United States Patent 9,328,346 (POLYCOMB-ASSOCIATED NON-CODING RNAS) - sequence listing, part 124

SEQ ID NO: 191357 - RNA, 77388 nt, Homo sapiens
caaucaaggagccguguggcucgccacuaaccucugcccugcagccgcgagggcgcgcgggaaaucccgagugcaucuggaauacgcagagucaguaagaccauggcuacguccucgaugucuaagguaugugguggccgaugcgcacuguggcucuaccgcugccucauuccccuuugaagaagggaugaagccgagguuacguaggcaucccuucccuggcuggagaggagggagggagcggcguacugagcugaggcguccuugcuccagaucaguugaggccaacuuugcuuggggagcgaggacgcggaucugccuugugguauggcuaggaggauuuuuaaguucugguugguggaggucggauguccugaugauguggcccagucucucauuuuuccaucucacaaauacugugcgccaagcacuccguuagguaccaagaugcagugguaaacaaaacagauucaguuucugcagucaagaaagucgguaaacauagauaaacugacgaucacaaauuuuaaguguuagcaaggaaaagaguucuaggcagacaacagaagagugggaagaaccuaauauagguugucggggguuagcggaggcuuuuuggagaaagugacccuuucgcugagaccugaaaaaugaguagaaguuagguuaaggauuagggcgaggagggcagagagaacagcauguuucuucggcccagaagauagaaauaaaauggcauauuagaggaauuuaaaaaucauaaucagaaaguagacaaagagugggagcgucaugaaaaaugagaaugaaaaaguaauguggaugcggguguguguggugggauaucuuauagaccuccucauguuggcuaccuagauggcaagaaauugcaagacauaguguaguugguaagaagauaagcccuagagcuguauuguccaauguguuagucacucaccacauguggcuauuuaaauuugaguuaaaauaaaguaagauuaaauaaaaauucaguuucuccguugcacuaaccacauuucaagugcucaaucaucacauguggcugcagcuaccauuuuagauagugcagauauaggacauuucuaucauuacagaaaguucuguuggacagcgcuguucuggaccacaaaaaguaagaccuugaguucuauuguaagugcagcgggaagccccugaaguuaagcugucugagaaagcugaaaaaugcacaugaagaagcuacauucucccuauguuaaaacaauggauugaugaagaaggcuaugucauggaucugauuuuuuauuuugauuaaaacgguuuaugagaagcagugcuuuuaaagacuacaucucaaggaaaaaggacaagcccugggguuuaagguuaugcuaguagagauucaaagguaguauuuuuauuagaaaugguacugguuuuauuuuguccugguuauaauguucuguagguuuugaauggucuaucccuuaauccuguugauugcauaagcaccucuuauuuuuauguaucuugcagaaaguaagauuuuucaggaaagcauuuuugguauuauaacaaaugucuguauugggaugagaccuuacaugaauaagaagcuuuaagaacuauuucaugaauuuauggaacugcaagcuuuuuuucuuuuucuuuucuuuuuuuucuugagacagagucuugcucuguuaccaggcuggagugcaguggcgcgaucucggcucacugcaaccuccaccuccccgauucaagcuauucucccaccucagccucccgggcaguugggauuacagacaugccccacuacacccagcuaauuuuguauuuuuagaagagacaggguuucaccauguuggccaggcgggucucgaacuccugaccucgagugauccgccagccucggccucccaaagugcuaggauuacaggcgugagccaccacgcccgguccuuaaacauaucaaaacauuuuagugucucuuucaucgugaaauuuucuggcuguuggccuuccucuaucucaaacaccaucacuugaccagcaguuccaaaugguuaaccauguuacuaccacugcccuauauuaagauccuuucugaucacuccucaugucuugcuccuuugaagcuccuuuuuccuuuacugaauugcagguggauuuggaaaggagguaaugacagguuugucaugguaucacaugauuuuucuaaauauguaugugauuucgcacacuucugcuaguugcagauauaagaauauaaggcacagggcugugugcaguggcucaugccuguaaucccaacacuuugggaggccgagguggguggaucaucugaggucaggaguucgagaccaaccugaccaacauggugaaaccacaucuguacuaaaauacaaaauuagccuggcauguuggugggcgccuguaaucccagccucucaggaggcugaggcaggagaaucgccugaacccgggagguagagguuacagugagccaagauugugccauugcacucuagccugggcaacagagggagacucugucucaacaauagcagaaaaaagaaucuaaggcacaguucuuaaaugggaacauguaauccaaauggcuacuuuauaguugcacagcggucuuuaacacuauccugagacaacuuuuccuagguaucguucuuucauucugucuuuuauuuuccauagaaaucgaaauauuuaagaaguuauccaucaggccgggugcaguggcucaugccucuaaucccagcacuuugggaggccgaggcggauggaucacgagaucaggagugcgagaccagccuggccaacauagugaaaccccgucucuacuaaaaauacaauaaauuagccaggcaugguggugggcaccugucaucccagcuacucaggaggcugaggcaggagaauggcuugaacccgggaggcaaagguugcagugagccaggaucgcaccauugcacuccagccuggacgacagagcgagacucugucucaaaaaaacaaacaaacaaacaaaaaaaaacuauaagcuauccaucauguaugacuuuagaauugguagaauagacuaggaccacuaacuugggggugaucuaccacuggucaaacaauaauaugaaacuaaacauagcugggaaauuaccaggacaguuauuuggcaagcauuuauucauuccauauucugauugccuaauauguauguuagcacuauuccaaacauuggagaaacaauuauaaauaaaauacaguuugugcuugaaggcacucacagucuacucagggagacacacccauaaacaacuacgauauacaauuaaagugacuuaaaacaaugcaaaauaaagauguucaaguacugagagaucucgaggaaaggagaauuucuggcuagagaauugugaaagguuuccugaaggagaugaguguugagucaaacuuuaauggauaaaugaguaggcauuuaucagaugaagagaaguauguagagugaaacagcugcaauuaucuauuuacuacuaagguuauagauacuucgaguuuaaauaaguuucggguugggagaacaucacuauuuucaaccuuuuuaaucuucauuuuuauuuauuuauuuuuugagacagagcuucgcucuuuguugcccaggcuggagugcaauggcacgaucucagcccacugcagccuccaucuccaggguucaagugauucuucugucugagccucccgaguagcugggauuacaggcucacaccaacacgccuggcuaauuuuugcauuuuuaguagagacaggauuucaccauguuggccaggcuggucucaaacuccugaccuugugauccacccgccuuggccucccagagugcugggauuacaggcaugagccacugugcccagcccauuuuaauguguaguauuaauuccuuuaaguuuaugaaaauggaaccuuucugggcuuaaauuuaaucagcuuuuauuuucuuugucuaccucuuagaucaggugucaaagagcaaaaucaaaaaugggcaucucaugggagggaggggagagaguagauagucccccuuguuguuuuagaauuuuccuucuauaggucagagagaagugaugugauuucuuagaaccugaaagaaauguguucucuccccuaacaucuuuuuuuaaaaaagugcuuacccauaaaauauuugguuaaucagauuucucugcuccuuggcuacuuugacuuuaugcuuuucgucuuucuuuuuauaggguugcuuuguuuuuaagccaaacuccaaaaagagaaagaucucucugccaauagguaaggugucugaauauuaaauuuuuuauucccuaccuucuuaaacuauuaggaacuaacccuaauugaauuuaguaauucucuugucuaaccuuggcuuacuugccauguugauguagcauuuauguuccaaggcauuggucaaagagauaagaggacaccccagggcucuaauugaaaagagaauccaauuacaccuuccaaagguaaguuggaagcaaauuuccuucaaaggauaugcugcuauucuuuaaaagagauugucuuuuugauuacuucucugccauuguuuuuuuaucuacaacuuuagaaaugaaagugaguuucugcuagagaaacauuuugauccuugaugaaguaaucaaaacaauaaaggcugacuggcaacccagauuucuaaugaugggggaaauguuauuuagaaaauaaaaugauaauugguaacauaaggaaaaccuaagaaagaaugauuauaaauuuguauauauuuucuaaugaaaauuguauaaaaauuauuuuugaguuaaaauacaauauucauggggagacuuaaauaugcuuaaaaauuuugaugugauauuccauuuuaugaauaaacuuggcaaaauaaauuaaagcaaucaucuaucuguauggagcauuuuagaacuuagggcuuaguaacuacauguguguuagaauacugcauguucuaacuuagggauaaaugcugugcacaucaauacaugcugagaaaaaagcccaaggucuuggaucucuuacaguaauucuaccugcuagagcacaaaguuauggaaucaccuggacuauaaguaaaggaauuggagugugauccugagccugaccagcucuauggcuuuggcccugcuguuuaaccuuucccuaagucucuucaucuguaaaaugagcaacuauacucacuuaucacuaagauuucucccuauucucauucuaucucucuaagagcuaacauguagugcuuuguaagacuaucauaaauaccaugugaauaaauuuguguuauuauggauuguuaccaccuuggccuuauaguuuguguuccaagacuccuaucucucacuagccugagggaagggaaaaagcugagaaugaguagcagaagacuuucuacucucacaauggcuacauauuuccaaguggcccagauuuccucucuuagucuucacauccuuucuaccaguuugcacccuccaucaucucucggaagcaccagggucccacacaguucucaaucacucuucauuucauaaaacaaauuuguuaaauuauugaguuuuaaucacucauagacacacauacucaugauauuaagggaguggauuuuuaucacucacucagacauacgcauacucacacacucauauacccauguguguaagagaggaaagacauuucuuuugguuuuguuuguugauuuauuuuagagacagggucucagucugucacccaggcuucaguucggcggccugaucauagcucacuucagccuugaaaacuccugggcuuaaaugauccucccaccucagccucccaaguaccugggacuacaggcaugcgcuacgacgccuggcuaauuauuuuuuaaaauuuuuuguagagacagggucucacuuuguugcccagguugguccugaauuccagggcucaagugauccucccaccucagaccucaaagugcugggauuacaggugugagccacugugcccagccuaauuuguuuguuuguuuuuguuuuuuuuuuuugagacggagucuagcucucagcaugaucucagcucacugcaaccuccgccucccagguucaagcgauucuccugccucagucucccgaguagcugggacuacaggcaugcgccacaaugccuggcuaauuuuuguauuuuuuaguagagaucggguuucacuauguuggccaggcugaucucgaacucccggccuugugaucugcccaccucagccuuccaaagugcuaggauuacaggugugagucacugugcucggcuguuuguuuuuuuguuguuuuuuuuuuuuuaaggcaaaaacaacacagguuguguuaaagucccagugguuuccugggaugaaguagggggaauuaacugcaaaaaggcaagagggaacuuucuggagugauggaaauguucucuguugacagagugguuauguaaguauauaccugggucaaacuguuaaaaugguuguguuuaauuauuuguaaauuauaccucaauaaaauucaauuaauaaaaaaagauacugucuucacuuuuuucauuuauauccugauaccuguuuagugaucaaauuaagaagacuugacuucuucaaucaaauccaguauuacuaucagaauguauuuauugcaccgguucucaaucauagcuucacauuagaaucauuuggggaacuuugaaaagucuuauuuuaauauaauuguagaugcacauauaauuacagguaauacucuuccaccaguaaguacccuacgaccaguuauccccaguggcaguaucuuacauaacuauaguacagugucacaauuaagaaacugauauuaauacaaucuagugaccuuauucaauuccaacuugugggacuuugaaaaaaugcagggugagaguuccuuaucccaaaucuugggaccagaaguguuuugguuauuggaauuuuuucagauuuugaaauauauaccuguauauaaugagauaaucuugggaaugagacccaagucuaaaaauaaaauucauucauguuucauauacaccuuaaccacauagccugaaacgaauuuuacauaauauuuuaaauaauauugugcaugaaacaaaguuuuggcuguguuuugacugcgaccugucacuugaggugagauauggaauuuuccacuuguggcaucauguugguacucaaaaaguuucagauucuggaggauuucagauuuuuggauuagagaugcucaaccugugccaaugcuaagacccuaacccggaucaauugaauuagaaucucaagaguggggccuaaguguuagaauuuuucaaaagcuccccacaggguuauugaguauauacauuccauauucagcacugugaaaauuaauuccaguggaaaaauuaugauauggaauuaagcauacccauguacuaguuuugaauugaaaaaaugaacuaugccacuguuugacuaaggaaauaaauggauaacuugaauauauagaauaggauuuuuuuuaaguaaugauauauauauauacacacacacacacacacacacacacacacauauauauauaauuuuuuuuuaaaauagagaugggaucuuacuauguugcccaggcugguccugaacuccugaguucaagugauccucccaccuuggccucccaaagugcugggauuacaggcgugagucaccaugccuggccacacauuucuuuaauguugcagauugcucaacuuacuagaaauaggucagagaaaauuaaagacuuguucccccauuaucauuagggacacauagcaugcagugacaucuaauaucaucaccaauguaauuauaacuaauacaguuguuaauauuucuuggauguuuacagugugccagacuguuuuguuuuucaagacaagaucucacucugucacccaggcuggagugcaguggcacaaucauaguccacugcaaacuugagcuccugggcuccgggaauccuccugccuuagccucagcuaggacuacaggcucaugucaccuugcuugcuaauuuauuuauuuuuuuuuuaaggugagaucucacuuuguuguccaggcuggucucaaauccugagcucaagcaguccaccugccuuggccucccaaagcgcugggauuauagacccagacuguuucaaucauuuuauauguguuaauuugauuaauccccucagcaaacuacaaggaauguauuaucgccauugaaauauauaaggauacuuagacauauaacuuucucaauguuauaauguuaguaaaugauagagcuaggauuugaacccaaccugucugauuccagagcucaugauuuaaccauagcuuaauacugccucucauuauauaaggccaaguuucuauuuagaacuuuuuguauugaauuuaagcuacaacuuauuaggauugguuuauaguuuuuaguacuaguaaaccugauguguauaauuguaugauuugaauuuugcuuuagaaguuugcuaggcuuuuuuuuuuuuuucauuauguggcucuaagaccaacggguaguguuauaauacgaaaaucuuugaggaauugacccugauuauaaggcagauggagcaggaaugagggaaacauacccagacuuuaacauuugccuucacuggcuucaguuguugaaacagauugacugaagaaguaggaagaugcucugcauuuugcccaccaucuguccccugacugaagacacuugggcacguaauuaagacugguaacucucccucuccucaguauucuguggaugacugcauauccagcaaaacaacuggauaggaacuggagagagagagacuggcagcagcacuggcacuguaggagauacccacacugaaguauagcacugugaauaggagccgaggcagguagaaaccuggcaacagugagagcuuauauucuucaguguaguuuuuaaauuuaccuaccugaucuguaacagacugagagaagucaugguaacaguuuaaaguauccuacugcuguguuucccaguuucuaagagguuuuucauguguauuuugaugcggcauuauucugcacauaaaaauugugucuugauuugccacuuucauguuaugcuaugauuuuaccuauuaauguaaagugacuauuuuuguucuuuuuaaagcuaccuuguuguucugcuuugucucuuuuuuuuauuauuuauuuauuuauuuauuuauuuauuuugaggcaagguuuugcucugucgcccaggcuggaguguaguggcacaauuucagcucacugcaaccucugccucccagguucaggugauucuccugccucagccuccugaguaccugggacuacagguguaugccaccacgcccggcuaauuuuuguauuuuuagcagagaugggguuucaccauguuggccaggguggucuccaaguccugagcuaaugaaccgcccaccuuggccucccaaagcgcugggauuacaggcaugugccaccacgcuggccugcuuugucucuuaauaauaguguccucuggcuagguggggugauguacgccuguaauaccagcacuuugggaggccaaggugggcagaucacuugaggucagguguucaagaccagccuggccaauguggugaaaccccgucucugcuaaaaauauaauuagccagauguggucgcgggcgccuguagucccagcuacucgggaggcugaggcaggagaaucacuuggaccugggaggcggagguugcaguaagcugagaucucaccacuucacuccagccugggcaacagagcgagacccugucucaaauaauaguaauaguaauaauagugucuccuugcuuucuuuuuuuguuggcauuuuaauucuauaaccuugucugccacuuuaccguacgaugacuucaauguauuccaaggcuuuugauaaaauuaaaaaucaauaguugcuaaaaacucugaguuaacuaugauuaggagagaaguuccuuaacaugaagugaauuuauauuccaaacuaucaguuaacauuaaaacuuggugguagauuauuagcagcagaaauuuaacgugaacacuccaguuguuacaauaaaauacguagcaguaaacaacaagaaauaugagggaaaguagaaaacuauaaggaaucuaaaauauuugauuaaaaaaagagaccugugauauugggguuggggauuuuuuaacauauuaaagaugggauuuuuccccaaaucagucuauggauuugauuuuaucuagucaaauaccaguacaacuaguuuugagaagugacaggauuacuguaaaauuaauuugaagaaguggcuuaaauuuuuuugaaagagaauaacaauguuugggggcagugggaggaagaccuaaauguauuugauaaaauguacaacauacaaagccauaauaauuaaaacaguucaagacugguaggagaauaggguuggauucaguagaacaaaauaaaaaguucaaacauaguucaaaguauauauaaguauuuagacuauaagggcaugucaaaucagcgggagaaggauggauuguacaauaaaggaggguuuuucaaaccaaaugucauaauuuaugugugaguuaugaaaucaauuuaguggacuaugaguauaaaacaggaaagaaaacauuugcuauuacauaauaagggugaguguuguuuuuugugacuuuaguuuuuguucauguguauauguguuagguuaugauauaaaguguauuccuuaauguggauuauaguuugaaaaguuugaaagccagugcaauaaaugguauuuucacaaauagcuaaccauuuggagaaagcauucaaaaaggauacaaaaauauacagacagaauaaaugaaagacuggacuaaacuaugucaguggaaaaauguaagaauaguaguaguaagucauucaauagaggagaguucaaagcaaauguaugaaacaaaguauacaagguuguagaauaacagcaaauaaugaaaacauuauuaaauguauauaacucaaaaaagccacuuaauaaaaacuguuagaaauuaaaaagcaaaugauagaaauacaguagaaagauugacauuuuuaaucuuaaauaugccauaaauaugguaaaaauaaaagauuauaaaaaaugaaauacagaggauauugaauguuaccuguccccaaauauauguuuuugaugaauguaaaaaaaauuaaggccaggcaagguggcucacacuuguaaucccaguacuuugggaggccaaggugggcagaucacuugaggucaggaguuugagaccagccuggccaacauggugaaaccccaucucuacuaaaaauacaaaauugagcgggcgugguggcacgugccuguagucacagccacucgggaggcugaggcaggagagaaucacuugaaccugggaggcggagaucgcacugagccaacaucaugccacugcacuccagccugggugacagagugagacuccauaucaaaaaaaaaaaaaauuucacuucugucacuuacuguguaacuuugcacguaagaucuauaacuuauacuauuauaugaaaaaagaaacugacuuauuucuuucuguuuuuagaggacuauuuuaacaaagggaaaaaugagccugaggacaguaagcuucgauucgaaacuuaucaguugauauggcagcagaugaaaucugaaaaugaggugaauacuuuuuuuaauaauuuucuguaacacccuaagucucauuuuuguugcaucucaucuuccuuuccaccaguuuacaagaguauugaugaaauauaggaaguauuggucaagcauagccuguauauccuuaaaaaaacaaccauaauccagccugggcaacuuggugaaacccugucucuacaaaagcuacaaaaacuagcugggcaugguggugugcacuuguaauuccagcuacucaggaggcuaaguugggaggauaacuugagccugggagguggagguugcagugagccgagauaguaccacggcacuccagccugggcagcagagagagaucuugucucaaaaacaaaaacaaaaaaaacucauauuucuugugaguggaacagauguuuaugauagcuguuaaggcaaggagcuuucaaauggugacgcucuuaaauuauccuuucagguauacaacugugaaaucaagcuguuucuaaacuccuucacuuucucaucuuuauauuccagcucugaaacauuucuucacuauagcaaauugguagcucuagggccagcauuuuaggcugacaacuuuuuuuuuuuuuuuggccaacacaguguuguaguuuuugguuuaauugccuuucggaagguuauauacuuuccaguuuauuacugccgccuaccaguccuuacugauuuacaccuagugguaaugagcaaaggcucauucacguauuccaugugauccuucaagguauuugaauuugugguuuccaguuuaggccgucuucauuucugaaucuggauuguuauauccuccugacuggcaucccugacaccauuggccaaauuagaaaagacccuuuucaaggcaaaugcagcccaauuccaggcaaccccuccagcccuguugccagauuaacccuucuuaacccugauccaauuaugucuuuacuucacaucccuucaguggugcuccccauaggacaaaauccaaacccuuuaaugucauauaucauauauauauuauauauuauauauauauauacacguuuauauauauauacacauauauaauauauauauauauauacauauauauauacaauuuuuuuuuuugagacaaggucuugcucugucacccaggcuggcguguaguggcaugaucauagcuuacugcagccuugaccucccagacucaagugacccucucaccucagcuucccuagaagcugggaccacagaugugcaccacuacacccagcuaauuugucuuuuaucuaaaaagaugaggucucacuaugccgaccaggcuugagagggaauuuuuaaugggggaacccagagcacuaauuacuagagauuuaaggaaaaaacauuuuuuaauuagguucaucuuuugaucauuuuacaucauugaauccaugacaauuuucuuuccacaaccaggaaagacaucagauuauuauuucuaauaauaauaaguuuuuguguguucuuuguagcgacuacaagaggaauuaaauaaaaacuuguuugacaaucugauugaauuucugcaaaaaucacauucuggauuccagaagaauucaagagacuugggcggucaaauaaaacucagagaaauuccaacugcugcucuuguucuugguauauaugcguauguuuguucaugcaugcaucucuguguauuucguuuuuaaauuuuuuuuuauuguugagaauaguggaaggaccuguuuugaugagccuauuuugucucucuuauuuguacaauuaaaccaacuauaguuuauauuacauauuuucaaaaaccaauaaaaauuccuuaucuuuacagacgaucauauguuuguaaauuaaaaggaauuuaucuagcuaauguucuccccaacuuuuggucggaagggaaaauauauuuguuuuacucuuucuuuguagauacauuacaagaguauaugagauuugguaauaaagaaacuaccaguguuaguagauuugguuuucauacuuuuuuuagucguaucuucaauggaauuacucuaugaccuuaauuuuauuuuccugugcauaguuuuuccaucuuagauuguuucauuauauucauauuaauuaccuacaaggagguguuuggaugaauugcacauaaauugcuuucaaauugcagguuguaaauuucuuaaguacuuaaacauccaucauuaauaucucaucuuuaccaaacauuuggauuccagcacaauggaaaaaauuucuuuggaauauuagcaaauuuucuucauucccuuugaaaacaaaguugaauuuauuuggguuccaaacaugcucuuaauuucucuuucaauuuauucaagauuuguuaugcuaguuagcucugagauaaggaauuaauucucaaccucaaugcacccacagauaaccuccagggaucguauuaaaauguagauuuugguuaaugggucuaggguggggccugaaauuuuacauuucuaacaggguaccagcugaugcccauagucccaggaccacacuaauaagacucaagggaaugauuuuuauuaugcuguggaccagcuuuacaaugcaacaucuaaaaauucucccauuugaggaaaaacugaggcccagugauggcccacuuguaccaagcuaauggaaagaauguuuuaaaaucauggucugaggagaacauuuuucuaguuaaacacauuguugauuaucuuguuugugauagacaaguucauuguuuuauaauacaaauauaacgaauauaauguuauuaauaaauagcuuauagccagucagugaaagccaagauaacccaguguuuuacugaacuucuaaauuuguucagggauguguuauuauaaucauagaccauaaugcaugcuaggaaucauuuugauauuuucuauuuucaauauccauuuaaaaaauagucugcuaauauuuuuauucuuuggcucuccuagaaaaaaaaaaugguuuauuauugcuggcauggaugauucugaaauuuuucuuuuucuuccaagcaaugaaaguuuugcagcuguaacucuuaagcaguuugaaaguggcugcugcuguuaucugccuaagcaccaaaugacuuucuagaaaucacagaugguuauguuagggaagauaccaguuaacagaauuuuuuuccaaaguagugggaaauuuuucacucaaaaauuugauaacuguaugcggugcccugaaacucugauuugcagaaaugaaaaccagggauuccguaaauaccaaaagaacccauaguuuuacuuuuuuaaaauuuuuauagagacagguucucaccauguuugccaggcuguucuugaacuccuggcuucaagugauccucccaaagugcugggauuaugggcaugagcuauacugcaccuggccaguuuuaauuuccuuaaagagcuuguuaggaauuugacaaagcaaugaaauuacuucuaagauguuuucaagggucggcugggcacaguggcucacgccuguaaucccagcacguugggaggcugaggcggguggaucacuugaggucgggaguuugagaccagccuggccaacguggugaaacccugucucuauuaaaacuacaaaaauuagccggugugguggcacaugccuguaauuccagcuacucaggaggcugaggcaggagaaucaccugaacuugggaggugaaggaugcagugagcugagauugagcugcugcacuccagccuggaugacagagcgagauucugucucaaaaaaaaaaaaaagaagcuuucaagugcacaucccaguaauuuguuugaaagaggaauugugcaaaauaucuuuccugacaaauauaguuuaugccuuuggauagcuauuguuaauggauaucauuuauauaguauauuuccuugguuucuguuauuaaucauuuuuuaaauguuuuuacuuguuugcuugauauguuaaauagcuuuugucauuaaauuauuauuaauaaaaauggugauguaauauugauguauuaucucauaggugugaaugucacagaucaugauuugacauucggaagucuaacagaggcccuucagaauaaugucacaccauauguagucucauugcaagcuaaagauuguccagguaaaaauauaaaugccauaauaaccuugaugagauguuacagacuucuuucauccuuuucucucuuuuucaggcuuucuuuaucccuuuuuuugguggaaagaacacagugcuauguuuuaggcagggugagguuugggggcucucagaguaauugugacuauuacagaacucugccuucuuuugcugucuuuguucuugacccauuucugcccuaucagcuuaacugccgguagcaguccaggcauuuugugagaugcauucuuuaacccagugaaacguuuaauaaguagaaagacuuaggacagaaagcugagaauuggggaaugaggagcucuugucagcucaaaagagaguagaccacaugggcucauguuucagccauaaaucaucuuauugucccacuuugaaaagccaccauggugaaaaauaguccacugacagagguaauccugagcaugugaacccaugaaaucauaaagaguguucacacuaauauauuaaaaagcuuuuuuuuuuuuucuuuugagacagggucucacucuguugccuaggcuguacuacaguagcaugaucauagcucagugcagcuugaacuccuggccucaagcaguucucccacuucagcuuccccaguaccuaggacuacaggugcaugccauuacgcucagcuacaucagcuacauugugggguuuuguuguuguuguuguuuguagagauugggucuugcuguguuguccagacuggucuugaacuccugggcucaaacaauccuccugccuuggcuucccaaagugcugggauuacaucuugagucaccaugccuggcccuaaugugguaaaauuuguuuggauuagauugauaaaagagauuuaugugcuuauauugcuuucauauucauaaacugauugaaauuaaguaaaagcccuuaaaggcaucuuuaaaaauggcuauaugaaagauuuauaaucaguaaaauaauucauaugacacuugauuuuucuuagggaacuugaaaacuguuuauuuuccuauguaauuuaaauacauauuccuaaaauuuauaguuugcauaucuacacauuugcuucugugaccuuuuuauuauagauaauauacauaaauggcugggagcaguguuugaugcuuguaaucccagcacuuugggaggcugaggcaggcagaucaugaggugaggaguucgagaccagccuggccaacauggcaaaaccccgucucuacuaaaaaauacaaaaauuagcuggguaugguggcacgcgccuguaaucccagcuacuggggaggcuugaggcaggagaauugcuugaacccgggaggcagagguuguauugagccgagauccugccacuguacuccagccugggcaacagagcgagacuccaucucaaaaaaaaaaaauaaagauaauauacauaagcuuugguuuagucuuagucugaauuaaugaagguacuaaugagcaucaguaguuaauauguuaaauguuacauuagcuguauugaugguaaguauaaaaaaacacauucuaccaaaaaaaaaaguaauacacucagcaagaaguuucaagagcuuugguuuuauuuuuagaagaggcagagauaagcuuucuuacuuuuuauauuccacagauaugaaacauuuuuugcaaaaguugaucucacaguugauggacugcuguguagauauaaaauccaaagaggaggaaaguguucacgucacccaaagaaagacacauuauucaauggauucacuuuccaguugguauaugacugucacacagguagauauaaacugaugauuuucucccaggaaauugacguaugauugauguggcuuggaauaauauuagacaguacuguuuugaucuaacaaggauauguuucugcagcacuagguguuaauuuaaaaguagguauuuauuuuuucuaaugcuacucgaauuuuaaaauguucuuuuauuaguaugcagccuaauuccagguaagugcuuagguuuuuacaaggacauauuauuuguuggagaauguccucuaaugacaaaaacagagcaucaggaauugcuucuguugcauguuccaucucugugacaguaacuauaacuuuaguauauuaucucuuauguuccucaauguuugcuuuguccaauagaaccaugcugcuaguauccacugucaacuuaguucaaugaagaauaaucauguauuuucuaaagucuaauuuguuuuauguuuagaguucuuagggaaucaguguucuuuaaguaaaguauguuagacaaacagauaaguaaaaagaaguuccauucuaccaugacagucuggugaaaaauaauaaccuagguuaacacuagguaauugcgucauaaaaccauagucuuagguuauggugcuguguagccagacaguaugggaaaaaaaauacugugguuacauuuuccaaucaacauuuuugcugaaaucaucguaagugaaguuucauuuugcuuuauauagggacuaaacuacgucuaauacuuaccauaauaccugauuugcuccacaauuuuagacuuuccagauaaaaugcuacuuuugguuuaugucagauaucuuuuuaaaaauugagauuggaccagaugauaccuaguauccauuucaggcuugaaauuucacaguggcagaguagcaagcacuacuauucauuauauuuuuuucauuaaaaauacuaguucucacuauaaagcaaagcagaauauaacuuucuaccaacagaaaaaucaauuuuguagaaaauuuccucuuccauguuuuuuucugucauuuccuuagcagaaaauauaaauauuucauaugaguuauagauuuuuacugaaccuuuuucuucuugguuauuauucccaugucagacacagcaagauucuaguaaccugaguuucuauuuaucgugugguagaaaaaaaauaaacaguguuauugugaaauuuaaagagagauaugucaacauguggcauuauaacauuguuugagugguaaggcuuaccuuuaacucuuucuuucugcaauggcuuaaaagaagacggacccaaaaaugcuaagcaaaaaaaggacuacuucuagccaauggcagucuccuccuguugucguuaucuugaaggauauggaaagcuuugccacaaaaguacuacaagacuucauaauuaucagcagguagaugguguauuaccuggcuuuuaugaaaaacucccuuuuuaagaaaauacuacuuuuaacuugaaaaguauaaucuucauuuuaauaccaacuggauaaaaaucaaaguauucaaauucuuuauaauugaauauucaaagacuuccuaucagauuuuccauuugcuuuuugagccaagaaugagaaucaaaggcacauuuagccaguuuuaaauugacaugguaagauaguauuaaauaugguuuuucucaccaagauugacugucucuuacucacccauuaaauagauaaacuacuccagguugaguuuguuguuuuuguuuuuuucuuuuuuuuuuuugagauggagcuuuguucuguugcccaggcuggagugcagugguacgaucucggcucacugcagccuccgccuccuggguucaagcaauucugccucagccuccugaguagcugggauuacaggugcccaccaccacaccuggcuaauuuuuguauuuuuaguagaaacagaguuucaccauguuggccaggcuguucucgaacuccugaccucaggugaucugccugccucggccucccaaagugcugggauuacaggagugagccaccauaccuggcuaaguugagauuuuuauuaggucuuauuuucugauacccauccauccuuagaugcucugaguugcauauaguuuuacuaagcaaaagugucuucuaaauaacauuauuuugcauuuauauaauacuucuagugagaaacuauuuucacgauugcauugcgucuucaaagcaaucaugugagacucagaauugaaauaaugaacucuuauuuuaaaauccagugacaugcauuuucccugguguauuuuuuaggauggaauuuauuuuggccucuucuauaugucaacuuguuuuaauaguuauagcuacauuugccuaaagcuauauauuguguuaaauaauuuacuaguauacuuuauuuuuauuuuuauuuuuggagacagagucucgcucugucccccaggcuggagugcaguggcgccuucucaacucccugccaccuccgccucccggguucaagcaguucucaugccucagccucccaaguagcugggauuacaggugcccgcugccacgccuagcuaauuuuuguauuuuuaguagagacaggguuucaccauauuagccaggcuggucucaaacuccugaccucaggugaucugccuuccuuagugcucuuuggggccucccaaagugcuaggauuacagacaugagccaccacacccagcuaauuuacuaauauacuuuauuuuuuuuuauuuuuuauuuuuuuugagacggagucucgcucugucgcccaggucggacugcggacugcaguggcgcaaucucggcucacugcaagcuccgcuucccggguucacgccauucuccugccucagccucccgaguagcugggacuacaggcgcccgccaccgcgccuggcuaauuuuuuguauuuuuaguagagacgggguuucaccuuguuagccaggauggucucgaucuccugaccucaugauccacccgccucggccucccaaagugcugggauuacaggcgugagccaccgcgcccggccuacuaauauacuuuaaauuucuacuuugauaggaucuuuuuuccuucauugauucuaagaguucuauauauuaggacuuuucuuuuuuuuuuuuuuuuuuuugagacagggucuggcucugucacccaggcuagagcgcagugacaugaucuuggcucacugcacccuccaccuccugggcuuaagcaguccucccuucucagguccccaaguagcuaggacuauaggcacacaccaccaugcccggcuaauuuuuguauuuuuuguagagaugggguuuugccguguugcccaggcuggucucaaacucuuggccucaagagaucugcccuccucagucucccaacgugcugggauuacagacaugaaccaucgcacccagcccagauccuaggacuugcaugaaccauugcacccagcccagauccuaggacuuuucuuaaugcugacacugaacugcuuagcaugcuuggaaaguacauaguacaaaauagugacagaaaagcuguacuuuuuuuuggagcuuagacuuaaugacuaccuuagccaucaaaagugaggaagacuauagaaagggcucaaacuuugaaugagauauuaaauggaaugguaucuaacaucucuucuaacacuuaagauuguauaaucuucggcccgggcaugguggcucacgccuguaaucccagcacuuugggaggccgaaguggguggaucacaugaagucaggaguuugagaccagccugaccaauauggugaaaccccaucuccacuaaaauuaaaaaauuaggcaugguggcacgcacauguagucccagcuacucgggaggcugaggcaggagaaucgcuugaacccaggagguggagguugcagugagccgagauugcaccacugcacuccagucugggugacagagcaggacuccaucugaaaaaaaaaaaagaaaaaagaugguauaaucuucaggaaaacuuucuggaccucucuguucuuauuuauaaaaugagaggauuuauuaagagauugauuucaaagcuagacugucuggaaaguaauuauuucucuguuuaauagaagaaagugaaagacuuagaaaauuuuaguguuugcaaugauaauccuuaacagugucuuauaaaguaagcauuaaaauaaaguuugucuuauguugaaauaugauguauugaaauauauuugcuaaauaaauuucacuuuugugucugucuuucaaaacuagucaacaucuccaugaauuuccacuaauacucauuuuuggaauagccacaucuccuauuaucauccaccgauugcuuccucaugcaguaucaucucuauugugcauagaacuguuccaaucuuugucuuguaaggagcaccugacuacgguacucgauaagguaaaaagaauaaguuuuaccagugaaauaggaugaaaagaaaacugccaauaauagauuguuaagauaacuguuaacaauaagccucuacaacucucugaguacuauauugaacauauuccuucacauacuuuaauauuuuuacuuaauaauuuuuguaguguuuuauaguuuuacagugauuuuguauauuaccucuucagguaaaauauaagcuuuaugaaaagagugaucauaucucucuauguacuuaaucucuuuauaucuuuacucaauagaaaauuauagguuuauaauguaaauuuuuacagaauuuguagacuuuguaguaacaauguauuuugacucuuacauuuugauuuuucuaauuuuuauuuuuuugagaaggagucuagcucugucauccaggcuggagugcagugacgaaaucuuggcucacugcaaccucugccucccagguucaagugauucuccugccgcagcaucucaaguagcugggacuucaugaggugugccgccacgccuggcuaauuuguauuuuuaguagacacaggguaccauauuggccaggcuggucuggaacuccugaccucaagugaucuaccugccuuggccucccaaagugcugggauuacaggcaugagccgccacacccagccugacuccuuacauuuuguauaaaaugauuugaaguuuuuaguggacuguuuccuaacugauuugucaugcugcucuugacaacaaauacuaacauuuuccuagaccuuagcaacuaaaguuaauuaacuauguuucuacauaaaugcaaguaugauucuuuaauauugacuguauuagucuguucucacgcugcugauaaagacacaccugagacugggcaauuuacaaaagaaagagguuuaauggacucauaguuccacuuggcuggggaggccucacaaucaugguggaaggcaaggaggagcaagucacaucuuacauagauggcagcaggcaaagugagagagcuuguacaggggaacuccucuuuauaaaaccaucagaucucaugagacuuauucacuaucaugagaacagcacaggaaagacuugcucccaugauucaauuaccgcccaccaggucccucccauagcacuugggaauucaagaugagauuuggguggggacacaaccaaaccauaucauucugccccuggccccucccaaaucacauguccucacauuucaaaaccaaucaugccuucccaacagucccccaaaguccuaacucauuucagcauuaacucaauaguccacaguccaaagucucauccgagacaaggcaagucccuucugccuaugagccuguagaaucaaaagcaaguuaguuacuuccuagauacaauggggguacaggcauuggguaaauacagccauuccaaaugggagaaauuggccaaaacaaaggaguuacaggccccaugcaaaucugaaauccagcgagguagucaagucuuacagcuccagaugaucuccuuugacuccauuucucacauccaggucaugcugaugcaagagguggguucccauggucuuuggcagcuucaccccuguugcuuugcagguuacagccucccuccuggcugccuucaugggcugguguuaagugucugcagcuuuuccaggcacacggugcaagcuguugguggaucuaccauucugggguguagaggaugguagcccuuuucucacagcuccacuaggcagugccccaguaaggacucuguguggggacuccaaccccacauuucccuuucacacugcccuagcagagguucuccaugaggacccugccccuacagcaaacuucugccuggacacccaggcuuuuccauacaucuucugaaaucuagacggagguucccacaccccaguucugugcacucacaggcucaacacgauguggaagcugccagggcuuggggcuugcacucucugaagccguggcccgaacuuuguguuggcccuuuucagccacagcuggaguggcuaggacacagcaccaauuuccuaagcugcacacagcacggggacucugggcccagcccgugaaaucgcuuuugccuccuaggucuccaggcuugugaugggaggggcugccaugaagaccucugacaugcccuggagauauuuucuccauuguuuuggggauuaacguuuggcucuuuguuacuuacggaaauuucugcagcugacuugaauuucuccucagaaaugggauuuucuuuucuaucucauugucaggcugcaaauuuuccaaacuuuuaugcccugcuucccucauaaaauggaaugccuuuaacagaacucaagucaccucuugaaugcuuugcugcuuagaaauuuguuccucaggauacccaaaaucaucucccucaaguucaaaguuccacaaaucucuggggcaggggcaaaaugccgccagucucuuugcuaaaacauaacaagagucaccuuugcuccaguuuccaacaaguuugucaucuccaucugagacccccucagccuguuucauuguccauaucauuaucagcauuuuggucaaagacauucaauaagucucuagguaguuacaaacuuucccacauuuuccugucuucugagcccuccaaacuguuccaaccucugccugucauccaguuccaaagucacuuccacauuuuuggguaucuuuucagcagugccccacucuacugguaccaauuuacuguauuagucuguucucacaccgcugauaaagacauaggcgagacugggcaauuuacaaaagaaagagguuuaauggacucaguuccacauggcuggggaggccucaaucaugguggaaggcaaggaggaacaaaucacaucuuacauggcugguagcaggcaaagagagagagcuugugcaggggaacuccucuuuauaaaaccaucagguuucauaagacuuauucacugucaugagaacagcaugggaaagacuuuuccccaugauucaguuaccucccaccaggucccucccacagcacuugggaauucaagaugggauuuggguggggacacagccaaaccauaucauugaccuuccccaaauugcuucuggacucaccuccuuuaagaugugcuuuaugcugcuuauuuaagguaaacuaaaaacaaccugcccacuagccacuuacacauggguuuuaguguuuuucuuuuuuuccauaaaggugauuuauagacacuuuaaggaaaauguuuucaagcugcuauuuuuaaauuugcuuggcuaggccggaaaggguggcaagcaccuauaaucccuuuuacuugguaggcugaggugggagaaucacuugagcccagaaguucaaggcuacagugagcuaugaugccaccacugcacuccagccugggcaaaagagcaagaacuuuccucuacaaaaagaaaacaaaaaacuugguuauagccaaguucaauuggccuuuuacaacuaugcuucuguuuaagaagccuugugugacuuuucauuuccagauguaaaacaucacuauagacaauugaaaauuagccaaauaauacaaauucagcuauucuauacuuuugaaauagacaucugugaaauagacauuuguguuucucauucaacaauacauaauauauuacucuucauuaauuugaaucaguaguaaugaaaaaaaucucaucugguaauaagaauugccaaagccugcagcuucuucagugguuucuggugaggaaaaaaaaaaggaugauauaguuaauaggugguauuuuuuuuuaauuaggaauuugauggaagaugguauagaucuuugguucugaagauacaguauaaguagcuucuuuuuguuacucuuguauaaauuaacuuaaaauuuuuguugacauuugagcuuaaaaaacuagcuauuauugcagcuuucauaguuaacugugucauaauaucauucuuugccucauuauuaauacuuaguauuuaugaagagugaagacuaacaaggagugugucccccucccuuuuaaucucuuucagcuacuucuuacaacucaguuucccuuuaaaauaaaugaaaaaguauuacagguucugaccaacaucuuuuuguaucaugauuucucaguucaaaacuuuauaaaaggacuucagguaagaacacaguaauggguuugaaaauucucaagcugauucuaaauaauuugcacauuauuucaggcugucuagugugauaggcauuuuaaauggcaaaaucuagaauaaguaaauuccaguuauuuuauucuagguucuacaauuccuuuguuaccuugcagcaaacuguagagaaugcacucauuaggauaucaauaaugggaaaagacuucuauuccagcaauucuuaaccauuuuggggguaggggcaagcagacuuuuuugguuuguuuccgagacucucaugagagcuuauggacuuuuucuaccaaggaaaugcuauauauaaggggucagcaaacuucuguaaagggccagauauuaaacauuuuuagcuuuuuuuuuuuucgagauggaguuucacuuuguugcccaggcuggagugcaguggcaugaucucagcucacugcaaccuucgccucccggguucaagcaauucugccucagccucccauguagcugggauuacaggugcgugccaccacgccuggcuaauuuuuguauauuuaguagaaacagggcuucaccauguuggccaggcuggucucgaacuccugaccucaggugauccacccaccuugguucccagagugcugggauuacaggccugagccacuacgcccagcccauuuuuagcuuugcaugcuacauguggucacugcuguugcuguuucuguuucuucuucuuuaauaauccuuuaaagauauaaaaaagguuuuuaguuucuggaccaugcaugugugugugugugugugucucuguaauuuguauucugauacauugggaauucauuuucacuaguuucaugaauugccugaagcuaauucaggaauuuagcuucaugauauaugcuguaaccuaaaaaagauccccauucuccaguuguuuaaaaguuaguauuauuuccuuuucuuggaagcuacauaaguguagucauuuugaauacaugccaguugucuaguucauuaaaaccuauguauuaugccaggcacgguggcucaugcguauaaucccagcauuuuaggaagucaaggugggaggaucacuugagcuuaguaguuugagaccagccugaacaacauaaugcagccucaucucuauuaaaaauaaaaaauaagccaggcgugguggcuuauuuauagagucccagguccucgggagggugaggugggagaaucacaugagccugggaagucaaggcugcagugagccauaauugugucacugcacucuagccugggugacagagcaagagaccugucucuauaaaaaacaaacaaaauucugauuuuaaaaaccuauauauguauuaguaaccuuuggugcaaaaauucaauuugauaauacuucauuuuguguagugccuugaagauuauaaauuauuucucauguuuccuuccuucaaaaaaagauugcagugguuucuuuggcuaauauguaucuuuuccucccaacuuugacuuuuuaaagaguauuuuaaaagaauaaagcauuauuuaccuuaggaauauguagaauuaaaugauauuaagauuaaacuuucuaaauuauuucuuuaauuucauuucauucauuuacucauaaauacuugucaagaaccuauugucaaccaagcacuaugcugaacccugaagauacagauaaaaaugaaaucucugggcugggcgcgguggcucacgccuauaaucccagcacuuggggaggccgaggcaggcagaucaugauaucaggaguucgaggccagccuggccaacauggugaaacccugucucuacuaaaaauacaaaaaauuagccaggcaugguggcgcaugccucuaaucccagcuacuuggggggcugaggcaggagaucaccuaaaccugggagguggagguuguagugagcgagugagcggagaucaugccacugcacuccagccugggcaacagugugaggcuccaucucaaaaaaaaaaaaagaaaucucugccuucaaauuguuauuuguuuaaugauggaggcaaaacaguaaacccacaaaucugaguagucagugcuaugaaagaaacaugcccugggguuccauaggaaaacagaaguguaugccuaagaaauaggagcgagccaggucagaauuucaggcaaaagcaacaguaggggaagagagaucuguuagaaugcuauugcaguaaucuagacaggacaugacaaggacuuaaauaaacuaagguaaugguaguggaacuggagaggaggaaacaaauuugaggaugagaucgaauaaaaaaaccuagugacuaaguaggucauaggauguucuguuguuuuuuuuuuucuuacuugacuugaagcugaaagguuaagagaggaguaagaugacacaggcucuagcuuggcagauuggagguuaguaccguuuauuaacuguacauguuaauacauagcaaagagcaagguuguugugagaaaaggaugaguuucuuuuuguaucugguuaauuuagggguguguuagacauaaagauuuugugcucaggagaaagauuuggacuggaaauagauauuuaggacuuauccuuaaaagguggcaguuaaaauaauguuaugaggaugaaaugucagcuagagggaguaaggaaaggcuaagggcagcaccuuaagacaaacugaccuguaaaacugagcaguagaaaaggagacuaaaaacaaggagaaccgguagaaaguggaguaccacugaagccaagggaaaaagagauucaggaaauagaaacuguacucuaaauaccuugagacagaaaguaaaggacauuaaccaaguuacuuaaucucucagggucucaguuuucucauuuguaaaauaaagcaaucagauuagaugauuuuaugguuuccugauaauuuauuaagcacuuccuuuaugcuugacacuuuacuaaacuauuuacaugguuuuuuuguuuuuguuucuuuuugagauaggguuucgcucugucgcccaggcuggagugcaguggcauaaucugagcucacugcaaccuccgucucccgauuucaagugcuucuccugccucagccuccugagcagcugggauuacaggcaugcgccaccacgccuggcuaauuuuguauuuuuaguagagaugggguuucaccauguuggccaggcuggucucgaacuucugaccuccggugauccacccaccuuggccucccaaaguacugauauuauaggcgugagccaccuugccuggccugcaugguuuuauucauguguauuauccucaguuuugcacaugaagaaauuaagauuuaaguuaaguggcuuggccaaggucacaccacuaacaagugacagcaucuuuagaccucauuuccccaguuuuccuaguccucaguggaaaauauugguaagucgugauuucuacuugagacagagucucacucuguugcccaggcuggucucaaacuccugagcucaagcgaucuuccaucuuaguuuccugaguaacuaggacuauguaauuccugauuuccauaggauguacagcaggacauauuaucauucuguguguuuuagccuucccuucauuagguggauauguuaaccaacuuguugauugacccagauauugaaaacacacuugaacaaaauaguuaagugauaauggguucauauccuauuuguagcucuacuguaacuucuguggcuuccucccauuccucuuccgcagcaagccccuuagccuguuuaguuuuuauuuuucucauguccgaaaaguacuguuaacauugggauaagcauuaucacuuugacauaauuagaaaagagaagaaacaaaauuauguuaauaugugcaaaaguaauuuagcaccuggcauaaacaguugcuuucuauuuuguacuuguuucuaaguuaggcaggcccuuugccuuacagccuuagagaauggacuauuuuggaagauuuccucuagccuuggguaucuuguugucagcauuaugaacucagaaauucauuaucaguucccccaggaaggaucaagcccaagauuauugauucaucccaaacaaauaccuuaagauggauauguaaccuaacaugcuaauuuauuaauuugugaugaggagugaccaguaucaggguaccugaaaauaccaaacuggucaagcaaaguuugcuuagaaucaacauaaugaacauuugcauagucuugcaaguuauaccaguuucuagguauaaaacucaagacuauccaaauguauacaagauuauccaaacguucauuauguugauucuaagcaaacugaauguuagaaucuggaaaauugucuucccuucuaccauagagcccacagcauucuauuauuaaaaugcuuauaucuaccagauaguacaccauguuuuccuccaugggaaaaaaauuaauuuguaaagauaaauuuucaucauucacuuuaauccauaggcacagcuccuaccauugcagcauuauuuuuuguaacagaccaguuuuuacacugauuuuagauuggcauuuucuuaugaguuuugggguaucuauuagacccuuucuuuaaaccucaguuugguccacaccacauuuguaauuauuauguguugcuuuugcagauagcuguucuauccauuugcauuaguuuaucuuaguuuguauuucaaagauuaccauuuucugaccuucuucacagaauuggaaccuuaaaauauggaguuauauagccauuuuuauguuguuugcaguguuauugugacauuauuaaauauauuagugccauaaauacuuuggcucuuuaaaaaaauccuuaaaauugagcagauuguagcgcaauagauuuacugccaaaauauaacaaauauguuuaaucuucacaugucuuucagcuuucucuauuagagcauuucuauucccagcccuuaaguguccugugcuguaaucuuccagaagccaaaagaagaauaaauuuuuuaucaaauaaucaaugugaaaacauccgacgucuaccaucuuuuaggagguaaaaagagaaguacauguuuaacacauacuauacuagaauuugguacuaaauaagagaucucagauccaguuauuucugaaguagggaaagaaauaguaaccuauucuguuuuuaauugugggauuucccuuguuggauuugaaaauuuggcaaaaagaaaaguauuuuuacaaagggacauaauuugcaaguucuccagaguuacuuuuuagaaauaacauuuccuauuccugggguuuauggccuuuuuuaauguuuauaucuauagacuaugaaguccagcugauuuaaggaguuuaaaauuaccauuaaaccauaaaugucauacugaauuuauuuuugugaagaaaugaaaaaaauguggcuaccaaucuagguaguucuuuuucccaauaugcuauuuaaauauguugaauguuuaauuuucucuuuuuauguauggaauggugaaaauucuagguacguggaaaagcaagcuucagaaaagcaaguugcgcucuugaccaaugagagauauuugaagguaggaaugugaauguguuucaguuucauucucuuuuuccuuucauaaagaagaauaugcauguaacauuuauugaguuaauaaaacauauuugugcaucuuaauauuuauacagugaaguacugggucuugauagucaccuaggaaugugaguuuuaaagaugacauaaaaccuuagcucuaaaaguugaggcuuuuuuuaaucaagaaaaaauauuaaacaccaaguuucucuuguggccuauuuugaaagcaccuuuagaucuauagagaucugcuaugugaaucuuuuuccaccuagcaguuuuggaaucugccagcaauuucguuguaauguucuuuuuaaaggcugugauaaauaaaagcauuuagaagccaggcagcuuaggcgucugcugcuaaguggguauugauuugauuugaagaaauaucauuauauauugauaauauaaagcuaggaaagaaguaaugagcuuagaaaauuaucagugagcuguacaacauaaggaauaucaaaagaaggagggcuucuuucuugaauaaauaauacuuggauguaguauauaauucaaaauggauauaguauacuauauauguuauaguauauaauauacagugaaaggcuucguuucaccugucuuccaacuacccaugucccuucccuggauacagccaguguuacuaguuucuuauauuucauucuagauagagucuccauacauacaaguaauuauauuauauuuuggcaguugcugccuucuuacaauauucugcaccuuguuucauuuuguacuuaaucuuggaaaucauuccauauuaguacugaagagugacauaguagucuauugaauuaauguaccuuuuuuaagaacaugccucuuacugaugagcauuuagaaacacauaaugucacauuuauuuucauacuccucaugccuuuuuuaggaaaaaguuguuagaauauuguaaugauaguaagaugagauugaagguaagccauagugcuaaagaugaguuuugguaauacauacgauuuucagauuuugaacaagagaauguuagaucuuauacauguacaauuauauauccauuuaaaaaauuaaaaauguguuuuaaaaaauguuagauucuagagggcauguguuucccuccauugguaauuuaugcccauuauaaaugcucaaaaaauauucagaauggcuuuuauuaaacauuauuucuaauguagaauccacacugggccguaauauaaagucacuucuagauugggcucaauaaucauuuuaguaaucucuguaaugccuucagagcaguauaggagguucucagaccuccaugcagguuguuuugcugggaagaaauuuaagaacuagugagaaagaaugugugcauguuuacugagucuuuggagauuagcuagauuagcucucuguugagucagcuaguugccaaguccauuuccugcuagaacuuucugucagaguuauuucagaagccaggaauagauuuuuuaagaguaccuuuaaccauugagaugacagagggagagaaugucuaggcuaguguauuauagaaauugccugacauuggucaggcacgguggcucacgccuaucaucccagcacucuaugaggccuggguggguggaucacuugaggugaggaguucaagaccagucuggccaacauugugaaaccccaucucuacuaaaaauacaaaaauuagcugggcgugguagcgcaugccuguagucccagcuacucaggaggcugaggcaggagaaucacuggaaccugggagguggaggcugugguaagccgagauuguaccauugcacuccagccugggugacagagcaagacucugucuuuaaaaaaaaacaaaacaaaacaaaacaaaaagagccugacauuuaugucugcuuuucagugacuuuuuacauauuuucuuagcauuuauuuaugcuauccuuguucuuguugcacugucaguuuugcuuguuaugaucuuugguguauucauuuucaaauuacauacuuugucauauaagugcauguuuucuagagacuuauacagugagaaauaugaaaaagcacagagauuuguacccuuacccugaaaaaguuagcugcaggcuaccugcugaaaucaaaagacagaaagugucuaagaaaaaaugaauguuuuaggccaggcacgguggcucacuccuguaaucccagcauuuugggaaucugagguggacggaucacuugaagucaggaguucaagaccagccuggccaauauggugaaacccugucucuacuaaaaauacaaaaauuagccgggcauaguggugcaugccuguaaucugagcuacuccagaggcugaggcaggagaaucacuugaaccugggagguggagguugcagugagccaagaucaugcccuagcgucggcaacagagcaagacucuguuucaaagaacaaaaacaaaacaaaacaaaagaaugugucuugauuuuuuaguuuaaaguaucuuugaauauucucauaauaaugcuucucuuuuuaugguuuuguaaaaauacaugacaauaaugugguacuacaaaauauaggaaauuuuguauuugaacugcaguuacucauuagcuaucuauauuuaagaaaaucacuuaccuuauuuaagccucaauuuucuuuuuuuuaauuauacuuuaaguucuaggguacauaugcgcaacgugcagguuuguuacguggguauaugugugccguguugguuugcugcacccaucaacucgucauuuacauuagguauaucuccuaaugcuauccuucccccagcacccccacccaccaacaggcccuggugugugauguuccccacccuguguccguguguucucauuguucaacucccacuugugagugagaacaugugguguuugguuuucuguccuugugauaguuugcugagaaugaugguuuccagcuucauccaugucccugcaaaggacaugaacucauccuuuuuuuauggcugcaugguauuccaugguguauaugugccacauuuucuuaauccagucuauuauugauggacauuuggguugguuccaagucuuugcuauugugaauagugccgcaauaaacacacgugugcaugugucuuuguagucguaugauuuauaauccuuuggguauauacccaguaaugggauugcugggucaaaugguauuucuuguucuagauccuugaggaaucaccacacugucuuccacaaugguugaacuaauuuacacuccuaccaacaguguaaaaguguuccuauuucuccacauucucuccaguaucuguuguucccugacuuuuuaaugaccgccauucugacuggugugagaugguaucucauugugguuuugauuugcauuucucugauaaccagugaugaugagcauuuuuucauaugucuguuggcugcguaaaugucuucuuuugagaagugucuguucauauccuuugcccacuuuuugaugggguuauuuuuuucuuguacauuuguuuaacuuauuuguagauucuggauauuagcccuuugucagauggguagauugcaaaaauuuucucccauuuuguagguugccuguucacucugaugacaguuuauuuugcugugcagaagcucuuuaguuuaauuagaucccauuugucaauuuuggcuuuuguugacauugcuuuugguguuucagucaugaagucuuugcccaugccuagucuugguauugcuuagguuuucuucuagcguuuuuaugguuuuaggucuuacauuuaagucuuuaauccaucuugaaugauuuuuuuauaagguuaaggaagggauccaguuucagcuuucuacauauggcuagccaguuuuccuggcuccauuuauuaaauagggaauccuuucuccauugcuuguuuuugucagguuugucaaagaucagaugguuguagaugugugguguuauuucugaggccucuguucuguuccauugguccauaucucuguuuugguaccaguaccaugcuguuuugguuacuguagccuuguaguacaguuugaagucagguagcaugaugccuccagcuuuguucuuuuugcuuaggauugucuuggcaaugugggcucuuuuuugguuccauaugaacuuuaaaguaguuuuuuccaguucugugaagaaagucauugguagcuugauggggauggcauugaaucuauaaauuaccuugagcaguauggccauuuucacgauauugauucuuccuauccaugagcauggaauguuuuuccauuuguuuguguccucuuuuauuucacugagcagugguuuguaauucuccuugaagagauccuucacaucccuuguaaguuguauuccuagguauuuuauucucuuuguaguaauugugaaugggagcuauuuaagccucaauuuucuuauauagaaaguaggauaauaggcugggugugguggcccaugccuguaaucucagcacuuugggaggccaaggcaggcagaucacuugaggccaggaguuugagaccagccuggacagcauagcaaaaccccuucucuacuaaaaauacaaaaaauuauccaagugugguggugugugcuuguuaacccagcuacuugggaggcugagacacuagaaucccuuuaaccagggaggcagagguuauagugagcugagacagcgccacugcacuccagccugggcaacacagcaugacucugucuccaaaaaaaaaaaaaaaaguaggauaauaauuccuaguaugauuuuuucauaagguuagugauaaucaaaguuuguucagcaaauaaaagugauuugaaaacaaauauaaugauaaagcuuuuauaaaugaaaauaauaacuuguuauauauuuuucacucauaaaaauuaagaucaauaugaacacauuuuauuuauuuauuuauuuuuauuuuauuuuauuuuuuuugagguggaguuuuguucuuguugcccaggguggaguguaauggcguuaucucggcucacugcaaccuccaccucccagguucaagaaguucuccugccucagccucccaaguagcugggguuacaggugccuaccaccacacccggcuaauuuuuuguauuuuuaguagagacaggguuucaccauguuggccaggcuggucucaaacuccugacuucagauaauccacccgccucggccccgcaaagugcugggauuacaggugugagccaccgcgcccagcuuuuuuuuuuuuuuuuuugagggggucucgcucuaucgcccaggcuagaguguaguggcacgaucucagcucacugcaaccuccaccuccuggguucaagccauucuccugccucagccucccucguagcugggauuagaggcaugggucaccacacccggcuaauuuuuguauuuuuaguagagacgggguuucaccauguuggccaggcuggucuugaacuccugaccucaagugauccgcccgccuaggccucccaaagugcugggauuacagaugugagccaccacacccagccaauaugaacacauuucaauguauauaaagauguauauacauuuuuauguauuauaauauacaaucuauauguaauauuuauaauacucuuauguuauauaguuguauagacaugccuaccauuagaguuuaucauuuugugcccauuuucuauauucaagugucuaagagcuagaccucacagaauauuccagagaaauuuacagucuguauaacuggaaaccacacuucaagaacuacuaaguuagacugccucccuaggaggaagcauuuguuauuguuucccccaucaccucauuuucuuaagcuagaacuaaucuauuaaguucccaccuaaacaaaugauugaucucaguuauccucugacuagaaucaagacguuaacaaaaaccuuuaacucccucaaaauuauggauccacugcuucagaacuauaugucagcuuugaauuuaaugaacucaguaaugaguuuuuuaaaaaguguacuuuuaaauguaaaaauuuagcugacuaaaacuaacacaggaacagaaaaccaagcaccacauguucucauuugugagugggagcugaacaaugagagcacaggucggagggagagcaucaggauaaacagcuaaugcaugcggggcuuaauaccuagaugauggguugauaggugcagcaaacuaccauggcacacauuuaccuaaguaagaaaccugcacguccugcacauguaucccagaacuuaaaauaaaauaaaauuuaaaacuuuaccugacuaaacaauguacauuuguaggugauuugcuaggaauuuccuacuaaggagggacauuagaagaccugguacagcugaugaaauacugaaaaucuucauacuauguagaaagcuuagauucauucccuugcaggugacaguugaaguuuuauuauucuuacuuguuaauguuucacgucuuuauaccuauuuucccaacuagacuuuaaauccuuuuagagugagaaauaaaccuugaacuccuuuagcacccucauuucaaaaaugaagaacugcagccaagagaaaggaagugaaauaucucaugucacagagcaaguucaugguagaguaaggacuucuuuucaccguuuaguaugcuuaucauagugucucaugaacaaaaggcacaaaaucaguucaugaguuugaugaagaccugccuuucaccuuugaccccaccucuuucuguuucuuuugucagaccuacagggcagacagggggaagaaaauuucuuagaaaaaauaauaaauggaaaaguaaaggaaaaaggaaaacaaucacagucuaucaaaugugaucaaaugagcugggcauuagccuagugugucaggaauuaaucauuuaaauucaaacucuuugucaagugcuucucuugaucuauacugcugagguaggaauauggagaacaaaagguagagacagaugagaagacuagcacucuugccacauaagugcuaggagaaagcugugguuuggcauucuuauuagauagcaguaauaugcuaagucuggaaaacacugccagccagcauuuuucucuaaugagaaaaauaaggcuuaguuauaacaagauaauaaaugagaaaauucuguguucuuagacagcugauaucucuuaauccuaaaauucaacagucuguuuuaccaguuuuuaaugaucagugaauugauugaaaagaaauuacagaaguuuauagucauuuuuacauacuuuauuuuauaaucugaggucacuguucaccccuauacauacaauuuuagagacaaaagugguaaguacuauggaaguagaagagaaauaaaugcauggcaaauguaauucugccuagccuuuuuuucuuuaccuguauaaguuuuacauauguauugacuucuccuccagagaaagcagcuagcucaauaacaauagggggucugucauauaaguaaacagugauauaugauuuuuaaaaaauagauucaggggguuacaggugcaguuuguuacauauuggaugauggugaguuuuuggcuucuagugugcccaucaccugaauagugaacauuguaccuaauaaauaauuucucugccgucaccccucccaacccuaccccuuuugaaguccacagugucuguuauuuuacucuguauauacauguguaccuauuauuuagcucucacguauaagugagaacgugcgguauuugauuuucuguuucugaguuauuucacuuaggauacuggccuccugcuccauccauguugcugcaaaagacaugcuaucagugaaugauuuuuguaugaauaacagacaggauugaugagguuggagaugacuaauuuaagaggguauauugcacauuaagaggcaacccacagucuaauguaaauguguuuuuuaaacauacauuuaaaaaaaauguuagaaccaauauuuacauauugagaaauuuuacguuacaaauucagacuuuugaaaaaucaggaaaucuagaccacauccagcaagacaaaauaugguugcucuuacuuaaaagagagacugaggcugggcacaguggcucacaccuguaaucccagcacuuugggaggccgaggcaagcagaucagccugggcaacauaaugagaccccaucucuacaaaaauuagccgggugugguggugugcaccuauauauagucccagcuacuuggaaggcugagacaagaggaucacuugacccugggaggucaaggcugcagugagcugagauugcaccacugcauuccagccugguugcuagagcaagauccugucucaaaaauuaaaaauaaauaaaagagagacuaaguguucagccuucauucauuaauguacucuucauucagccaauauuuuucuagugccuauuaugugcccgguguuaaucuagguuuugagaauacaggagugaaccaaacagccaaaacuucuaccguuuucauuguaucagggagacagacaauaaauaagauaaauaaguaaaauaucuguuagugauaagugcugagauaaaaacaaugaagcagagaagaaggauaugaaguuccaugugcgugggaaguggagucaaaauuuuaaauaaggaccugacugagaagguaaauuuugaguaaagaccuaaaggaagucacagagcuugccacucaagaaucuggaggaagggaauucuaagcagguagaaaggaccugagguuggagcaugucugccauauuugaagaagagcaaggaggcuguuauguauugcuuugcuuuuuuuuuuucuuuuugagacaguuucgcucugucacccaggcuggaguacaguggugcaaucauagcuugcugcagccuugacuuucugggcucaagcagucuuccuaccucagccuccugaguaucugggacuacaggcacaugccaccaugcccagcuaauuuaaauuuuuuuuuuuuuuuuuuguagagacagggucucucacuauguugcucacuaucaagcuggucuugaaccccugggcucaagugauccucccacuauggccucccaaagugcugggauuaugggcaugagccacuaugccaugccuguuuuucuuauagcagagaaauauuucuguuccuuugucaaaaaucaguaaagacuaagaagucuucaugcuuaaagaacagagaaagcauaucuuuuuaguaaauaaugcauauuccuagacaaaguguaucuccguagaaaagaaucauuguaaacacaauuaugaaacaaaauggugacagcuaugacuagugugcagaaaaagugccugaagaaaaauuuaacauauggaaaguaggguuaauauuucaacaggcuuuauuuucacauguacaugguaugaugcugcuguaauguauuaaauggaaaauuuuuuuuugagauggaaucucacucugucacccaggcuggacugcaacagcgcgaucuuggcucacggcaaccuccgccuccuggguucaagugauucuccugccucagccucccaaguagcugggauuacaggcuccugccaccacacccagcuaauuuuuguauuuuuacuagagaggggguuuugccagguuggcuaggcuggucuugaacucugaccucaggugauccacccgccucggccucccaaagugcugggauuacaggcgugagccacccugcccggcccgaaaauuuucucauauaucaaaaccuuuuacagguuugaguuuguaaaauaguguccauaaguacauuaagaauuauuguuuuaaggccgggugcaguaucucacgcagugucuaaucccgacacuuugggaggccaaggugggcagaucacuugaggucagaaguuugagaccagccuggccaacccagugaaaccccaucucugcuaaaaauacaaaaaauuaaccaggcauuauggcaggcgccuguaauuccagcuacucaggaggcugaggcaggagaaccgcuugagccugggagguggagguugcagugagcugagaucacgccacugcacuccagccugggcaacagagcaagacuccaucuccaaaaacaaacaaacaaaaaagaauuauuguuugaauaaguaaaggcagauacauaugugcagguaucuaaguaagauggaaaacuuagaggacauguuauaagaaaauguuaaucauuugugauguuuuuuguugcaacugauaaaaacacauauaaauaacaaugaaaucuuuauuauguggagauuagguucuaaagucagcacauaaggugaagaucugggauggucaaaauuacucuugaaaaaucccuuagaaagguacagcaaaccuucucucauucguuaaguccaucauagccagucuuuuuccccauuguuggaaccaaccaccauuuccucaguugagcaccagaugauauagucugccauguuguauggaacaaaacaaaacaauacaauacaaaacauuuuuuaggccagucacgguggcucacaccuguaaucccagcacuuugggaggcugagguggguggaucacuugaggucaggagaucaagaccagccuggccaacauggugaaacccuaucucuacuaaaaauacaaaauguuaacugggcaugguggcaggcaccuguaaucccagcuacucaggaggcugaggcaagagaaucacuugaaccugggagguggagguugcagugagcagagaguuagacuucaucuuaaaauuuuuauuuuuaucuuaaaauaaaauaaugauuaaagcaaaacaaaacauuuuuuaaacacuagaacucuacucagcacagggaugcaccacacagugaaaaguaugaaggaacugagaccaccuaggagaaaaacauguuuauauuccucaucgaacacuuauuccagggcagguauguuccuugaguaugcaguauugcccuauaguggguaaaguauuucuuuucucuccuuauccaaguaaauggaaugaagauacucacuucuacugcaucacccagauacuuguacacauagcuauuccacaaggcaaaagaaaauagguagcacaaguagcaugcagugugauuacucaguaauagaguucauuuucuucaaaauauucccccuguuuaaaagcuauuuaagcacacaucaagguaauuaauggcuuuaugccaucuguauguuauggcucacaguaaaaaacuaaagaacuaagcuaaaguuuagaacuaaaguauacccucccaauggugguuaaaacaauuuuugauuauggcuacuuuuguuaugauaggagauuuagauuuuguugugauaggagacauagauuuugaaauuaccaaucaacucaaauaaugggagggaaaacauuuaggugcuaaaaacuuuucuuuaaucugccaugugcuuucagguaaugacccguagaucguugaccaaggaauugauuuccuaagugaguugguguuuaggaagauaugucauauuuauugcuuuauagagguuagauuugcuugaauuuauugauaucugaguuauuuucuauauggcugaccacuaaaaauaauggguaucugcaagauauuacugaaauaaagacacagcccagcaaagccuuuauuugacuucuuaaaggagaaaaauauugaagaccauggcacagaugauaauccucuuaagaaaauguuacagaguaagugguuauaaaaggaauugaggccugaaaauuaccugauaggauauaauguuuuaaaaucauuucuaaacuauuucaggaggcucuagaaaaccucucucuccccucaacaaaaccuuuugaaacugauuugugagauuaaucauccauagguuucuucuuuuuuucuguaucuaaaucccuaauauggcgaguagggcuaguuuucgguuguggguuuuuuauuuuuauacaaaugaggucucacuauguugcucacccaggucuuaaacuucuaagcucaagcuauccuccugccucagcccuccaaagugcugggauuacaggcgugagccacuacaccugcauagauuucuuaagacacuaucccucaugucaucauccuugcuagauucuaaauuauaaaacuuguuggcuucagauuuauuuauuuauuuauucuuuuuuuuuucuuaauuggugaagcaaauaaaaccaguauuggagaucucagcaagaggcagggacucaucagaaucacuuguguuucugccauagucuuuucauuuuccccuucaaacacacuaacacacuugaguaguacuuuaggaaaaguaugcaacauaagcagaacuuuagcaaguucauuagguugguaccauucugucuggugaucucacucuucugaugcuagcaagguggaggauaaagcaccuucccuugcuguggcacacaccaggugaugggcacaggcaagcauccacuaaggugcuuucuugcauacuuguaauuuugguggccaaaguauugugggaaugcuagagcuaucaggagauuaaaauacaguaucaauucuggcuuguguaaaguaucaccagacuugauacuaaaucagaaaugcucugccuguauucuggauuuuauauguauuucaaauuuucaugaauuaauuuguaguuuugaaucuugucaguuuuccagaaauuuuuauagccaugaaguagauuguauuauuaugcucuuuuauuagcugacuuacauauuaauaauauauucugugauuuuuaggaggaaacacaauuauuacuagaaaaccugcauguuuaucauaugaauuacuuccugguuuugagaugucuucauaaguucaccucuucucuucccaaguauccacuaggucgacagguaauccaagccuccucauuuguaauccaugaaguaggaauguuaguauuuucuugcuuugguuuuuguagcauucaggcaucagaaugugaaaugaagccaauccuuacaaugagaacacaaucuaaauccauuccagcuguaaacauuacugguaauugauauuguuuuuuuguucagauggccacagcuagaaacagccguaugaaucccagugguguugcuuccccuacaauguuuuuguacuaaggcauuugaacuuuccuucuuuaacacuuccuugucaccuguacugagagagcuguuucucuucccuuaauggaagaaggaaucuguuugagaaugcuugaugguuaaccuugcacuacacccagaauaaaaagagaagcaguacuucugcugcuugaaaaauuaugcucagcuggccuuuauguuauucgauaaaccuaucaaccaucuguagaguagauuuuagcagagaaauucuauauuccuaaaucaucuuagcucaaagcuuuggagaacaaauaccaguauguaagaaugacuuguuggcugggugcagugacucacgccuguaaucccagcacuuugggaagccaaggcaggugguucgccugaggucagcaauucgagaacagccuggccaacauggugaaacccugucucuacuaaaaauacaaaaauuagcccggcgugguggcacacaccuguagucccagcuaugagggaggcugaggcaggaggauggcuugaaccugggaggcggagguugcacugagcugagaucacugcacuccagccuggaugacagagugagacuccgucuaaaaaaaaagaaugacuuguucaugaggugauuuuugccauugagccuuaaaugagccucuuuuucucauuuuuccuuuaucaguuucuuauuuuaaaaugaccacugauaucaaccaaucucaguauagccucauuuuacuuuuauauaaauugcauuuuuuuuuuuuuuugagacagagucucgcucugucacccagguuggagugcaguggcgcaaucucggcucacugcaagcuccgccucccagguucacaccauucuccugccucagccucccaaguagcugggacuacagaugcccggcuaguuuuuuguauuuuuauuagagacgggguuucaccguguuaaccaggauggucucgaucuucugaccuccugauccgcccgccucagccucccaaagugcugggauuacaggcgugagccaccgcgccuggccguaaauugcauucuuauaaagccugauccaugagauauaugccaagucuauuauaaucuaaagaaaaugacuuuuaauaacauuaauuuuuuuuguguugaccagaaaugauuuuugccaaacuaguaguguguauacacuuuugguuccucacaaauguguuguucccuuacagaucagagaguuguacuguacauguuuagaaaagaacauaugggauucagaggaguaugcaucagucuugcagcugcugagguaguuuuguuuuuucuuguuuuucuauuuuugucugcuauaagccugccaguaaguagcaccuuccucuagaacccugccugccaaaaaguuucauaaauagccauguugugucuaagaauauuugcauauaucuugaauuuauccauguagcuuaugauguuuuuaauauagcaacuauccguuucuuugcugguuuaaccuugcauuugagcuugugguuuuuaaaggaaaauccaugauuguuuagucaaauacugacacuacccuaagagagcuuagauauggaucauuugaauccagccaacuuuacaucauggcagggaaagcaagucaugaaaagugaggucaccauguccccaaccugguugaaugcaggaagagcaucauugggugauauguacccaguggucacagcugaccuugacuaggagcagcaaggaguaggcaguggccuuggugccuucccucaccuuaacauuggcuaauucauaaauuauuuaucuaauaauauacaaguaaauaaaauaucuuaguguuaaaguuauuauuuauauuccuugguuucacuucuuauauguauaguuacuuuuuagucuuccauaaaaaaaugacacuuggauaguuauaaggggaaaucacaugugagcuaaguuucgccaguuuuauaauuuuccucagagguuguaaaugcuuauauaaaaauauuuuaaagaagucugaaaacugaauauuuauuaagucuugcuuuccucugggcccacaagaaaagaacagaugggcacaguaggaggaaaauucacacugaaagcacuucaaguccagagacuuaauaauacaaauauuagugaucuagcaggugcagcuuaagauagaaaaugaauuucaugcuaucuggaaaaauaccuccccauggaaacuagauugccacugaaaagcuguguuuuauuucauuuuuuaaaaucccaacaagauuucuuuuuucuucuuuuuuuuuacccauaaggaaaccaaaaaaucccaauaagauuucuauguauuuauaagcuuaugucaacuauaguauuucugagacuuauuuugcuuucuaaauauaccuaucuuauauacccaguugauucuuucagguuuuucucuuuuaagcuuugugauuaguaauugucuuccuucuccagugagguguucccagauucauagauucuuuugucaaagaggaacuuguucuuuuuguucugaaccucccaacaccaguugucuuaggguacagucaagaaccaagaaugccaguuccaaaguaggguaaggaaacaugagcagcaguaguaauggugauagcaguaaccaucacuuauugaaggcuugcugugugcaaggcacuuuguuaggcacucucaguacauuuuccaaucuaaaacucuuaauauaccuuuaugguagauauuauuaggcacacuuuacccccugaggaaucugaaacacacacagggauuaagugacuugccugagaucaccuagcugcugagggaaccaggauucuacuccaggucugacuucaaagcuguuauaccuucugcuuuucuuggccaagaucuaaaauauggauuuggagaucugaguacagcagaagcaaaaaauagaaaaugagauuucauuuugcuaagcugaggucagaaacaugggcagucaagagcaaagcaauguaaaaagcacuaugggucaaauauaauaccuacagcaaggacaggcaggagucuggguucuauaaaagaggaaaggaauuggggaaccucugggcuggaaucagccuuuucuccuuuguacagauuugauguagagcagaagucagggacgcuuuuuaguuaaggcauucucaauaggcaucaccugaacuugagaccauucucaucaccugucuugaaauuuuauuuaacucaugagagaaaagacuaaaaugaccccugaaugaugcuuuggaaagaauaacugcuuaagguacuauuagaaacauaaucuaauuaaauuucuuauuugaaauuuuuuauaagaaucagcuuaaauuauuuuucaagaaaaaaugcuuuuuacagauugagcaucucuaaucugaaaaucugaaauucaaaguccucuaaaauuugaaacacuucaaauuucaaaacuuuaugagcacuugugauaccacaaauggaaaauuccacaccugaccucaugaaauggguugcagcaaaacagaggcacaccacaguuuauucagcuugccauuguuuguugcuguuguuuaacacugauauggguauuacuuaguuacacuuaacacauuauuuuuucacuguaccaaugguguguccuguuuuuuaaguguuaaguacuuauaugugaauaaguguaagaaaaugguugcauauaaauucaagagucaguaaugauggggauaccaagcaacuacagauugauuguccaucuaguuggccgagauagugacaccuuugcuuucugaugauucaguguaccuuguuucaugcagaaaauuauuuaaauuauucuaugaaauuacuuucaagcuguguguagaagguguauuugaaacauaaaugaauuuuguguuuagacaugcaucccauucucaagauaaucucauuaugcacauauggcaaauauuccaaaaucugaaaaaauccaaaaugcagaacacuucuggucccaagcauuucagauaagggauacucaaucuguauguggaagcugacauguuuaaauaaccacagaucagaugagauccagcccauucagguuaguauggcuguagacaucccucuaccccuaauucuucugcuuuguuugggaagaacauggaagaaaaggugacuucugccuccgcugcucuuacccccaccauaguggccuuuggcgaugccuccuaccuucccccaacaacucucuugcguguuagagagaaggggcccucccagcacaaaguugcauuccuccccccaauuuauucuaauuuauuaauuuagucccaccccuucugagccugcagccuucugcagccuggggacuguagaguaaguagcugccccagccccucccaggccugacccagccuggggagugggacaagguguggguguggcccuguuggagguugauguugcuguuuuuaucucuuggcuuuguguuuguguucugugauacuuuuugagaaagaagaggccaggcacaguggcuuacgccuguaaucccagcacuuugggaggccaaggugggcggaucacuugagcucaagaguuugagaccagccuggguaacauggugaaacccccucucugccaaaaauacaaaaaaaaaaaaaaaaaaaaaaaaauuagccuggcaugguggugcacaucuguggucccauccuuggaggcugaggugggaggaucacuugagcuugggaggcaaagguugcccugagcugagaucgcaccacuucacuccagccugggugacagugagauuucgucucaaaaauauacauauaaaagaaagagaaaaaaagaaaugugagcaaagcagaaggaggcggauucaaaccccagugugucacgccucaugccuuuucuuuaguggugggaaacccuuaucuuguaaagggaauguguccccuucuucagccagccucuaguguauuucacagaaaacaaaaccucccaauaaaacuguugaaaccuggaaaauaaaacaaacaauaugucaucuacuugaagaaauaucuggugaccauuuaaaacauauuuacagugacuuuguaauaaugugggagaauguuuaugucacauauuuauuaguggaaaaagaccuauauaauuuuauaucacaguuauuuuuuaaauguaugcaacagacauucauguguguggggagcaugcaaguguucauuuauaauauaugccauuauuugacaugagcucagugguucugcauauguucugccuuuccuugcucagucaacucuuggaguaugaagaccacaucccuauaugggauaugaguagguuaauuuuucacucaacccugugucauuauauaaggauauguuuccauuaaaaagccauuugggaacagaaaguaguaacaaaugaugcuaacccagcagugagcuagguaaguacaacuguuuuuccuuaucagaugugaaagacuguaagaggaaaauuuuaccccucuauuggagaaaauuucugaacacccaucuagaaaucaaaugcuaggccaguaauuuuucauauuuuuaaaauucacugaaccuugcauaaauaagguuuuaaggguuauuguaaaucagaggcagcugggugugguggcucaugccuguaaucccaacgcuuugggaggccaaggugggggcagaucacaagaucaggagaugaggaguucgagaccagccugaccaacauggugaaaccccgucucuacuaaaaauacaaaaaauuagccaggcgugguggcaagcaccucuaaucccagcuacucgggaggcugaggcaggagaaucacuugaaacugggaggcagagguugcagugagccgagaccuugccauugcacuccagccugggcaaccaagugagacuccaucucaaaaaaaaaaaaaaucagagccucaacuuaaaggaguauguuggaucagccagaucugaagaguacuacacucucauaccaguagcaguggauucuuggauuggggauaaugaaaagugugccccacuucuuaggggaauuuaugugcucuaccucaucaauugagaauuacucaucuacaguuauuccauuuucuuucaaaugaggaaaccaaggccagaaacauugacuuuucuacaguugacagagcugaaacucuuucaacccuauuccaguuacuuagaggugguaauaaaaggaaauuuaugguuuuguggccaguauuacauguucagaguguauccaaaauuuuaaaccagcagagcaagcuucuguggacucagauacccuccucccccauccugacacuagucauauuggcacaggacacagacauaaaugaaaggagccacagugucuagucugcuuauccuaaguguaaccuuaugagcuugcaaagaaacagacuuacaaaucgaaggugauugauagcuggaggaauuuaccuuaggcuaaaggaauuauucuaauuucugaguaaggcuuuugacuuaaacaguaauauauuagcaggucagcucagcuuucauugaguaaaaaaauaaaauaaaauaaaaacaugaccugaauaaugauguuaacauuugaucacuucagcuuaguucaaagagacuagaaauuuggacucuaaguaaugcauuauuuccugacuuugcagaucaacuuuaggugauauuuaaagaucuacuuaggaaaaaugacacagcuccacaaucuaugauaagcuuccuaauaaucuaacuuaugaugauguagauuuauccauccaagagcuuuguaagacugcaucauuaaaauauaauuucuggcaggcacgguggcucacaccuaugaauuagagcacuugggaggucaaggcagagagaucacuugagcccaggaguuaaagacuggccuaggcaacauggagaaaccccaucucuacaaaaaauacaaaaaguauaugagcgugguggugcaugccuauagcccaagcuacuuggaggcugaggcaggaucacuucagcccaggagguugaggcugccgugagcugugauuguaccacugcacuccagcuugggcaacagagugaaacccugucucaaaaaaauuaauaaauaggccgagcauaguggcugacgccuguaauucaaguacuuugggaggcugagguggguggaucaccugaggucaggaguucgagaccagccuggccaacguggugaaaccccgucucuacuaaaaauacaaaaauuaguguggcacaugccuguaaucccagcuacucaggaggcugaggcaggagaaucaauugaauccgggaggcagagguugcagugaaccaagaucacaccacugcacuccagccuggacaacagagcaagacuccgucccaaaaauaaauaaauaaaaugaaaaauaaagaaauaaauggccgggugugguggcucacgccuguaaucccagcacuuugggaggccgaggcggauggaucacgaggucaggagauugagaccauccuggcuaacacggugaaacccugucucuacuaaaaauacaaaaaauuagccgggugugguggcagacgccuguagucccagcuacucaggagucugaggcaggagaauggcgugaacccaggagguggagcuugcagugagccgagaucgcaccacugcacuccagccugggcgacagagcaaaacucugucucaaaaaagauaaauaaauaaaaaauaaaaauaaaaugaaaaauaaaaauagaaauaaauaaaauaauauaauuucuuuauuuuagaaaaggaauugccaauccugaauuugcaucacauuagggccuucacaauuaucuguaggcuuacagaugaugaaaucaggcuugggacagaauuguuaaagcucucuuugaaacaaaagauauugagagucacuguuuuuuuguguaaugguuuccaggcuucaaugugcauaagaauuagcugagauauggccuagcgagguggcucacgccuguaaucccagcacuuugggaggcgggcugaucaggaggucagagaauuagcugagauauugaucauuucagcucuuuccccagagcuucuguugggaacgcugguaugguguuucagcaggaauuugcauuuaacaagcacucuggcacauucagacagaugacccaggaacuauacuuugacaaauacuuccagaaaauaaagggagagguuaaaaaaaaaaaaagcggggagggggaaacuuuugaggaaaacaaugaagccaucaaaggaaaagucuuuauuuguggagaagcugaauggcuguaggcaguugaucucaaauuggcucgaaaacuggacugcgguauuccgcuaauagugagcuaaugguuuuuaucacaguaaacagaaaaaaagaucugaauuuguauuuuguuuuucuuuauuaaacauuuacugccuacugucacuuuucuguuagcaaaaugaacagauaacuaagaaacauuaauuuuaaaaacucagaaauaacucaucaaauuuugacaacucuuuucuuucuuucuugugaacucaggguuauacagucauccaucacugucugugggggauugguuuuaagaggacaccguaaguuccauauaugaaaugguauauaguguuugcauauaagcugugcacauccucccauauauuuuaaaucaugucuacuuuuuacuuaauacaauauaaaugcuauguaaauaguuguuacauuguauuguuuagaaaauaaugacaagaaaaaagucuguacguguucuauacggucucuucuccuaccccccaaaauauuuucaauccaagguugauugaauccaccaaugugggacccacagauacagauggcugacuguccuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauagucucgaucuccugaccucgugaucugccugccucggccucccaaagugcugggauuacaggcguagagccaccgcgcccggccggcugacuguacuuuuaaaaauuacaucaauaggccaggcaugguggcucaugccuauaaucccagcacuuugggaggcugaggcaggaggaucaccugaguucaggagaccagccuggccaacauagugaaacccugucuguacuaaaaauacaaaaauuagccgggcgugguggcacacgccuauagucccagcuacgagggaggcugaggcaggagaauugcuugaacucgggagguggagguugcaggaguuagccagccuggcuaacauggcgaaaccccgucucuacuaaaaauacaaaaauuagccuggcgugguggcgugugccuauaauuccagcuacucuggagacugaggugggagaaucacuugaaccugggagguggagguugcagugaguugagauugugccagugcacucuaggcugggugacaaagcgagacuccauccaaaaaaaaaaaaauugcaucaauaaaguauguguauauuugaacuuacucaaguugcuucuaaccaugugaugaauuaaauuuauucuuuuugauguauuccacaaaaaagcauggcaucccacaaagggcaucaugacuuccaggugcuucccaggaugaaccaguuugagaacuguucucuuuagaaaaaguauucuucacuaaggcauuagguuaggaaauuauuaauuauugcaugguuauugcuuugcccauccauuaaaaaaaaaagggguuuuuuaaaugcuucauuuuugaaaccacugaucagaugacaaagauaacccugguccuuaccuauacagaauuuuggucaaaucauugacaugaacaguagagagcuacaauucagaguaguaagagcugugaugggucagggcuagggugcugaggaaccaguagacuggacaguuaaccuccauuugugggguuggcagcuucucuaggaaggggcaccuaauaugaaauaucaaggcuuaggaggcgauacacauacuuuugguuucuguuucauuguuaucauccuacauaauugcuuuguuguguuagucuuugaauaagacaauuucuuauuuuuacaugcuucuuaauuuuuuuacaugcuuuuuauuauuuuuacaugcuuuuuuguuuuguuuuguuuccuuaacuuccagccuucauugauauauauacauuugcaaguuugaguucugaguauuuuucaaaacuagcugguaaugguaauguuuguuuagaauuugaaaacucgucaggcaaaagauguuuucauuagccauggauuggccaguuuuuccuuguagccaguucuuauaaucagacauuuauauaauuaguacuuaaccagaaauuauuggcuuucuguaugaugaagcagaauacuccauugcccugcaggaugauugcuuuuaaugauugcuuaaugauucucuuucuuaguuaagaaaacuuuuuuaaaaaaugacaaucuauaaagccuuuauuguuuuucucaacuccugugacagauuaccuauaaagcuuuuaauacauuagguaucacaggcauuuuuuggaccauuuaccugauagugaaauaauuuuuucuuuuuuuuucuuuuuuuuuucuuuuuuuuugaggcggagucuugcgcuguugcccaggcuggagugcaguggcaugaucucagcucacugcacgcuccaccucccagguucacgccauucuccugccuuagccuccugaguagccgggacuacaggcgccugccaccaagcccggcuaauuuuuucuauuuuuaguagagaugggguuucacuguguuagccaggauggucucgaucuccugaccucaugauccgcccgccucggccucccaaagugcugggauuacaggcgugagcuaccgugcucugccaauugugaaguaauuauuucuuaauuaagugggauaaagauaaaucgcucuuuuguggcauuaaugugaccuaucuuagacauuuuuuuuauuucucuuuaaucucacaugguggcuuucaaacuuuuuaguucugcuauuuucuuuacaauuuuauucucuuuauuuuaaaacaaaauguuaguuggaauguaccaaaauuggaaagcauugucucacugucucuaauucuucucccauucucuuuaacugauuacaauuaggcuugugcuccagaucacaacuaguuugaucaaagucaccagugaccuccauguuccuaaaucuagcauuaaccuguuaucagcauuugacuacaguucaucacucccuucuuaauggauuucuaggacuuucuugguuuuucuccuaccucaguauaugcuccuuuacauucuccuuuagugcuuucucuucucucugacaucuuaacauuacagugccccagggcuuaaucguaagccuauaccucucuccugagugccaggcuguuauguccauuuauguccuauuuaauaccuccacuuagauauccaauacacaccucaaaguuaaccuacccaaaacugaacuccugaucuuccccugaaaucuaucauuuuccuacugucucuuaucauucugauuuuucaaaccagaagccugggcucugccuucauaauuuauccagaaucagaccucuucuugccaccuuccuucacuuguaccaucauagucuaagucaucgucguugcucaccuguauuauugcaguagccuccuuucugguuuuucugcuccccuacagguucuucucaaaguagcagucagaauaguccuuuuaaaauauuucagauaauguuacuccuuugcucaaaacccuccguuaacuccgcauuucacucagaguaaaagccguauacagugacacuaugugacugccccccuccucuccccacauggccucucucugauuacugcucauuuucucucuccauuucagacaucuuggccuccuuguuuucuugaauauuccagauaugcccacuauggaaccuuugcacccauuguucugucugccaggaaaagcucuucuggauauuuguauggcuaacuuccuuuccuccuuuauguacuugaucaaaugucaucuuuucagugaggcccuaaccauuuaaaaauugaaagcuuccuccucccauggcucuccgcuuauucuguucaauauuuuuccauaacauuuaucaauuuuuaacgcauauaucguauauaugauauagauagauagugcaugucugugcuucucccagcucucccacuagaauguaaguuccgugaggacagugauuuuugauucaauaagguguaccucaaaugcccagaacagugacuaguauguagugugcauucaauaaauaucucuugaaugauugguucaugacugacaaaggaguugaaacccaguuugaaaaaugcuugucugauagcuagacucaauccuuaauuuuuuauuugaggugcuauauauaaacacacuuuuuuggaauaagcuaaauauuuuguaguuguuuucaagugaucuucuucaguuagguuugguuuauccaaagugcuuugauggccgcaguggcucaugccuguaaucccagcacuuugggaggccgaggcaggcagaucacuugaggccaggaguucaagaccagccuggccaauaugguaaaaccgccugucuacuaaaaauacaaaaaauuagccaggcaugguggcaugcgccuguagucccagcuacucuggaggcuaaaggaugagaauugccugaacccaggaggcagagguuguagugagcagagacugccucacugcacuccagccuggcaacagagcaagacucugccucaaaaacaaaacaaaacaaaacaaaacaaaaccaaaaaaaaagugcuugcuauagucauucuaauaaucuaagugaaaaaauaaguauuuuucugauauuaccccuuguauuauauaaccucgaaaaccagucauccacuguuagcuauuugcacuucagauauuuuuccacacacaaauguauauuaaauaauacuauauaugguguuccacacuugcauuuuuuguuuuuuuguguuuguuuuguuuuuguuguggugguuauuuugguuugugccuaauauucuaccacagaugccauguuuugagaugcaauauagcaugcucaguaagagcauggaugucaagcugaacugucuagguucaaaccccagcuuugccaauuaccagcuauuggauucuggacaaguuuacuuaaguucucugugccuuuguuuucucaucucuaacaugggaauaauaauaguauuuacauuguauuguaucaaaugacacuugauacacauauguggguauaaauguuagcugucaucauuaguauuacauauugcccuaccucauuguuucucaucacuauauaauaucauguuuuuaaagugcuuuuuauuuaaucagacccuuuuuugauacauauuuagauuguuucuaauucuucacuauuacaaacaauaaucaugagcagugguaagucuguguauuuguauaacuauuuccacaaaacaaagguagauguaaacauauugagucuaaaauauaaacauuguuguacaguguacacucacaccaaccauguaccaguguguauuucccuacacuuuugcugcugcuggauauuaucaggcuuaaauaucuuucuugguuuucuucuaguauuuuaugguugaugagcuaguucuuuuucccugcucccagaccguacuuacauuuuuauucuaucugaaaugcauuuuuguguauaaggugagauagugaccuguuuuuuuaaaauaguuaauucugauacccaguaucuuuucccucacugauuugaaaugcuaucccugugacauaacaaacacccauguacaccuagaucucuuucugaacucauucucuucuguugaccugucuauucccaaguaccaucaauuuuaaucaucauagcuuaacacuguuuaauguauuuacagcccuaccauacacacucaaguguacacacauuguuccuguuuuuuagaacaauuauuccagauacauuucagaauaauuuuuaguuuuuaaaauuuacggccaggcgccauggcucacaccuguaaucccagcacuuugagaggccgaggcgggcagaucaccugagguuaggaguucgagaccagccugaccagcauggagaaacccugucucuacuaaaaauacaaaauuagccggcguggcagugcaugccuguaauuccagcuacucaggaggcugagacaggagaaucgccugaacccaggaggcagagguugcggugagcugagauugcaccauugcacuccagccugggcaacaagagccaaacuccaucucaaauaaaaauaaaaauaaaauuuacccucuguaauuuuguuucaaacuguuaagaauaucgauuaauuuggaaagauuuguaucuuuacaauagugaguguuaaaaugucuauucauuuauucagggcuuuuuuaauauaggucauacacauauauuauaauguguauugcuguguauuuaguagguuuuguuaccauuuugaacaugggcuuuuuuuucauuauguaguuuaauauaagauauugauuacauuauauggauauguauauaugcaugcauauauauuuuuuauucacuuacuuuuuuacacucucuuuuuuuuuuuuuuuuugagagagggucucuguuacccaugcuggagugcaauggcaugaucacggcucacugcagccuugaccucccaggcucaagcagucuucauacuucagccucaguagcugggacuacaagugugcgccaccaggcugagcuaauuuuuucuauuuuuuguaggaaugagggucucacuuuguuggccaggcuggucucaaacaucugggcucaaguggucuucccaucggccucccaaacugcugggauuacaggcaugagccaccacgcccagcucuuuuacacucucuuuuauuugcaguucuuagauuuucuaacuuuacagucacaucauaugaaaugauuaauuucauccuccuucuuaacauuuauaccauuucuuuuucuuaauuuauuguagcaucuagacuccagaaugaugcugaauaauagugaugauagcaggcagcauugauucuguguguguauaauuuuacuggaaaaaaaauuuuaaauaaugacuuuauugggguugguuaaguuauuauuucuaaucagccuuaucucaagucuugucauuuuacauuaaacaagagaauacuugagaaaguguaagaucuuucugcucugggagcaaaacauaaucuuuggcuaagaauaagaggacuagacugggugcaguggcucacgccuauaaucccagcacuuugggaagccgaggugggcggaucaccugaggucaggaguucgagacuagccugaccaauauggugaaacccugccucuacuaaaaauacaaaauuagccgggcaugguggugcaugccuguaaucacagcuacucgggagguugaggcaggagaaucgcuuggaccugggaggcagagguugcggugagccgagaucacgccauugcacccuagccugagcaacaagagcaaaacugcgucucaaagaaaaaacaaaaaaagaauaagaggacuaauaacuauuugaaucccuggcaguuuacaucugaguaccuucuccaagugacacauuaagaguuaugacuaaugaaguuugcuuccaaaguuauaugaaauaaugcccucuuuuuuggucuccuggauaauaggcuagguuuggccuuccuugauauucaguuauuuggagcucaaaguggacaagagcuguugcugccccuauccugggaagcuaauccuucacaugcugcuaacuuggguuagaucuucugccagcagaaccucacccgucuuuccccuccaagcaagucagugccggugauuccuuggacaccagaaaugcuaaucuugucuauuugaauaggccuaaaggucagguuuaacagauuguucaaguguaucugacuuugaguuaacuuucuucucauaacucuaucugggcaauagaaagccacaaauuuuaaaucucaacuguaaucaaguaugaaaugucuuggcuuauuuuuccuugaccaguuagcugccuuucacagauaaagauuauaucuuagauaauuauuguagaaagaggaagauaaaguuuuauacuuuuaaaaaaacccuguggaaauuuacuauuuggucuacccuuaacaauugccauauuuagugguugucuacuuuuuguuguuguuguugggguuuaaauuuuaguucaaguaaccaguucaauuucucaguaaucauagucuacuuagcuuuguuucuuucucccaaguuagcaauauuaguauuucuccucauuuuuuuauuaugaaagaugucaaauauaagugaauuaguuguauuacaaaaugcccacauucuggauuugucuguuacuucaugguuaauauuagaacuuuuuuuuuuuuuuugagacugagucucacucuguugcccaggcuggagugcagugucgugaucucagcucgcugcaaccuccgacuccccgguuccagcgauucuccugccucagccucccgaguagcugggacuacaggcgcccaccacuacacccggcuaauuuuuuauaauuuuaguagagacgagguuucaccgugguagccaggauggucuugaucuccugaccucgugguccacccgccucggccucccaaagugcugggauuacaggugugagccaccgugccuggaaauauuagaacuuuuaaucaucauaguuuuaaugacuuagaugcauuugcugagaauaauuugaauauuuguguaaugccacugcuuaaaaauuccuaauauuggucugauuccuuuugaugccauuacugaguaugaucuuaguggagaaauccuguaaacuccaagaacaagauccuaacuuuagaauaucuguauuuucucuccauuucuaacaaagauuucuucuauagcugugaaugagcuacucaaccacucugccugugcuauaaauaacaauuagaucugccuacuucauuuaaaguucaguggguuuacugacugauguuuauaaagcccauaggagauguaaagcauaguuuaaauggugauaauuagagaaaugaguguacuauuuugguucuuucaaacaaguuuacauuuagcacgucauaucuucuguagacauuucuuauuucauauguacguuuagaucaaaagaaaggaaaacuaucauuaaaugccuacugugugguaagcacugugcuagagucuuccacugcuucuucucauuuaauuuuuaagucuccaucuaaccugugaaauaagcaaguuauuauuuccauuuuacagacaacgaaccaaggaucagagauguauaauaaccuuauucuuuauuacaaacaucauguuagagccacacuaugaauccagaccuuuguaaauuuucuaagcuaaacuuuaucaugagaacccuucaagaauucuucugaaugucacauauauggaggaaaaucucuccaaaaaauguugguagcuacuaaugaagaauuucuuuuaucuucugagcggaaacauuuaauauguauauuaaauaaaauguuuuuuaaguguuaauuuucuaguuauauuacauuuccugucacugacucuguucuaggauguuggcaaaggaugaacugaugaccauacuugagaaauguuucaagguuuuuaagucuuauugugaaaaccaccuuggcagcacagcuaagagaauagaggaguuccuggcccaguuucagagccucgaugguaagaguguaauauccuuccaauucuauuggccaugacagucauuuaacuaaaauggcauggaaaaccccaccuucugaugugcuuagagauaaagagauaaaguaguucaugaucagucaguaugccaagccucauaguaucacauuuuaacaaucacaaauaggccaaauguuucucuucuagauuugguuuaaacaauggagagcaucaaaugggcagaaaaagaaaaucuuucuccagaucgacaguuugggggauuugucuuuaaaaagucaacaaaaagaaaucaaaaagauuggaaagaguagcagggugucauaauuaagaacucuuuuuagagguuuuuucuuaagcauuucaucaaguucuuuauagauuuccaaagcacugcauaaaucaucuguaagcuugaaaaauuaauagcuaugaacugcuuucacagcagugaggcucauugguauguugauuaccaaaaucugcaugaggcuuacuuuaaucggauuuacaaaagcuggaaucuuucaguccuaaauuaacugaagcagccuggcacucuucacuguuggaggguuacaguuucucucuuuugcuugaccuccacaugaucauuuauauauccugaaugcuuagggugucugauuguauauagguagccauguucuguucccuaaauacuagcuuuucaugggcucuucucuugcucuguuucuagcaccaaaguaugguauucuuuuaguagaacaauaacaacaauaaaauauauugguguguacguuuuacuuuucccaaauuuagggcaauuuuuuaauggaguuuugggggaacagguaguuuuuucauauauaaucacauagaauuggacaugacauguugaaaauaucuuauuuaaaaugucuguuuuaauccuuuuuuauguuuggcaagugcuucuuugucuuaaaaaucuuuuggcuuuaggaaacugcuuuugcaaaaaucuucccauaucucuccauagcuacaaugugaggcaccugaugagugcucagucauggaagaugaaagagaauguuugccugacuagaguggccugagcagccagagugaggaagucaucagcaggcacuaagggauuuucuuucagguuaugugugggcauugcucuugccacugcagcaugaacucaaccacucuucagaacacaaaaacuuuuaagggcuggauguugguaucauuaagaucauugaguucagcuauauaaccagaaacuaaagucuaggagaagacggcagcuuguuugagaucacacagcuagcuagugguagcacucagaccagagcccaucucucuuaaccacuaguucauuguuuuucugucgcuaauucacgauauaaauacgcccuaauagugaucacuggaucagcaaggggccaaccuuaaguacauaaauaggguaaaaggcuuagaaaaauagaagguaaauacuguguaaauuucagucuuuuacaaaaugggacuuauggagauugcuguaaaaauaaacugcacauauaauuuuuucuucuuuuuuugcugggcaccauuaacgagguaaucuagauacauuuuuaauuagaguucauauaauaugagcuaguaaacaaauucugugauaugcuagagcuaaauaaaggaaugcagcuuuugaaaugggaaggucgaagauuaagaugauuaguagccuaaagaauaaagaauuuuacaaauuaaagcacaaccacugucuugaagaaaugucuguuauuuccugauuuucaaaagugacucauuauuaauaauaaacugaaacuaaaacuccccacguuggaugaguagaaauauuuggcuauaugcuaucuguguuccuuaacauuuauuacauauuacaguuuggguuuaaaauuacaguugggaagaguuaaguaggacagagugucauaucagauuuuuuuugagacaggaucuugcuguguuguccaggcuuaagugcaguugugcagucauagcucacaguucccucagaccuccugggcucaaguaauccuccugccuccaccuccugaguagcuaggacuacagaaaagggccacaacauccagcugaauuuuuuuuuuuuuuuuuggagacagagucucccacuguuguccaggcuggagugcaguagcaugauaggcucacugcagccuauaccucccaggcucaagugauccucccaucuuagccucccaaguagcugggacuacaggcacgucccaccacacuuggcuaauuuuuuuguauuuuuguagggaugggguuuuuccauguugcucaggcuggucucgaacucuuggguucaagcaaucugccugccucagccucccaaaguguugagauuauaggcauaagcccccucaucagccuaauuauuauuauuauuuuuuuuuuuuuuaaauagagacagugucucacuauguuucccagccuggucucgaacuccuugucucaagugauccucacaccauggccucccaaagugcugggauuauaggaaugaggcacuucauucagcccauauuagauauauuucaaaggcauauuagguuuauuaacauguagcaaacuacauguuaaugacaugggacaaagaaucuaguagacauuuuaaccuuuaguuaugucuuuuuugaaccagaaauuagcuguagcuaaaaagcaguuuauucuuuaagccaaugcauauucuccagcugcauccuccugucauaguuuuaggccaaacaaaccaugugugugggguucacaaaacccaaccugcacuugaagaagaauaugagagcauuaugcucucuagaaggagcacagcuguacauuuaagcaguuaugguuuucuuucccuuugcuaaagaaccaugaugcacuuuauguuuuaguggauuauuucaaaacuuuuacacacuacccuccucauacucaaauuuuguuguuuacaaucuugacauaaucaaaggaaaacaguuuuaaguuuuuauuauuuuuuuaaaaagcuauguauaacaucaaaaauauuugagacuggcugggcaugguggcucgugccuguaaucccagcacuuugggaggccaaagcggguggaucaccugaggucagcaguucgagaccagccuggccaacguggcgaaaccccuucucuacuaaaaauacaaaaauuagccaggcaugguggccggcaccuguaaucccagcuacuccggaggcugaggcaggagaagcacuugaacugggaggaggagguugcagugagccaagauggcgccacugcacuccagccugggcaacagagcaagacuccaucugaaaaaaaaaaauuuuuuuuuuugagacuuuuugcuguugguuugagggaguuuuguuagguuguauuuuguuuuguuuucauugugguuacacuuuuaaaauucaguagcugauuuuuugaagacaucacuacagcacaaguuauauauuauuggccuucagcuucuguaagaaaucauuuaucagauggaaucuugaucccuugccacauuaaaaaaauauauauaggugaaacuuuuacuuuggaguaguagaaauguuuguucccuugacuuggauuuacccucauugaugucuacugguuuuguauuaaaagcagaaaccaaagaggaagaagaugcuucugggucacagccaaaggggcuucagaagacagaccucuaucaucuucagaaggucaggucacucucuucccuuccagcugcauccugugacacucccuuuuuucaguuugugcucuagauuaacucugccuggauguuuuuguuuucauuuuuaaaccacaaccaggaacaaagcagacuuuuaacucacuucuaaguugaacauccuguuagucccauugccaucauuacucuacauauacacauucuggaaccuacuagcuaacauagguggaaaccauuccugugggcucagcaagagaaagagaaucagcuagcaauaagagaaaaugggaacauggcugcacaaaucugauuauuuaucugauguauuuuucuguuugaucaaacugagagauuuaaaagagccuaacuaauuaguuuuaguuacuuuccuugauuuuuuaaaaugcauauucaaguauagagcagaaauugagccacaguauauccaauauauucuuuuucagauaguucuaacuuuaggaucuugauugucgaaaugaagaaccuucuuuguacugugauaccaaauuaugauaaauguagaguaaaauuucaaucuaaguaaaauaaaacacauggaaucuauucuguuaguauggcaaaaaggcaagauuuuuuucuuuauccuguuaaguccuuuucuuaaaugacuuaauggacugaauagugagcacucugccauguaauuuaguaguaaagugaacugcccuuuucuucuuucccuaaaaauuugcuuguauauuauaaagcaaaacaccuuugaggcgagauucuugccagaccuuaaaaauaaaaagaauaaacaaaacccauuuugaucuuucucuguacauccugucuuauggaaagggcaucaggugcuucuauagaacuuaccaacagagcucccucugagggguuuucugucugaggaucaccagaaaagcuauguucuuuuaucuauaguccuuauuggaaaugaaggaguuaagaagaaguaagaagcaaaccaaauuugaaguacucagagaaaauguugugaacuucauugacugucuagugagguaagucuaaauuuagcucuuaagagcuaaaaaucaugcuguuuuuccaaauaacacuggugucauagcugucuauagccaauccagaacauuuuucuccuagguuaggcuuuaugcuuuucaggucucuccaucuagcuuagaguuguaauuuuuaggccaggcgugguggcucacgccuguaaucccagcacuuugggaggccaaggcugguggaucacgaggucaggagaucgagaccauccuggcuaacaaggugaaacccugucucuacugaaaguacaaaaaauuagcugggugugguggugggcaccuguagucccagcuacucgggaggcugaggcaggagaauggcaugaacccaggaggcggagcuugcagugagccaagaucgugccacugcacuccagccugggcaacggugcaagacuccgucucaaaaaaaaaaaaaagaauuguaauuuuuauucuuuuuccaucauuaucaagaugucuaaucaaaugacuuaguucauucuuuuaaucucaguuaagaauauaggcuuaaauuugaucuacuucauuaggucagguggggagagaugagauagaaagugaauguuucucuuucuaauaauaaaguauuuguauuacacuuuaucuuugcuaggaguaaaugcuggaucugagccaagcccagaaaguagagcagacuagccaugcugcucuauuuuauccugaagaaagaacauuuaauucuaaacaaugccagugcaccucauuaucagcacuaaauuuauguugagacaugugcuggguaaauuuagaagucuaccaauccagccuguauuuuaagauguuuccuuuuuaggaaacccagaucauucugauucauggauuucccaaaagucagcuuuauguagccguguaaaaucacccaccuaaguuugguggaaguugggcaugcuacagaaaaaaaugagaagugugcaaaagaaaacgauuuaauaccuaaaaaguggggcgggggggggagaaccuguuaucauuguuuauuguaauuuuuuuuuuuuuuuuuuuuuuugagacggagucucacucugucgcccaggcuggagugcaguggugugaucuuggcugacugcaaccuccgccucccggguucaagggauuuuccugccucagccucccgaguagcugggauuacaggcaugugccaacaggccuggcuaauuuuuguauuuuuaguagagacgggguuucaccauguuggucaggcugguccugaacuccugaccucaugauccacccaccucggcuucccaaagugcugggauuacaggcgugagccaccgcgcccggcccuguuuauuguaauuuuuaauggcaguuuaaacccaacagcaggcuaggcacugaauaaaguacugagaaaauagcagcacaauuauuaaagagaaagagugcuuuucugacaaauuacaugucuuuucugaaagugaaaagcuuaguuuuccagaauaauguggggacagagucauuguuccuagucauuggggagaaauugcuaaugccaugaaaagguccaaaacgaucaaccaaggccgggcgcauuggcucacgccuguaaucccagcaucuugggaggccaaggugggcagaucacuugaggacaggaguuugagaccaaccugaccaucauggugaaaccccgacucuacuaaaaauacgaaaaauagcugggcaugguggcgcacaccuguaauccuagcuacuugggaggcugagggaggagaauggcuugaacccgggaggcagagguugcagugagcugagaucgcaccacugcacuccagccuaggcaacagagcaagacuccaucucgagaaaaaaaaaaaaagugaugaacugcaauauuggccaaauacuggucaaaaauuacauagaacccacagaguuaaccuugcccuacugggcuuuccuguucuuguagagucuagccccaaacucuugacucuucccuuuuaccaggcagugaacaugguagucacuaaaaauaauuuugcaaugugauuugccaauuuuaggccaaaugucagguuccagaguucuuacaaauuccaaauuguaggcucugaaaucacaucagccguuucccugucaugauccuucaccuaauaugucugacuuuuuaccuuucugagcaguuguugaaauaaugcucaguauaauuaaauguguuuuguuguaaaaucacaaaaucuuccauacuaggauuuagugucuuuaccaagauugucccaggagggaagagauuagaauuguagcauguuaaagcuaaaagagaccugaagagucagcccuguggcagcuaaaggccagagaggggcugugacucaugcaaggucacacagucucauucuccugacaucugccaaaaggcccucuccauuucucuacacugcccucaacagccacaccacagaugucugggcagagcuuggaguuauggagaaaggauguccuuuaaagacaaauauaagcaggagacuucaggaggcagaguucacaguauaccaugagcagcucuuggcaaaaauacuggcaggcaagaauaaguugccagaucuugagagaugagaauaaauugccacuuucuaaguuacuguuuuugccaauagcaagcuucaacuuuguagcccuuguugauacuaauuccuccaguuccuucagaaccaccucuuucagggaaggccuaucauuugucuggucugaauccaaaaugagcauaaugcagugcuuuagugccagacucauugcuuacuucuucucacauaaauaagucacagaaguauauuucuaugucaaucuccaagucugcagucagauaaaaauucuaauguauaauguauuuuguuacuguuguuguucaacuaauguagccaguggaaacaaaauuaaggcagauauuuuauuuuugcucugaugguucuuugaggauaucuagagaggucuuuugccuugggaaaugccugaauuucuauauaucacauguaaaaauguuaaaaugugaggcgauaguuugaguuucugaaguugacucuaucugauugccuuguuagauauccaauccuuauuacauagcagggacugcaacaagaucuuuuaaugacagccauguauaaugauugggaaauaacugccugagguuaguguaggaagaguuuauggucagaaauuacaaauugguagccagccaucacagaaacuauuuccugaagcuacagcuaaguuaacuuaaccuugaguaauuaagauguuaacaguaucugagguauagaauauuguuucuuagugaggaucaagucaaaaucauacacucuuugcaaguaaguuuuguuccaguugacucuggagaaggagcagcaccuagaauuagaaugagcaaggggucauuagcucuugagaugggggagaaaaggaggauggugaagagugauguccauguugaauacccuuuccacuuccucucuucuucagagcuccuggccacaucgggacaaagcaaguguaggggauuucuagggagugguauccucuccagaagaagagaaaggauacuuggaagaaggggaauaauguccccagugacugggcugagguagcugcuuugcucugcuuguacugguaggaaaaggagcugacacaagcugucauguggccaaaauacuuuaggcucaggacuggacuaagccccagaaaucuucuuuaugaagucaugugaguuaacuauauacuuuaauccaguuagugacauuacucugucuauggguuaugugugccaaagcuucuccccuccaauuugccacccuccaggcauccaguauaguaucacugucauggcacagaccaccugaugggcucauuauacaugcaaagcaaauuuuuaaugccauauuuuuuaguuccgaauuuauuaaaauuguuuuaucaucuagcucauaggugaaaaaaaucccaaauuauggcagauuuuuuauaagugaaauuuuauuaaugauuuguuuuucaauacucugaaacuaagauuuagucuuuucugccuucuaacguaauaaguaauuccaauauauaaaaaacuuuugggccgggugcgguggcucacaccuguaaucccagcacuuugggaggccaaggcugauggaucaccugaggucaagaguucaagaccagccuggccaacauggugaaaccucaucucuauuaaaaauacaaaaauuagccgggcguguuggugggcaccuguaaucccagccucucaggaggcugagggcugagucaggagacucacuugaaccugggaggcagagguugcagugagccgagauugcaccacugcacuccagucugggugacaagagugaaacuccgucucaaaaaaaaccaaaacaaaacaaaaaaaccccacaacuuuugaggugucauuuccaugaaagauaucaacuaaaaauuuucugugauccaagaagaauuuccugaacucuuaauuccaggccuguguuuaauauugccaaagguuaaauguuugcugugcuagaaaauguagauaucuguuuucucauuuacuuuaagaaaugcuaucuuaaagauuucuaagcagaaauguaguauauauacauuuguuccuaaagguuuaacucagaacugaaauauacagcuucuuauaaagagucuagagguaguuuuaaaaacuauuauauggaagagaugcaguucugagugaaacuguauuagagcugauauuuggguuuguuucauucguuuguuuuugguuguuaauuuugcuuuuaguaaaugguucaguccucuacagagagaggauugacaaaaauguuauagugaaaauugaaguccaacagagcuuaaaggaaaaaauauauauauuauauauaaagaaaauaaaccugugcuuaucuaaacauggaugccugacuggcuguuucagagaauaccuucugccuccugagacacagccucuccaugaggugguguacuucagugcugcccaugcccuucgugagcauuuaaaugcugcuccgcgaauugcccuccauacugcacucaacaauccuuacuauuaucucaagguaagaugaacauuuaguuuucugauaguuuagcucagacucugggcgucauugucauaaaaauauacuaaauuugcaguuauguuuuaaugagcagagagucggcaauucaggguugcacgucucauauauuuuuaaaaauucuuuagacuguagaaaaaaauuucuaaccccauaaagauagcaauuaguagucaacuguugcugccaguuuuugaccauguguaaucuuugcccuucacaugcuaaagucagaucauaggcacaaagacuugagaguauaauguuaccacucuugugaaaauaaaagaaauguuuccuguaaacauaacagcagacagggauuaaacaauauggccuaauaaauuacugaaagaccgaaaugguuguuucuagugggaaagagaaauacuuugggacuucaucuuggauuuuaaaacaaagaaaggucuauucugagagcaucugcagagcugaguguagaggauaaccagcagucugccacuaaaacuccuggggcagcacacuucagcugcccuugcuaaaguccagacacaguuaucaacuccuggaagcucuuuaaacaauaguucaagacagcucacaauuuuagaaacuagcuuucuuaugaccgggcaaaaugaucacuuuaaacauucaauaagcuguauauacaugaaagagugguaaguuaaauacccagaaaucuugccacaauaaauacuuaagaaacaacuccguaagaccuaugaagagcauuccaguguacuggcuucucauugcaaaacggcacacaaacaugcagaguauuacaagaauauugaguaggacgauauaagucaaugguuuucagugauggugaaaaccacugaauaauuucauacuuaaccaaaaaaucaguuaauuuuaauauauaaaccauaaauuaaaacuuacaaaaucugucuucuucuuggcuggugggucacagaagagaacugguaugauuucaguugucuuugggugggauauauuauaauauaccccugauauuauaauaucagagcaggguguguauguaagacuuuguguuucucaguaaaagccauggauuucaaauagguugaagaaacacugaugguuucuauagggcuuaaggucugcaguguugacaacguagucuuuucuuuaaaagaaauuuauaccccugguaagugguauuaguauuuacuaauacaguauaguaauuguuagaauucagcuaauuauaaguguuggaaguaccauuuuauuaaguauuccuaaagauuuccauaaacuuuuuacauuaagugcauucaggucugagaaauuaguaauuuauggauugaaaugaaaaauaugcuuaucuucuaauccugggaauauucuucuagugacuaagaacuagagggguuaugaccaagacauaaaccuaaacaagaacuagcuaacuauugaauagacucacucacuaaauaagggaaaccaagauuccauuuacugguuuacucaguuuagguugggggcuucauuaaugucugauuuuauuccuaauaauuuauaaaaguuagucaucuuaguuuacuguuaauuguuagaaugaagcacugaaaagcgaagaaggcugcauuccgaauaucgccccagacaucugcauagcauacaaacugcaccuagaguguagcaggcucaucaaccucguggacuggucagagguagguuguagggaaaagaacaagcuagauauuuuucuaaccauccaugaugacuuucucagaauaguuuuauacuuuuagugcuuuggaauuuaucuuguguuuaaugccuugucuuuuauuuggaaagcauaaaucauuucaaacuuuaaaaguuccuuaggaagugguaguucaacaguccccacucccaauccccugcccucugauccugaauuccuuaaccaagccaauucuguguucaugcuaggucaaaauaaguaugugaucuaacccaauaguuagcauuaagcaaaaacuaaacaauuuaggucaguucuguuauuucacaaaauaaaguauauuauuaacuagcauuucucuucuugcuuaaaagaaaaaaaauugaaguaacuacacaacagauuuagcaaucaggaaguauaaggaauacuuggcaaggcaauaaacaacuguuguuauucuuuaaaauaaacaacuauucuuucugucuucagaauaguauuacaaagaucuuaacucuauuaaaggccuuacagaugucuugucaccauuaaaaaauauccauaauuggcugcuuccaagaaaaauagauauuuuccuggaguaagauuaguagaggaaacagggcuuucuuguucuuuuaccuuugacuagcuucguuucuuuucucugcauacucuuaguucucugaaacaagauuauucaggaaccauuacuuuaucuuuuaauauauaagugguuuaaagugaucaucaguguaguuuugacaaucuuaaauuugauauaaugaagaauaugugccagcuaucaacagccauuaaaagaaguauaguaaaagauguuuggcaacuguagacauuuuuauuuucuucugucuugucuauucaaaaggcuuuugcaacaguugugacagcugcugaaaaaauggaugcaaauucugcaaccucagaagaaaugaaugaaauuauccaguauccuuuuaaaaccauuucuacaauguccaacuacacauaaaauauaaguuuauaauuucuccaggucuacacuagauauuuauaaaggcguacuccaaacaaccguauuacuuguuaauauuaaccauauggugcuagaauaacugaaauuucugaaucuuuauuuugaauuuaauccaaaaugagaccaaaccuaaaacuuuugguaucaaauuuauaucaagauuauauuuuaaaauuuaccaaaaaugaaacugccauuauugaauucucuuuuuuugguuuuuguuuuuuuuguuuguuuguuuguuuuugagacggagucucgucuaucgcccaagcuggagugcaguagugcgaucuuggcugacugcaacguccgccuccuggguucaagcaauucuccugccucagccucccaaguagcugggauuacaggugccugccaccaagcccagcuaauuuuuguauuuuuaguagagacgggguuucaccauguuggccaggcuggucucgaacuccugaccuugugauccgcccgccuuggccucccaaagugcuaggauuauaggugugagccaccucacccggccuaauucuuuuuuuuuuuuuuuuuuuugagacagaguuuugcuauuguugcccaagcuggagugcaguggcacgaucucggcucaccgcaaccuccaccucccggguucaagcgauucuccugccucagcuucccaaauagcugggauuacaggcgccugccaccaugccuggcuaauuuuuguauuuuuaggggagaugggauuucaccauguuggccaggcuggucuugaacuccugaccuuaggugaucugccugccucggccucccaaagugcugggauuacaggugugagccacugaccuggucugaauucucuauuuuucuaauguacguuuagaagugggggcggggagcaauuuccauacuauguagaacauuagauuuaggaagcauuaaguacuuuuccauuuauguuuuauugauaguggauucuaauuaauguuuuccaguaacaguuauaguuuaauuuaggaguuuauaucugaacuaucuacuucauuuuaccaacuaguauuuuaacauugagauuuuaaucccuuuuugucaaaaauacagcacggccaguuuccuuaauuaaagccuccagugcucgguuuauuagagcuguuucugaacuagaacuuuuaggauuuauaaaaccuaccaaacagaagacugaccauguggcaagacuaacauggggaggcugcuagaaagcaaauaagcaaagccagaacuaucacauuuagcuuaagagaaaaaggugaccagucauauuuacauauauuagaggagccuguuuuguugagaagauaaauguguaacccccauugauguuuaaccagaaaaguacauugcuaaccccaaacaggcauguaucaaaacaccuguggaguacuuuagacuccaacaaauaauaauguaacuaaaacugcucacacauuuuacuguacuuuccaaagucauuacuaaauugugaguaaaucauucuugaacuuagaguauguaaauguaauaaauuccguuauccaggaguauaaauua

SEQ ID NO: 191358 - RNA, 75640 nt, Homo sapiens
auaaggagguggggcgaggccggaacuggcggacugcggcgcacuuccguagagguggacauggcgugcggcuuucgccgcgcuauugcuugccagguauggaucccggagcgcgcagaggagucccugaggagcuagggaccccaaaggccuuucaccgcugcgggccaguccucagucagcuggagggugggucccacggaauccuguuaguuucuaccaccuccucccccuucucuggagcugguggagcuucagaaguccuguggagcgucggcugggaucaguuugucucggugaaaaguaaacuuugaaagguaccuggugcuuucuucucuccuucccaccccacagcuaugaaugcuuuaccuggguggcggcaagucauuagaccaugauuagaccccauagaaguuaguguucuuuacacuuuagugacauugaugauggaucuggauuguucuucagaaggaccucauuuuaaagcugcuuauuucucuugcagucacuuaggcagccuacccuagaauuguuuuugguaacgcccaaagauauaagagcuaucugagacucaguuuuucuugguucagggucguauuugaacagcucuguugugaggaagggcuuacaaaauugcaauauaauugcuuuguuuuguuuuuccuuuuuguggagaacggggucucgccguauugcccaggcaggccucaaacuccugggcucaagcuguccucccuccucugcuucccuaagagccgggauuacaggccugagccaccgcgcugggcaaaauugcaguauaaauguggaauuaaucaaaaagaauuuuuaagacucauuggccacccuugcaaggaaacuuucuauuguggucuuggcuaacccauuuccuucugauuaauggauguacuaguggacguaauuagccugguguauaauuuaucuuggcucauuuuuacaguauuucuagacauuuguggggaaaucccucugccuugucuuuauguuuauagauguacugcccuguccggugauaauucgccaaauaucaccaacaugacauuuuguuaagacagcugaauuuauugcucacugggauaaggaagaacaccacugagagcuuugguaguguauuaaacugggaaagcaaggucagauuuuacugauggguauggcuuaaggcuggucuuucagagggagaggguaggaggguguuggaggaagauggcuugauuaggguuggacucugaucugauacagcgguuuaagauugauaggaaaagcaaagagugcaagaagccuuaaggcauaaacuauugagguuuucuauuggaagaacuaauaggccuggcaugugguucaugccuauaaucccagcacuuugggaggccaaggugggaggauggcuugagcccaggaguucgagaccagcguggacaacauagguagaccccgucucaacaaaauuuuuuuuaaaaaguagccaggcaugauggugcaccucuguaguccuagcugcuugaaaggcugagucuggaggaucacuuggacggacccacgaguuugaagcuacagugagcuaugauugugccacugcacuccagggugggugacagagcgagacccuguaaacaaaaaauaaaaauaaaaaacgugaaaagcuaauagauuucucaugaaguucuuauaaugaaugauuaaguuauuugggcagaagucuucuagaacaguaaaguuaugcuaaugaagacaaaaaauaauaaauucauguuaauguagacaguaaaccauaucagggaagguaguuuuggaccuuaguaucuaagcuguguguaaggguggacguuuuccauucuuagcccuuaaguaaagauagugccaugaugagaaacaaauuguguuuaguuuugcaaaggcuguguucuuuguaaagacuguaaauuggaccaggcaugguggcucacacuuguaaucccagaacuuugagaggccgaggugggaggaucccuugaacugagacguucaagaccagccugggcaacauagggagacccccaucucuauaaagaaauaaaaaacaaaacuuagguguaguggcacacaccuguggucccagcugcuugggaagcugaggugggaggaucguuugggcccagguggcugaaacuagcaagcuuugauugcaccgcugcacuucagccugggggacaaagugagucccugucucaaaaaaaagaaaaagauaaguuggagaaacaagaacuaauauauugaguauauauuugugcuaguuacuacacauucacauuuaagcucauggcaacccugugauauagaaguauuaaccuuauuauauaauugagucaguugagauccacagagauuaaauaacuuacccaaagccacaucaucaauacauuguagaguugguuuaugaacagaacucuaacuuuaaaauuagaucuuuccuauauacugugcucuuugugaaagcaagaagcacaguccaaucauugaacagaaucuaauggauuuauacagcaguguaaauuaugcagauauauauguauuucucugaauauagagucauuggggaaugaucugaaacuugaggauaaauaauaauauuuucaauacguuaggacauggggaaaaaagagcaaagaaaaaacauguuccguacaguuugagcaucccuaagcuggaaaucugaaaugcuccaaaauuugaaacuuuuugagugcugacaugagacucaauguucauugaguucauuggagcucaauuggaaauuggaaauguucauuggagaauuccagauuuucagauuaggagcuggguaugguggcucaugccuauaaccccagcacuuggagagacugagacaggcagaucacuugagcccaagaguucaagaccagccugggaaacuaauuagaaaauuaguugggcaugguggcacccuccuguaaucccagauacuugggaggcugagguggaaggaucacuugaaccugagagguggagguugcaaugagccaagauugugccacugaacuccagcgugggugguaaagcaagacccugucucaaaaaauaaauaaauaaauaaauaaauaaauaaauaaauaaauaaccaaccccacagauuuucaguuuagggaugcucaacagguaaguauaaagccaauauuccaaaaucugaaaaaauucaaaaguugaaacacuuguggucccaaggauacccagccuguauuuaauaccuuugcgaaugagcaucguuuugcuauaauaguuuaggaaugaaggaauguguaacgugcaauggcaaaugcauuuagcuaacuuugauuaauuagucgacaguuuucuaagcacugucaucagucccaaggcuaaaagugaacggaaaauaguuucugcccugaaauggccucagacaugcuuggaaaacgauguaaaccgguaauugcauugcagccuguaaucacuguauuagaagcaugugcaaagugccaagggaacuugaaagcuccuaagggucagacaaaguuuuguagaaaggugauguuaggucucaguuuugaaagggauauggguaggagugugccaaguaaauagagugagagcuuggggagaggucagguauugcaagaggaggaugugcauagacacagacaucuggaaagcaugauauguacauagaaucacaauauuuggauuccuuucuucagcaaguccuguugauuuuaucuuuauaucuugaauccaucuacacuauugcugcugccucccccucuccuuucucuauuccacaccaagcccccauuaucaccuauauugacugcuuacaacagccuucugaugggguguuuguuuccauucuugcccucccuccaguucauucuccauguaucaagaaaggugacaucuaaauugugaaucaaaucauaucacuuaucuuucuuuguugcacgagucucuaccagaaccuuaacuucuucaacuuccauucaugccccauucuaucauuuuuguaggaaccuagcuacaauguuaauuuguuuuucuaacauagcagggucuuuccauucccauugcguagauuauuccuugugccuaaaagaaaugcauuuuauacuaucacucuuuaugcacgaugaaaguuucaugaaacaauacuuauuuauacuguauucuguccuguuuuauacguauuuuuuaagacuggugguugggacucaacagaauuuauuuuuauuuuuauuuauuuauuuauuuauuuugagauggagucuugcucagucguccgggcuagagugcaauggcgugaucucugcucacugcaagcuccgccuccuggguucacgccauucucccaccucagccucccgaguagcugggacuacaggugcccgccaccacacccggcuaaauuuuuuuguauuuuuaguagagacgggguuucaccguguuagccaggauggucucgaucuccugaccucaugauccacccaucucagccucccaaagugccgggauuacaggcgugagccaccgcgccaggcaaaggaauuuauuucuaacuggcaaccuauaauuugaaaaguguguccucuaguucucuuagucccuuguuugcuucuaugaugacaauaauaagaguaauuguuuuguuuuacuuguuuuagugucuguuuccucuauaagcuucaugaagacagaacaugucuuauucacucuuauuuccucagcaccagcaaagugcccgaaacauaaguguuuaauguguauuugaagaaugaauaccugaguaucucuguugugaucucauauaaaauaugcagcuucacugaaugaguucauaauuuuaaaucuauggagaugacguggugugguggcuaaaggaacuccaucuuggaugcuaaucugccauguugacuuuugauuauccccaguuccaggaauaccuguaagauuucuauuuuaucuacuguuuauaguacuuaagggcaggauuucuauuuuauuuacuguuuauaguacuuaaggacaggauuuauaauucuugcccuuaagcaaaugauaggcuaugacauagcauucuugauuuuuucuaagggguugacuucgguugucuuagacaucccuucugaagcaugguuaccccuucucuaugguauauaccauagagaagcccugggucuugggguagauaacugcacaaggauucaucaucuugucucuuagcuuccugagauaugacuucuguucauaaauccauauuaaauguuucuuucugagaagcuggguuugucagcugcuuucuucagucucucagcauccucagucuuuugaggguagauuuguauagaccugcuuaccauggagcacuuaauaauggugggaaggauuagaauucuagcuucacuauuuguguaacuaacucuuggcaagucagcuguaagaugaugguuuugauuccaaguuuacaggauugcugcaaggauuaauaaugauguugaagauuauaauaacuacuauuuaugggauaccucacuuguacggugccguauuuugcuuugcuuuauagggcuauuaauaaaauguaaugagauaaagauaacagugcuuaaugucaggaguugcaaagggucugugauuuuacccucuuaaguuucuaccacuguuccauggaugguagcagaaaacaucagaccccugaaugagggaaaaggauuuuacuauucauagcaauagcaguagccacaguaucaacauauuuugugugucaauuucccaaguucuuuuucuucccaugccgcaaugugaagauaauaccucuauauaagcuguguacuguguuacaggagagaaaccuugagucuuuuauaaugggcaguaagcaugccugcccuuugcucuggagugaggaaccaucuuuaucuuacaaaucuguauccuugaaagauaguccagaacaaaggcaauuugugucuuguuuacauacgcagaaauguuggagucccacgaggauuugucgcucaacacuaagcacagugguauauugugcuuagugguacacauacaauguacaguacuugaaauuuucauuucaucaucucagucaugccauugcuauuuguauuguauccuuauuuuacagaaaaggacacugagauucaggaacaugaaaggaauaaccuaaggucacucagcuauaaaauucuagaguugaacuacuaaccuagcuauuugccucaaagccagaauucuuuguauucuauauguagaguuaaauuuguaaaauggccaguacgugucuggcuccgaaauaaugauggaauguagauuugucucccuuucuuacuugcuuuucauuuugcucauuaaacuuaaauucagcugguucuguuuuuuuuuuuuuugagacgcaguuuuguucuuguugcccaggcuggagugcaauggcacaaucucggcucaccgcaaccuccaccucccagguucaagcgauucuccugccucagccucccagguagcugggauuacagguauaugccaccacacccagcuaauuuuguauuuuuaguagagaugggguuucuccauuuuggucagucuggucucaaacucccgaccucaggugaucugcaugcuucggccucgcaaagugcugggauuacaggcaagagccaccauuccuggcucagcuaguucauuuuaauuuuguauacuuuuaauuuugaaauaauuucagacuuauaaaaaguugugauaauaguaccaacaacuccauauccucuuuaucuagauucagcaguuauuaacauuuugccacauuuccuucaucguucuguauaacuuuuuccugugucauuugagaguagguuucauacauaaugcuccuuuaccucuuaauauguaauuguuuauuuccuaagaacaaggcuuguuuuacaugaccauaguacaguuaucagauucauauaauauugauaaaaugcuuuaacuuacaguccauauuccagucuuguugauuuuuuuccccauauaggaucacaaauugcauuuaguuucuuguaacugguacauuuuaaguagcuuuacgcucucguuauuaacuuacaucugcauagcuugauagaggagcuacccugcuaauggugagcaggaagaccggcuuucuugacucugcugaugaguuuauuaucaaauuucagguguggccucaagaagcaauuaaacuaguugucuaauuguugucauuuaguccugaggugcaauauguauguugggcagauauucauccacauuaagguaaacagcaggacugacugaauuaucuacguuuguacuguucuuugcuuccaaucuauucucacagacccaccagcauuccauucugcuuagaagcacaaguuguauaauaauaaccauacuauagcaaaaaacaaacaaaaaaacuaucaucagagcaaacaggcaaccuacagaguagcauagaauuuucacaaucuaucugacaaaggucuaauauccagaaccuacaaggaacuuaaaacaaccccauuaaaaagugggcaaaggacaugaacagacacuucucagaagaagacauuuauguggccacaaacauucgaaaaaaagcucaacaucacugaucguuagagaacuguaaaucaaaaccacaaugagauaccaucucaugccagucagaauggugaucauuaaaaaaucaagaaacaacagaugcuggugagauuguggagaaauaggaacacuuuuacacuguugguggaaauguaaauuaguucagccauuguggaagacagugucaugguuccucaaagaucuaguaccagaaauaucaucuggcccagcaaucccauugcaggguauauacccaaaggaauauaaaucauucugcuacaaagauacaugcauguggauguucacugcagcacuauucacaauagcaaagacauggaaucaacccaaaugcccaucaaugauagacuggauaaagaaaaugugguugguacauauacaccauggaauacugugcaaccguaaaaaggaacgagaucauguccuuugcagggacaugaauggagccagaaaccauuauucucagcaaacuaaugcaggaacaaaaaaccaaacacugcacauugucccuuguaagugugagcugaacaaugagaacacauggccauggggaggggaagaacacacaccagcguuuguuggggguggggugggaagagugagagcuuuaggaaaaauagcuaaugcuuguggugcuuaauaccuaggugauggguugauaggugcagcaaaccaccauggcacacauuugucuauguaaccugcacauccugcacauguaccccggaacuuaauuuuuaaaaagaaccaugcuaaauuuauuauagucauaauuugccuuccaaauuguuugggauauucucuucuaagccccaaaguuuuaauucuuacuuuguuugcuucuuguuugugucuugaaacuaaugcagaccuguuccugaggaaaauuucugcaaauuugggagggcuucugcacuggucuugguggcaaaccuacagugccugacuugguaguguuggagaaucagaagugaggaacaacugggguaauugccuuuuuagacucauggccuauagauuauguuaauguggauaaaaauacagagcuaaucuucauaagaugaugucaguuuugccaccugaaugucugguugcuaaagauauggaucccuuuuucauuagcaaaauuagguuuuuaugcaauuuucacagauuuugauccugaaccuggcaaguuuagcuccuagcugaauuuaguaccuaucuagagccagacugagaauauuuuuugacuuugugcucaguuaucugaguacuagcgguaagaaucauauuugccauuguaucagaaaaauaaaugguugaggacugcugacaagcuaauugauugaugugcuuuccuagugaaugcucuggagccaaagauucuauuauauuagaaucucugauacuagguuccuaaaucuaaaguuuagaauugugcuugguacauuguaagcacucacuacauauuagccauucuuauauuacauauuagaaucucugaucuuagguucucaaacgagaucuggcaguugugaauuuucacuugauauucccuuaagugcuuccucuuaaaaauaaguaagcaaauaaauaaauaaauaaaaggccaggugcaguggccaaugucuguaauuucagcgcuuugggaggcugaggugggaggauugcuugaguccaguucaagaccacccugggcaauauacugagauauagugagacuucaucucuacaaaaaucugaaaaauaaaaaaaaguccuuuuuuuuuuuuugagacaggguuucacucucaaauuccugaccucagguaauccacccgccucaaccucccaaagugcuggaauuacaggcaugagcaacugcaccuggcaagaagugcuucuugcuuucaaccucagauuugcuccucauucaauguguuguuuaguuuacuucucaaggacugugccuaauuuuguggauguuauuucucuguuaaaauuuucagguuuacugucagucuuuuauuauuugguucgcauuguguaaccuuuuuaggauauuuuauucugugaaacuuuuauuacuuugaggccuaaagaagauaguuaucaguagaccuucuuuucgcuugugcuaguccuagaugaagcccaaugccaggugaaacagcccuacccgaagggagcaaaagaaaauaaacccugaagcuaagcaaacccauuggucacauucugauccaagaaagcuccaaauccaaucucagagacaguugaagaaagucguauuacucccagaauaauucuaaaccugugagaauacaagugaacuuaaaaccaugcuccaagccuggggcgguggcucgcaccuguaaucccagcacuuugggagguggaggcggguggaucacgaggucaagagaucaagaccauccagcaacauggcgaaaccccgucucuacuaaaaauacaaaaauuagcugggcauagugggugccuguaaucccaggcugaggcuguagucccagguacucgggaggcugagacaggagaaucgcuugagcccgggaggcggaguuugcagugggcagagauugcaucacugcacuccagccuggcgacagagcgagacucugucucaaaaaaaaaaaaaaaaaaaaaaaaaaaaaacaugcucuaugcucgguggcucucaauuuguuuuauuuucucucucucucucuuuuuuuuuuaugcugcacccauuugagagaaagauaaaccucuaauuaaaaacauucacuacuuugggcauuguuaaaaugggaggcaacugcucucucccuaagccgugguucuuaaacacuagcugcagacuugaaucaccugagaagcauuuaaaacugcuuaagcccaggcccuuuagccugagguugggcaucggccuagaaguuauaaaaauuaucaggugauucagauguucauccgagcuugauaaccacuaccgaacggcuacccaggggcagaaagguguaguacaguggucucucugcacauuagaucaccuggggaauguuuuacauccuucugcccagagcccacguuguacuaauuaaaucaaaauauuugcacaugggagccaggcggguuuuccugaagauuuccgguggucauucccauauacggcaaaguauuggaacugcugguguagugacuaagaacauugaccauggaagacucagguuuaaauccagcuucuccucugauagauuuuuaaguuuucuucaccucgucuguaaaaucuggaaaauuauuuagcuaccguauagaugugucaucaggaugcaagguauuaauacauauggagugcugagaauuguguuugguauauuguauguauucaguaucaguaaauauuagucuuuuuuuuuuuuuuuuuuuuuuuuuugagacagucucucgcucugucuccaggcuggagugcaguggugcgaucucagcucacugcaaccucugccucccagguucaagugauucuccugccucagcuuccugaguagcugggacuacaggcaccagccaccacgccuggcuaauuuuuuguguuuuuagcagagacaggguuuugccauguuggccaggcuggucuugaucuccugaccucaggugaucugccugccucggccucccaaagugcugggauuacaggcgcaagccacugcguccagccaauauuagucauuauuauguuauuuuagaauaucucagggugggguauuuugaauaccucuccccgccucaccaccauccuaggcuuagcaccauguggaguuaguaaacaguacgugucugagccauacugcuuaacauucaacaggaauuccuuaaacauacuuuuauaaaguugugguuugguaagcgaaaaguucucauuuuugcaaaauaaugccugcucauuuuaaauaauuaagcaauacaaaaggaugcaaagaauuuuuuaaacuaccccauaaaucaucaacacugacuuuuauuuuuagguauauuucuaugcagauauacaggcagaaaaaaggaaggaaaauaggaaggaaaacuggauaaauaugcuuuuuacaaaauccaggcuguauuauaaugaguuuuuauuuucagaguguuauuuuuaaguuuuacaauggaaaaauguccaacauauugaaaaguaaaauaguacuauuauuccucaugugcucauuacugaaaugcuguuuuguuuuuauuauuuuuauuuuuaaauagagauggcgggggggggggucucgcuauguugccccaggcuggucucgaacuucuggccucaagugauccugcaccucgaccucccaaaguauucggauuacaggcaugagccaccgcgcuuggccugaaaugcuguuuuaaauaaaaauguuaaaaguaguuuuguuugaauucagugaaaaaccaaagugcaguucaaaaaauuauugauguauuuccuaaaugagguuuuuacaguaagaaaagaaauugugaaaaacauuacaauucguaguguuuuuacaaaaagaucuucauguuucaaauuuagacagcaucaccgucuaccauaagggaugaagacauuggcacucucacaaaugauauaauuuucuuccaccuuuaccaauuuauguuggguaacuuucucacucaaaguuuauaacauuuauagucuguuuaguaaccauaucugcacaaccucuacuguucauuuuauguugaaccagauaagaugcuuaccaccaaucuuuuuccugauauauggcuuaauuggcuguauuuaagaaauuaugacuucucagaaaaaguaauccuagaaauaucaaaaggaggcuuaaucuuuagaaaauuaccauguuuagaaauaagacugagugcaguggcucacaccuauaaucccagcacuuugggaggcuagggcaggaugauugcuugaacccaggaguuugagaccagccuggacaacaaaggugagauaugccgucuccacaaaaaaauacaaaaaauuagccaggcauggugguguacaccuguagucccagcuacucaggaggcuggggugggaggacugauugagcccaggaguuggaggcugcagugagccaucaucauacugcugcauuccagccugggcaacaaagugagacccugucucagaaaacaacaacaacaaaagagucaaaaucuuucuuuuagaaauaaaggaauaacacugauuguuuaguucuuaucucacauuuuuucuucugauaccauggaugcaaaugcguagggcaaucccaguguaauuguaaaauuuuccaaucuuccuguguugucaauuaauucaaauuaaaaaacaacaacugagcaggugaaacacacuacuuugcaacuucuuuaucgaaugaaucuauuccuauauaauaucaccguuaaauuaucugcuuugaccagaucaugaucuuugugauuuaaugugacuacaaaguaaaguacauuuauuucauuucccauggaguuuucuugauugggugcuuuauuuucaaaauuuagcaacuuauccagcauacaucuguguugaauuuucuguauauuuucuugauauaauuuaucuugauauguagauucaguuucucuuuuuuaauugaaauauguuaaucauagaaaagaauauaguuaauacuuauaugccccacacccagcuucgaaaauaaaauauuacaaauacuuuuaaauucccgagaguacccaucucuggcaaacucuuaccuuacacaauagguaaugucuaucuugaaauuuguguuggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaaaaaaaaaaagaaauuuguguuuauuauaccuguaaaugucacucauuaccuaugaauguaucucuaaauaguauuauuuuacaaguuauuaaauuuuauauaaauuauaucaaaguguaauuaucuuugugcagcugcagcuuggauuuuuuuguuugacucaauuuuuaaagaagacuuauccagcugggcgcauuggcucacgccuguaaucccagcacuuugggaggccgaggcggguggaucacuugaggucaggaguucgagacuagucuggccaacauggugaaacccugucucugcuaaaaauacaaaaauuagcugggcauggugggugccuguaaucccaggcugaagcaggagaauuccuugaacccaggaggcagagguugcagugagcgaucacaccauugcccucuagccugggugacaaaagcgaaacuccaucucaaaaaaaaaaaaaauuuauccacaaugaugcauggaggucuaguucuuugauuuuauugcugaguggugugccauagcaguaguguaccacaauuuagauuugguucuuuauuucguggaaguuuuucccuuuauuguuuauauugugcccugucucccaucaccuuggucacaccucugauuccagcugccacaguuguaaauacagguuuacaacuauuuacacagguguaaacaguuuugugugugcuuccauucacuuauugcuaauagcaccucauccucucuggagccugcuggucccagcacauacauagcuccagugugguggaauuauuuuggauagacaauucugguagacacuauguauguauuuuacgagguaccauggaaauuaagccuccauugcuuauagcaaugacuuugauggcauaaucuuguauuaaguuuucuuccuucccucucucucaucacuucugcccucaggaaccaucucccaaauaaacuacuugccugcaagucuuuuucucaggcccugcuuuugaagaagccaaggugugugugugugugugugugugugugugugugugugugugugugugugugugcuuucuauuuuuuaggguucaucucuguggcuucugauaagugagaucaaguuaggagcccugccaaauaaggcugcuccauucugcuucauaaucuguauuaucuuuucuuggagaucucuuuugaaguuuauggcuuugaauuuugucucuauccuuaugacugguugcuagggaagcagucuaccuuccuuccuuccugucugcauguuuguuugcuagucuucauucuuuuuguauuuuaaggacaccaauuuuccuaagguuggauuaucuuucuucaauucuguuuauuuuucugauuacauuaaucuuuguauucucugauuaguucuucugugucauaguauuuuuuucaauuaugacuauacuguuauguuucuuaauuauuaguuuuaugguaaaaaguuuggucacuaauuuuuagacuccuuauaaaauucacuccuguuuuuucaucuugucuuuuaguucuuguuuauuuuauucacauucucaguaaguuccaaauccugaagcauuugugaauaauguucuucguauucauuggguuacauuuuucuccugggcagaguucuuugaucuguuguaugccacauuuuuuccagcugucuaucuucuggucugugccucccucccuauucucucucucccuauuuuuguuuauuucaguuugaucaccuauuggugaugccuguucuuuuucuucuugcucaugcuugacagcucugccccagcuuuccauuuguuugcacauuguguggaugacuucuucacuccucaugucacguuuguuuuuggcuuaccucaccuuugugguugcaaaaauauaaacuccucccccuuuccauuccucuuuugucucucucucuaguaggucauggugaccuguacacauuauuccucaacucugacaugguauauuaaauuuuugcaaacuagcccugauauuuuucugucuuccuguaaaaacuacuucucugauucuuacugcucacacaacaccauaucaagguuugcuuucugcaguaggagaauguauuguguuuucauuggaaaggccauugguguguuacccuagaauuuuuacuuuugcuggaaagugcuggaauucauuucugucuuacuaauuguuucccacagcuugggcagcaucucuuaguugcaagagggaaaaaauaauggaauuuauucaauuuguuuuucuccagauuugggguguuaaugagaauuguuaauucaucucugacuucugauacaugaggacugaguuagccuugccaaacagggcuguuccauucuccuccagaagcuauuguauuuuuacuugacuaucaacuuugaaguuugugacuuugagcucuuucugucuuguguauuugcugcuggagaaccaaccuaccuaccuguuuacucucuaauuacuuuccuuccuuuucuuuuugauguugguugaagaugggagauuaugugaagaagcuuucauuucacuacuuuaucccggaagucuucuugguuuuuuuuuguguguuuuuuuaaauugugaaaaaauacacauaacguaaaauuuaccaucuuagccauuuuuaaguauacaguucaguggcauuagguacauuuacauugugcaaccaucaccaccauccgucugcggaacaguuuucaucuugcacaacuaaaacucucuacccauuaaacaauaacuccacauucaccccaacccccuuuuucuuguuuguuuuaaaauuuacauuauguaagaauguuucuauacugauauaguuuggcucuguguccccacccaaaucucauguucaauuguaauccccaguguuggagguggggccuggugagaggugauuggaucauggggaugguuucuaaugguuuagcaccauuccccuagugcugccucggugauagaauucucacaagaucugguuguucaacaguguguagcaucuccccauucacacuuuuccuccugcucccaccgugugagaugugccugcuucccuuucgcuuucugccaugauugaguuuucugaggccuccccauacgugcuuccuguacagccuguggaaccaugagccaaguaaacuucuuuuccucaugaauuagccagucucaguuaugucuuuauagcaguacaagaacuaauuauacauguaucuuuugugaaacugcuauugaaacuacugucuuguuauuuauaucuucauaugaguaagauaaacuagucuuagaauuacuuucaggaaaacuucauuccugcuauuuacugaguauguauauauauauguuuacccuguauuacuagguguaaaacaugcuguguagauagauucccuuuguaccuugauugccaagaagcguuaaguaccuugagcuuagaguuuucugguauaaauuuauaccuccauuucauuuuaugugcuuaagucccccauuucauuuuugguagcaaaugaaauauaguaagauaauacaugaggccagccaugguggcgcaguuccuuggagucccagcuacucaggaagcugaggugggaggaccauuugagaccaggaggucgaggcuacagugaaguaugauugugagccgcugcacuccagccuggguaacagagugagaccuuuucucuggggaaaagaaaaaaaaagaagaagaagaaauuauuaaguagcuuuuaguuuagccaaaagaauucuccaaaugagaauugcauguuguucauuuaaauguaaccuuuuuauugcuacccagguucacaaccuauuugucagcugaaaugcuucaaaauugaccuaauaacugaguuuuuuucagccgaauuguuauauuuaagauagacauaaaaucuuagugauuaugguuaaguuuggaagauguguccaaaauaaacaaacuuuuuaaaaggagaaggaaauauuuauuacauguuuauuauaugacauauuuuucuuagucaucacaagagcccuaguuuauuauuuaacagauuuauuauccccguauuucagcugugaaaacuauagcucauucauguaaaauuacuuucucaaggucucuuaacuaauaaaaguagaacuggaauuuggaauuuggauccuuuuuuuuuuuuuucugagaaauuacgauagaaccuuuauuacugauguuucuguucuagaaacauuucguacuauaaacaugaacuguuugagccuuuauccuauaaaugcuuuggaaauauuuaccuacuucuguaaauacauccuaaagaaaugacuuuuuaguaaggaauacaguaauuuacuuccuaaagucuagaaaauaaaaauauuguacccugagaggaaacuuuaaaaaaucaaucuguaccaagccaaaguggaaauguacaagccucuuaaagaaagugacgucuccaggucugcaaguuugggcaaguuuuuacgguuaauauguuugugaaauucaacaaauaacuucuguugacaacaggagaguauauguuguuauuaaucaagagacagugguuuuaauuuuauugcucuccugaacagucacaaacacccuugaagaugauuucuucuuaaacucuucuuacauucuuacuuuuucuguuucccccaucauucccuucucuuuuucccaauucuacagccauguauaguccuuugcagaggcuauaugaguauuggagaagugggggaaaaguugaagacaguuguaaauuuauacuggcuaugcuguuauuucacuauuuuguuuuuaugcauuucucaaugaaaggauauacauauguguauuagucuguucucacacugcuaauaaagacaugcgugacacuggguaauuuauaaaggaaagagauuuaauugacucacaguucagcauggcuggggaggccucaggaaacuuacaaucguugcagaaggggaagcagacacauucuucacauggcagcagcaaggagaaguguugagcgaagggugggggaaagccucuuuuaaaaccaucagaucucgugagaacuaacucacugucacgaaaacagaaugggggaaaccaccccaugauucaguuauccccaccuggucccucccaugacacguggggauuaugggagcuauaauucaagaucagauuuugggaggaaauagaaccaaaccauaucaauauggcauagggguugaguauagguucuguuuuuagauagccuguguucacauccuagcuuuucuuuccacuuaggcaaguuaaguaaauucccuguacuucaguuucaucauuuauaaaaugaggguugaaauaguaggaaagucugggauuguugcaaagaaaaauuaagguacuuaagacaugccugucagauaggaauaauucaggacuggugcagugcucacucuuguaaucccagcacuuugaggggcggaggugggagguuugcuugaggccagaaguuagaggccagcuuggucaacauagcaagacugucucuauaagaaauaaaaaaucuggcugggcauggugguuuacgccuauaaugucaacauuuugggagucugaggcggguggaucaucugaggucaggaguuugagaccagccuggccaaaauggcaaggccccgucucuacuaaaaauagaaaaaauuagcugcgcuugguggugugcgucuguaaucccagcuacuugggcggcugaggcaggagaauugcuugaacccgggagauggaggccgcagugagccgagaucacgucacuguacuccagccugggugacagagcgagacucugucucaaaaaaaauaaaucauucaguacaugggaaugucucuuccaccuaacuuugaguguccaauuaggguaauaguucacaacuuuggcuauguauuaacagucgugcgaggagcuuuuagaaaauacaaauccagcaaggcacaguuccucacaccuauaaucccaguacuuuggggaguugauguggaaggaucacaugaggccaggaguucaagaccagccugggcaacauagcgagacuuugucugugcuacaaaauauauguauauaacacauccaccccgcuauucuaaugauuaagccuuugauagggacggggaucacauuuucccuguuauuuacuuguuuauuuguaaaugccaugagguuuuguuuuguuuuguuuuguuuuuugucuguuuuguucacugcuguaucccuaauaccuggaauaaugccuggcacauuaaguagccacucaauuuuuuuaaugaaaaaaauaaguaaauuaucuguggauucucagugguuuaucuccucucuugccauacuuuuuuuuuuuuuuaauuuacgaagguaaaguucauucuuuuugcuaaacaguucuguuaauuuauggucaaauccuccccuuaacccuuggcaaccacagauuuauucuucauccuuagaauuuuggguuuuccagagggucaaauaauugaaucauacacuauauaccuuuuugaaucuggcuuccuucacuuggaaugcauuuggagcucauucguguuaaguguauuaauaguuuauucuuacaagugguauuccauugaauggaacaaauaugugaacaaucuuacacuguuuuguucuuuuugauuuuuagcuuuccagaguguugaaucuuccaccagaaaacuugaucacaucaauaucugcaguuccaauuucccaaaaagaguuaaguauaauacacuuguaacaaucuauaaaauguugcugacuuuguugauacaccaaaaaagcaaaaaagaauuguuacucuucaguuuguggaauaguccuugaaauuaacuguaagauaugauucauuauacucagccuauuacuccuguugacuuaaauaauaaaauuaaaaucuguauuuuaaauacucugauauggcagauuguguauucuuauguucauuauuuuaguuaugcuaguaacuauaauuguggcaaagucuuugggaaugagguucaaauucaauucuguaacaauaaauaaaauaacuaaaauugugguuagaaucucaggguuuuugaagggauauuaaagauuguacagccaucuggugcuugaauacuguuguaccauauuuaucuacuagguuuuuaauguuguuuuuguuuauugaguuuccuuuugaguacucccagugauagaaaacuguugguuaggacuacacacaacuaauaguugcuuucucaguuacagagagguaucucuuugugaguuuggucauccuaaaugauucuuguuuacgauuuggguagaaaacuucaauacuuggauagauuauugucugucaauuaauaaugacaagaaauuagcuacauaguagucauuuaaguccuaagcuuugaaaagaaguuaagauauaauuaccaguaccauucuguccuuguauuuuauucacuuaacuuugucaggacuuuaagaguagaaugaauauucuucucagaauagaacaaagaaguaaguggaaaagaaagagaaaggcuacauuuggccuucuaguaaaagcaccuuuaaaauggcccacugcggcuuuuuauauugacuuucuguaagagaggcagccacuaccaagaggaucucaugauuauauguaaauagauguaaccuuccaaacuaguugccuauuucguaaaaucuauaaaugacauucugcauaauaagggaaauguuacugguuugguguuuguuuguuuugagaccaggucucauucugucacccaagcuggagggcaguggugugaucucggcucacugcugccucaaacucccgugcucaagugauccucccaccucagccuccagaguagcuuggacuacaggcucacgccacuaugccuggcugacauuuuuguauuuguuguagagaugggguuuagucauguugcccaggguggucuugaacuccugagcucaggcaguccccuugccuuggucucccaaaguacugggauuacaaguaugaaccaccacacccagccuguuuguuuccauuuucauuuaaugugucaaaggucuuuaauaagcugaaccaucuuggcccaucuuuugaauaggauuuccuuugccugcuuccacuuuaacaaucugagguauuaacuuuaguuuauagaaaauaaauauuggggccgggcacgguggcucacgccuguaaucccagcacuuugggaggccgaggcaggcagaucgugaggucaggagauggagaccauccuggcuaacauggugaaaccccgucucuacuagaaauacaaaaaauuagccaggcaugguggcaugcgccuguaaucccagcuacucaggaggcugaggcaggagaaccgcuugaaccggggaggcggagguuagagugagccgagaucucgccacugcacuccagccugggugacagagcgagacuccgucucaaaaaaaguaaauaaauaaauuaaauauuggggagggccucaagauuuuucuggccuacaaaucugaaauucuucauauuaaguuuacuuaaaacaaagggaaccucuagugcuuugccauaauaaauucagguuuccuuuacaguauguaacuaagccuaaccguucuauauuucuaacuuuauuccagagugcuuacaagugccaggagaauuaagaaauaguauuuuuguuaacaugguuuaauuaauauaaugaauuaauuuacucugaucuaauucucucgauuuuauuuucugucuacuaucugaugguaguaaacagaauuaacaacuuuauuauaagccaauggcuaucaagucuguggauuucacacuaaccaauaucacaacuccucagaauuaaugggaaaauaacuauugcuuuuuaaacuuuuuuaaguauaaagaaugaguguacagggacuaguuuaaugaacccugugugugcccaucacccaccaucaucuguaugggaccaguuuuuucuuuguuuuuuugaggcggaaucuugcucugucacccaagcuggagugcaguggcacaaucuuggcucacugcaaccuccgccuccuggguucaagccauccuccugccucagccuccccaguagcugggauuacaggcacacaccaccaugcccagcuaauuuuuguauuuuuaguagagacgggguuucaccauguuggccaggcuggucucaaacuccugaccuugggaggccaagguagaaggauugcuugagcucaggaguucaagaccagcuugggcaacaugcgccugccucagccucccaaagugcugggauuacaggcuugagccaccaugccuggcucaguuuuguuucuuuuacacgccgucugcuuuccuuguccacauuuuuuuuuuuuuuuuuuuuuuuugagacaggaccuagcucuguugguugcugaggcuggagugcaguggcagaaucacggcuuacugcagccuuaagcucccaggcucaagcuauccucccaucucagccugucaauuagcugggaccagaagcaugggccaccacacuuggcuaauuuuuuaaauuuucuguagagaugaugucugccuacauugcccaggcuagucuugaacuccucagcucaagcaauucuccuaccucagccucccacacuagaauuacaggcuugagccacuguguugggcucuccucauccacaguuguuuauuuugauaucuacugcuuuucauagcuuagauguuuugucuuuuuaaagguuuuauuuuuaaauguguuuuucuauuauaaaagcaaaacagauaaucuucuuaaggaaauucaggaaaauacagaagaauaagaaaagauaaaagcccccaauagucuacuacaguaagacaacugauuuuagcaaguugauguauuuuuuacuuuuuuguuugaaauuuuuuuagcguuuaaaaagacauagcuauaaaacuacauagaaaaacauaagauauuugaauccuuuuccugacauaauucuguuuuuaaaaugaauaucgcuuuuagcaauauuguaacauucccuuguugcuagacauuuagauuguuuucauuuuuuaauauaaauuuuuuuucuuagagauugggucuugcuauguugcccaagcuggucuugaacuccugagcucaagcaauccuccugccuuggccucccaaauguuggaauuacaggcaugggccccuguaccuggccaaaguguaauacauaguaggcugcuggaugauguauuaaggcucaggagaauucuuaauggucauuguggacuggguuuuuaaaugugauguuaaccagaagucacacaggaauuuuuaguuauuucccugaguuucauaaguguuaaugaaggaaauaauuugugccuucucaaaaauaaguuuuuucauuccagugacagaugggcuggauaaauaaaguuucaacccucuuacucugcccaucgagucucauucucuaguuccauauuaaacaccagaagauaaauuagugugaguaguuauauagaugcuuauauguugauuaaaaaaauuuuuuuugcaccuugaacuauuucaaaccuacagaaaaauucauagagaaugauguaaugaguacugucauggucacuuucuaaguugucaaguccuuuuuccaaauuuacuucaagucuuauuuuguagggaaagggagagcuuuugauuuuuguuaagcauuacagauaauguugaagucacugauauauauuuguuugacugcauucccuacccugcuucccuagagagaacugaucucaugaugcaaaugauuuauuuucacgaaucaguugcuuuguguuuguuucuuuguuuuuguauuuuuuuuucaccuacccagugaaaaggauaaauggcauuguccaucucuuuaaugaacuacugaguguuaagaagaauauucuucuuuuucucauguugaaacucaaauuacaacauuuaaaaaauaugucauuuggaggucaguggagagguuugaauuagaagcauguauuuggaguaguagaggaagcauuguagaagagguaaagagaccugggcuuuuuucucagucuguuuuuauuugcaguaggauuuuaaaggagacauuuagcuugccagacaucaguuuucaugucuauaaaauaagguggcuaguauaagaggaagaauuuuuugagacuaggucuugcucugucacccagacuggagugcaguggcaugaucucagcucacugcaaccucugccuccuggguucaagcaauucucgugccuaagccucccgaguagcugggcuuacgggcacaugccaccacgccuggcuaauuuuuguauuuuuaguagagaugggguuuuuccauguuggccaggcuggucucaaacuccugaccuuaagugguccacuugccucggccucccaaagugcugggaucugugcccagacagaagaggaagaauuuuauaagaugauaagaaaaacauucugaauaaauacuagguuauuucucauuuucuugcuuuuaauuuuguuuuuuauuuauuuauuuuauuuuauuuacuuuuuugagacagaguuucgcucuugucacccaggcuggagugcaguggcacaaucuugacucgcugcagucuccaccuccaggauucaagcgauuccccugccucagucucccaagcagcugggauuguagguacacaccaccaugccuggcuaauuuuuguguguguguguguauuuuuaguagagaugggguuuuaccauguggccaggcuggucuagaacucaaccucaggugauccgccugccuuagccucccaaagugcugggauuacaggcaugagccaccgcucucggcccccuugcuuuuaauuuugaaaguacacauaacaccuucuucugguaaagguaugucucaauggagaacucauagugauuagucuuuguuuaacaacuaaugcuuuuaagguaacaguucuaucucguuucgaugucugucuuuagagaaguagcugauuuucagcuuucuguggauucuuuauuggaaaaagacaaugaccauucaagaccagauauucaaguucaagccaagagacuagcagagaagguacguuagcacuauuaucucuuuuugacauuguaauaaacuuguuauuaaaaaaaguacuuugcaggcuaucucagccauaauagugaauuuaauaguguuucuuugaggcaucuuguguaauauaauuuaaauucauuuuagccauguacuauaagguuauaaugauuuuucagauuaguuauaaagcacuccucuugagcugacauuguucaauuuuuugauuaaccacuuacaggaagacugaaguguuaauuaaauuuacagauugaagcuggauggacuuuugaauuuaggagaacaagcuugauaaauuagagcagugaguugcaauuuuuaaaaugaguuucugaaaagaugaacauugaaauaugagaagaaaugauuagauguaaauagaaucaugauuacagagaagaggugguuagaugauuuaauaagccucuuucauuucuaaguucucugauggguuugauaucuaacagaggaauugaaaggauugcaaggaauuacuaaacauaaauuguuaguguaauucccucagaaaaggcagauaauguuggacaagguuauuaacauacauccacagagucagugucugggaacucaaaagaauuggaacaaugaaagucacuaucauagaaaaagaugcuuauuuaaagggugacuaugauaaaggagcauugguagcuuaguaaauauuuauuugaucagaaaaucacucccagauauuuaccaggaauagaauuauucaaaauacaguauuuaguuccuuuuccccauuucuuguaaguucuuaaaaauaaagacuaguugcucuuuagugacagcagauaucucuucaaguuccauagguuuuucaugagauggcuucgaacaucuaauagguuaaaaagugaaggcauaugcauagaagacagacuaucuaaauuacaucuuaucuguuggugcaggugcuuuagcguagacccugacagaaugucauguucuguggcucucaugaaagcuaggugagauaaaaaguguucaucguaugucagaguagguagaauauggguagagugauuuuucuuacuuguuacaaggugaauuugaggggagggaaagagaaugaggaagagagagacugaauacagaauagcauguuaguugggaaaaaaagaaaauguguuuacuuaaauagaaguauggaacuaaagagauugccugagaacugggacccgauauagggaccaugaaagaugacuuacuugugucuuuguaagccaaaaauagcauuagaacuaccuaucucauuaggccuauuauauaacauaccuacuuugugugauuuguucuuuucagcuaagaugugauacaguggugagugaaaucaguacuggucaaaggacuguaaauuucaaaauaaacagagagcucuuaacaaagguaagaauaaguuaauauccagccauugugcuuucauucugucugcuucagccacaguggucuuccuccaguuuuuaaauucuuuaugccuccucuggccucaaaaccuuugcacauacugauccauaacuuggagaguaccaccccaaguuaacaccuacucauccuuuaaaucuugauauuucuuuggcaguagcuuucugaccccuucauuuauaugcucucauagcacuguauagucauauaccacauaaugacauuucauacacaacguguauagaugauggucccauaagacaauaccauauuuuuacuguaccuuucuguguuuagauauauuuaaguauacagacacuauuaugauacaguugcauacaauauucaguacagugacaugcuguacagguuuguagccuaggagcaauaggcuguagcauacagccuaggcguauaguagacuguaucaucuagguuuguauaagcacuugggaggcugaggcaggaggaucacuugagcccggaaguucaagaccagcccuggcagcauaucucuacaaaaaaauuuaaaaauuagccacacaugauaguuugcgccuguagucccaacugcucuggaggcugaggugggaggaucgcuugagccugggaguuugagguugcaaugagcugugauugugcuauugcacuccaaccuuggugacagagcgagaccuugucucaaaauaaaaauuucaauggccaugaauuuucaagcuuuauugcaauuaacaaacuaaagaauuuuucugauuuaaggauacccauuagcucacuuauuaaaaauauucccaaauccuucucaauugacauugaagggacaagagucagggcuuugaaguccaacuacucuuucucacaugggaauucuuccguauugcagccuugaggaucugaaucuuagugagaauuugaauaaaggagcaagcggacugcuuacaguugcccugcucagugucacaguaaaaucagauccuggagcagugagcacucauguucagaaaaagacuauugaauguaccucugcuuuguguuacaauuuuaaugauaauucuucuuuacugaaaauuuaauguauucuacauuuggcugucaaccuaaaaggaggaaacugaggcaaaauuaauauaaguagagaguuuacuugggccaggcuugaggauugcagcugaggagcacagauucaaguugccgugaauauacccuuugauaggcagcaguuacaaguggauuuuuaaagggaaagaagagggaguuugaguuguuaaccagaauuuacauuaaaauaauguaagcuauugauaggcuguauauuuuucuuugugucacaaaugccaguaacaugaagauaaugugugaggcagcuaguugggaacaaaaucacauaaaacaauugcccccacccauaggaggaagaguuugugcauaacugauguuugauaugcaugucuuucugggccugcauaccucacauagcugagacuacucugagcuauuuuucuuuucucaagcuuauagcaucuguuuuucucacguauuggaucucuaguuuuauaauuuuaacuguuuuacaguccauuuuuuaauaaguaggauaauacucuaaaauaaugauuaaaaguaaauauauaaaucacuaacauagucauuuauaaugaaguauuauguacuguacauaauuguaugugcuauacuuuuauacaacuggcagugcaguaaguugguuuacaccauaaguuuuaggucucagaugauggucauuugcaugguuuuuuuugagacggaguuuugcucuuguugcccaggcuggagugcaauggcacgaucuuugcuuaccguaaccuccaccucccggguucaagcgauucuccugccucugccuccccagguagcugggauuacaggcaugcaccaccgcgcccagcuaauuuuguauuuuuaguuucuccauguuggucaggcuggucuugaacucccagccucggguaauccacccaccucacccucccaaagugcuggcauuacaggcgugagccaccgugcccugccaucauuugcauauuuaauggauuuuucagaucacaucaagaaaaaaaauucgauucuuguuaggaccaacaaagaauuaauauaucuuuguuugagaaauaaccauaaugacauugcaaagaacugucacuuugguaccaaacuucuaccugucaguagcuugcaguacuuucaagagaaacuguaacuucaaauaauauuuaauuguuaaaagggaaaaaagaaaguaugaucucaaccaaauaggaaaaauucaaacaaaacccuguuuucuuagggaugcuucagaaauacacaauggauaacaucauuuuauuucacgcuuuuuaauuugccaaauuaaacuuugcauguuuaaccaaaaguaaaagaaaaaguuaaauuuaaaaaucucuuaaaccguucaaaucauugaaggguuuaaauaaaacagacuugauuaaauguuugugcuauguaaaaagauaauuagguguuauuguuuuguuauauagucguguguugcuuaacaaugggauacauucauagaaauguguccauaggugguuuuguuauuaugggacaucauagaguguacuuacacaaaccuagaugauaaaaccgacuacacggaccuaggccauaaacuugugcaucauguaaaauaccaaauacuguauuugugcaauugugacacagugguauuuguaucuuaacaugucuaaacauaggaaggguacaguaaaaauaugguauuaaauauaaaagaugcuauaccuguauuuaccaugaauggagcuugcaggacuggaaguugcucugggugagugaguggugagugcaugugaaggccuaggacauuacacuacuguagacauuauaaacaugguacacuuagguuacaauggguuuauaaaaaaauauuuuuccuuguaucauaacuucagaauaaaauaauaaaaauuaaaaaauauuuuucuugccuggacaugguggcucacgccuguaauuccagcacuuugagaggcugaggcaggagaaucacuugagcccaggaguguuagggcugcaaugaacuaggauaacacugcuguacaggaucacacugcuguacuccagccugggugacacagcaagacccugucucuuuuuuuuuuuuuuuuuuuuuuuuuuugagacagaguuucacucuuguugcccaggcuggagugcaauggcacagccucagcucccaccuccgccccccagguucaagcgauucuccugccucagccucccaaguagcugggauuauaggugcccgccaccaugccuggcuagagacccugucucuaaaaaauaaauauuuuucuuucuucaaugauaaauuaaccuuagcugacuguaacauuuuuauuuuauaaacuuuucauuuuuuaaacuuuuuucuucuauuuauuuuucuuuauaucucagcuuguuuaacuuuucagcuguuuuguaauaacagcuuaaaacaagcacauuauacaauuguacaaaaauauauccuuauucuguaagcuuuuucuaauuuuuuaauuuacuuuuuagacuuuuuuguuaaaagccaagacacaaacacauuagccuuagccuacacagggucaggaucaucaauaucacugucuucaccuccacaucuugucccacuggaaagucuucaggggcaguaacacacaugaagcugucaucuccuaugaugacagugccuucuggaguaucuccugaaggaccugccugaggcacuuuuacaguuaauuguuuuuaauaaguauaaggaguacacuuuaaaauuaugauuuuaaauauaguagguuaaauacauaaaucaguacaguccuuuauuauuaucaaguaucaugauguacauaauuguaugugcuauacuuuuauuugacuggcagccuagccuaguagguuuguuuacaucaguguuaccacaaacaugugaguaaugcauugcacuaggcauuaugaccugcugcaacauugcugagugauaagaauuuuucagcuccauuauagucuuaaugggaccaccauuguauauaugugguucaucacugacugacacauuguuacuuggugcauuacuguagguguuguuuuugcagugguauagcugacagaugagggccuaaaccagggcagaggaaccaguuauuaaauaacuguaaugauauuuaggagauaacacacacagggcccagugauuaacaggugauugauuacagagguugagggaauaagguuaaguguuagggacuccuagguuucugaguagguuaguugggugagugguagugcaguuuguggaaauagacaguguagauggaagaacaaguguauuuucugugaaaugccugaaaagcauauccagucuguagcaauagagagauuaaguaauuaguauuugaagucuuuuuuuuuuuuuucuuugagacggaguuuugcucuuguugcccaugcuggagugcaauggcgugaucuuggcucauugcaaccuccaucucccagguucaagggauucuccugccucagcuucccaaguagcugggguuacaggcgccuaccaccacaccuggcuaauuuuuuguauuuuuaguagagaugggguuucaccauguuggucaggcuggucuugaacuccuguccucaggugauccuucugccucagccucccaaagugcugggauuauaggugugagccaccaugccuggccaaguauuugaaaucuuaagggagugguuuaagucaccuaaaaguguaaaauaaaaagcuagaagcaagaauggagcacagagugcagagucaagggcagaugguggaagaagagccuacaaaggaaauugagaagcaaaaguugagagagaauugugucuuuacaaccaaggaaagaggauaguugcaagaagggaguagucaccagguaagaugauguuugaaaaguguuuacuccugaggaaggagggaaggaauuaggauaaggacagaugaucgaaagggacuucagccuuauuuuaaaugaucaauuuuuuaaaaauuauuaauguugccuuuuuguuguuugugccagauaaaucaguagauagaggguuauuguuaaagagaauucuaacuuacuacgauuaacuguuguggagucugccauucauuacauaaaaaggagaagaagugggaaagauuuguagacuuucaacuuagaauaaucugaaucuggauuucuucuuacugauguguucuugucauauauauucuuggacuaauaauacugggacccuaguuuacgacagacacuauucuguauacugucuauauauuguauuaauccuuuauguguuucuuauugcacaaugugagucaagagaguauuauuuucucuacguccuugugcacauacauacuauuucugaaccuuaguuuuugcauccauuaaaugggaaauguugcccaucuuuaagauuaugaggcuuaaagacaacggguacuguaggagcacuuggucuuggaccuagcacuuuaugcuucuuaaaugucgauuguuauguacuggcugcugcucccuucucugccuguuccauuuagagaccauuuuaaccaacucuuuaauaauaaaauuuuucacaacauaaaccacauuuuuaagacucaagaugcauuuuggggccaggcaugguggcucauaccuauaaucccagcacuuuaggaggcuaaggugucaggaucauuugagcccaggaguucaagaccagccugggcgacagagugagcgagagacccugucuauuaaaaagaaaaaaaaaaaauuuuuuuuuuuuuuuuuuugagacagagucucacucugcgcccaggcuggagugcaguggcgcgaucucggcuuacugcaaccucugcuucccagguucaagcaauucuccugucucagccucccaaguagcugggacuacaggcgcaugccaccaugucugguuaauuuuuuuuuaaaauuuuuuuaguagagaugggguuucaccauguuggccaggauggucucaaucuccugaccucgugauccaccugccucagccucccaaagugcugggguuacaggcgugauccacugugcccuuccaaaaaaaauuuuguuuuaauuagcugggugugguagcauguaccuguagucgcagcuacucuggaggcugaggugguaggauugcuuagguaggaaggucguuugagucugauugaggcuucagugagccgugauugcaccacugcacucagccugggagacagaguaaggccugucucaaaaauauaaaaauaaaaguaaaauauagaugcaguuagggaaacaaaaccaacuaauaugaguaaacaaaaguucaucaccauuaacauaaaauaugaauuuugugaacuauauaucauaguucuauguuaauaacuaaaaacuaaccuggaauauguuugggaaguuucugugggauuuccuuguuucucacuuguguagccaauaggcauuauacauuuuuaucuuuuuccuaccauugcuuguggucuuuaauaucacaaaagcugcagcagcaugcagcaguuaacagguuaacugugaaguggaaaaguucuuuucugcacuauuuaaucccucaguacuuuucuuucuuuguuaaaauaguucuuaccucuauggcugucgugaggaguaaguaaguuaaugcauauaaaaugcuuggaacaguggcuggcacauaguaugaacucaauaaguguuaaauggugcuucugguuuuguuguuaauauuuacugugggacuuuugguuguuacuuuacuucaccaagcuucaguuuccuucucuguaaaauaccuacauaacugguuacuguaagaaugaauagacauggaguauaaaagggcacagaacccuuguaaauguuaacucauguuacuacuaugacuagcauuaguaacaagaaaaguggugcuggagguagugccacugaggaugcuaagaaauucucaguuccauaaauuagagugaacaaauuggcaacauuuaauucucaguaacagaguaauuaaaagcauuguaauuuuuguucauuaaauuacaguccuuuaauuuucagacagugcuacaacaaguaauugaagauggcucaaaauauggauuaaaaagugaacuuuucucuggacuuccccagaagaagauugugguugaauucaggugagggugcaccccuuuuauguguugcuuaaucaaguugacugggcagaggaguguuauuaccaucauuauuugggggucuuaauaaauaacauguggaaaacuugaaaaccagugcaauuauguuauuucuugaaaucacagugaaucaaucauugaacugugaauaaaaaauauauuuuuggaccuccaaaaaugucuaauaauuauuauuuuuuuaaguauuaacaauuacuuuuuuggaagaacuaguuauucacuuuauuuauuuauuuauuuauuuauuuauuuauuuauuuauuuauuuuugagacggagucucacucugucgcccaggcuggaguggcgagaucucagcucacugcaagcuccaccuccuggguucacgccauucuccugccucagccuccugaguagcugggacuacaggcgcccgccaccauaccuggcuaauuuuuuuuggauuuuuaguagagacaggguuucacuguguuagccaggauggucuccaucuccugaccucgugaucugcccaucucagccucccaaaaagugcugggauuacaggcgugagccacugugccugacuaguuauuuacuuuaauagacuguuaaggcagagguaaugguuacuaccauauuaggaauuuuaaaguggccagacaugguggcucagccuguaauccuagcacuuuggaaggcaaggugggaggaucacuugaggccaagaguucgagaccagccugggcaacgcagaccucgccucuuaaaaaaaauagaaaaauuaguugugcaugguggcacacuccuguagugacagcuacuugggaagcugaggaggaaagauggcuugagccuaggaauucaagguuacagugagcugugauugucaugcacucuagcucugguaagacacaccaagacccugugucaaaaaaaauuuuuuuaaguaauuugauuaccagagaaacaagucuuuuaguauuuguaauaaauguauuuuuuuaauuaccagaaaaauagcuugaaguuuugaugugccucuaaauagucuucauaacuuucuaacgugcugucaguauaacugucugauauuuggacuguuagagguaaccaagagagaaaagggaacacuaagaacuaauacuuucauuguacagccgacagauugacaacccuaggaaauuaucagagauguugcauuugucuuccuaaagcugaagaacagucuugauggacuguuuuucuacuuagaaagauagaacuugcuaagagccuuuugucuuauuaaguauuuaugucuguggaagauuuuuaaaaauugauaugggaaguauuaucucauguuuacuaacucauuauugcaguuuaauagcuuuuaaacuuaguuaugauuagcuccuggacaaucagagaaagagcggguuuuaugcauguguaccgucugccacucacuugucuucuuaaagaaggcagacccucuaagagcaaacucaugaauuuguaauaaggaccaauuacugauuaagcuucuacuccuauggaguagacacauauuaugaaugacucuaaaacugccaguacaccacaauuaugauuuuuaaaguugaguuuaaauauuuguugcaucacaaagaguagagggauuccuacagucaucuucacacuagagaggaacuacacuaaggccaucuccuaaggaaauuugccugcuuuaucuccacuugaauaagaaaccacugcaaaccuuaguguagggauuguuaaaccuaagcccauaggcaacauccaguuugccgcuuguuuuugcaaauaaaguuuuguuggaacacagccaugcacauuuguuuacaucaucuacauuggcugcuuucauauugcaauggcaguugaacacaguagagcugaguugaauaguugcgacagaucagauggcccaaaagccuauuaaaauauuuacucucuggcucuucaagaaaaaaaaaugccagcuucugauuaguguuuuaaaacaacauccauuuugguacuuaugacaccauggauuaggaaauggggagagagggguauuucaggccagugguucuucuacuugccugaggucacuuauguaacugcggucaucuagagacuaguggggcuacaaaucaaaaauggcucuuuacuucucuagccaggcaucucucucucucccaccacauugucucucccgcaggguagcaagaccucuuuacaaagguacucaaggcucuaagauagugaaaucaucuagucuugaaacaggcacagcaucauuuuugucacuuucugcugaugaaagcaagucacaagaucaccccagauucaagggaagaaaaauagaguacaucucuuaauggugagagaagcaaagaauuuguggucaucuuugauuauuuucauucaugucuuuaaauuaaaggacauacugcuuucuucacuggggaggcacuucauuaccauauuacucuuaaaccccuuucaauuaccuaacuggcaaauaaaggaaaaucagcagggagguaauauauuaccuguuaccguacauucauccuugaaauaaugccauuauaaaguuuccuaaaauuugaaaaguugccaccauuacuuaccuucuuuugcauuuuuuuuuucagcuucaccaucuuuuuacuccagcuaagcucuagaaauacuguggcuucagucuuccuuacucauugauucccuggcuuuccucuuaaguuuugguuucccauauacugcuccuuuuuuuuaugcuuuuaaaaaauaucuaaaaauaaccuguucuaugugaguuguauucuguaggcuuuuuguauggcaguuaauuugcuuauggauuuaccucucuuagcuuuuuucuaaagcaguuaaggaaagcuggaauuuaaaugagugucugaaugcuggugaaggcagagccugucuaucuccuagcagccaucuuugccucugacaguucacauguggcauuguugugagaccauugcuucucucucccuuagagguuuuccaggugcuauaguucuugcuguugugauuucaaaguagagacaaaauagguagggacaggaagauuguucuuggauuucuucugaaaaugagagaggugggagaagagaauuuuuaaaauauguaguauccugaacagaccaagcaacauuccccagaaaacaagagauaccacugugcucaagaaacuuucucccuaaauugaguugauuaugauaauacuagauuaaguaacuugcccagguucacagagcuaacucuugauucugaaaccuguauacuuaacuuuuacugccucccugguacguaguguagguugucauauauuuugucugauuuaggagcagugugauaaaguacaggauaaauggcuguccaucauagauuuggacuccucgugguagaugguguaagacuugaagcuaauuacuguuuccucucuaaucucucucuagucagccucuccuauuuuguacaaaucagcucuguaagaucaugggaagcagugguagccuuuucuuuucuuuucucaacaugauuuuccccaacuccugcuguucccaagugugagacacucuucucgcaaaacagauuggagaccucuggcugguaaaaugagaauuguggaggucaggguagcaguucugacuguuaguaacuggcucagugaucuugaaugggacaguuuauuucucuggccucuuaucuggaaaauaagaguaaucuuuuuuuuuuuuuuuuuuuuuuuguugagacggagucuugcugucucgcucaggcuggagugcaguggcaugauucauugcagccucugccuccccgguucaagcaauucuccugccucagccuccccaguagaguagcuggacuacaggcaugcaccaccacgcccagcuaauuuuucuauuuuuaauagagacaggauuucaccauguuggucaggcuggucucaaacuccugacuucaagugauccacccagcucggccucccaaaaugcugguauuauagacgugagcgaccaugcccggccaagagugauguuaucugucccuucuuaacaaaaauuaaggaaauuacaugaaguaauuuaacaaaagucccaguaagaugcccaaauuauaauucauaauagcuacuucaguugccaaaagaauugaauuuguaucuuccauuucauuguauucccuucucaguagaaauaugguaucagagagaagcaaauuguugauuucaagggacauuuugucaaaacuugaagaccuggauagauucaauuuuucuaauaccggagggaaaauggaaagcucugugaaaguuuuuuuuuguuuuuguuuuuguuuuuguuuuucuuaacagacauuauaaauaccuaguuuuuuaaaaauucagagauuacaaagagauauuuaaugaaaaggaaagcucuuccccaucucaguuuccucuguggguaucuauuaauccgaauaucaguguuuuauucacccuccuagagauguucuaugcauuuguaaacagacuauacauauuuuacauuguuuucacuucuugcuuuuuuuuuuuuucuuaaauaauguauuuuauguuccuuuaauaugaaugcauccagggcuggcuuauuauuuuuauuguuccauuguauucuauucuuuuuuuuuuuuuuucuuaaaucggcuucauugagggauaaguacauacaauacuuauuuaaacauauaauuucaccauauuuaaacauauaauuugaugaguuuuggcaaagauaugcaaguuguguaacuaccuccacaauuauauagagcuguuuuucugggguuuuuuauuucuauugauuuuuuuugcuuuacuuuuaucuguauuauuuucuuuuauucugcuugcuuuggauuuaguuugcucuacuuuuucuaguuucuuaaaggagaagcucagauuauugauuuaaaaccuuuuuucuaauauaaacauuucauguuguagauuuuucugcuuuagcuacauccaacaaauguacuaguaaggcagcaauguggugcagcgcuaggacuccccuuguuugcucuucucucagacaucacaguccuucacugacuauuguccagauucauaaaaucaguguuucaucuauuuuucuggcuuucugauuauuuaaaggcagaagaguaaauccaaucuucuuuuggcuggaaauggaagguuuuuuuuuaagccuuuaagaugacauuuacuuucuuucuaaacaaugauuaaauaaauacguguguaguuucauaauuucauaauugugcacacauauccauaggaucaaguuuuuaaaucguaguacccuuaaggguguauaacaagacuuuggagacagaccagaauuuaaacucuaguuuuaccacuuuuaaccagcuauguucaaguuaauuuaucuuuuuuuaaauauugaaaaacuuaugagauuuucaaacaugcacaaaacagggaacaguauaauuaacccccauauguucauuacacauauucaagagucaucaagauauugccauauuugcuucaucaucucucuucguugucccaguucccucaucuguaaaauaaaagauaaaagcacauaugaguauuaaaugaguuaaugcccaugaagugugugaagcugugccugucagguagugagugcucuagaagcauuugcuauguuaaaugauugauuacaacuucuugagcacacacgggagugauaaauguguugauugggaauuuggaguggugagccacauucugauuguucugggagguuuuaugcauaaauauuuuuacauguuuuuuuuuuuuuaauuuuacagacagaaucuuacucugucacccaggcugaagugcagucaucguaguucacuguaacuuugagcuccugggcccaagcuaccguucuacuuuagccuucuaaguagcuaggacuacaagcaugcaccaccacaccugacuaauuuauuuauuuauuuauuuauuuuauuuuuuauuuuuauuuuuuugagacagaguuuugcucucaucacccagacuagaguacaaugucgugaucucggcucacugcaaccuccgccucccagguucaagccauucuccugccucagccucccaaauagcugggauuacaggcauacaccaccacaccucgcuaauuuuuuguauuuuuaguagaaucaggguuucaccauguuggccaggauggucuagaacuccuggccucaagugauccaucugccucggccucccaaagugcugggauuacaggagugagccaccacacccagccaccugacuaaaaaaaauuuuuuuuguagagacagucuugauauguugcccaggcuagucucaaacuucuggccucaagcagucuucccaucucagucucccaaagugcugagauuacaggcaugagccauugugcuggggguauuuuuacauuuuuaaauuuugauuucugauacaguaaauacuagcagauaccacuuacgugaaugcuauuacuucaggagucacaagaucaauuucauuaacacaaugucaaaauuucgaguucuaauuuaucuuugcucuaaauuuuuaacuuuuaacuuaucuuugcccuaauaccaaaggccauacuccacaguuuugucaaaguauggaggcaugaccuaguugauucuuagaagucuuaagucuuagaauagagaaauguuucccauuuuuuuugcaguucaccuaauguugccaaaaaauuucauguuggacauuugcguucuaccaucauagguaaguguuuaguuucacauaaaaugcuaaacguuccuuugaggaaguauuugauaguucaauuuaauguuuuaaugcuuaaauaacaaaauagcaaaaaacaaaaaguuuaaauuuauaugagccuccugccaauucaggaaauggaugacauugguuacacuguuuuguggaaacacaaaauugauuucaaaaccaaaagauucacugagaaacuaauuuuaacugcuauauauguuaugauuuuuaacuuucuaaaaauaaguauaaauauggggaagaccugaaagaugcaaaaguaaaaauaguuauguggggauguauaaccuuucagauuuuuuuguucauuuauuuugugguuuuuuugucacuuaggcuggagugcaguggcgcaaucuuggcucacugcaaccucugccucccagguucaaaggauucuccugccucagccucccaaguugcugggauuacaggcgugcgccaccaugccuggcuaauuuuuguauuuuuaguagagacaagguuucuacuuaauaacaauuuuugucaaaauuaaaaaacacgaauaacaauuuuuguuaaaaauucaccucggucaugugagcacuuaguggaauguucaagacuggaaguuaaaacaagacuauuucuggccgggcauaguggcucacaccuguaauccuagcacuuugggaggcugaagcaggcagaucauuuaaggucaggaguucgcgaccagccuggccaacauggugaaaccccaucuuuacuaaaaauacaaaaaaucagcuggugugauggugugcaccuguaaucccagcuacucaggaggcugaggugggagaaucgcuugaacccgggaggcagagguugcagugagcugcgcaccacugcacuacagccugggugacagagcuagguucugucucaaaaaaaaaaagaaaagaaaaaagacuauuucaauaaauagagauuacuauauaguacuucauaguuguaaugcuucaguguauaauauacuuacgauuuucauuuaacacaugucauacagcaggucaauuuaaaaacugaaauuaaaauuauauaauauuagaauuggaagggacuuuggaguuuaucucaaucuaaucucacuuccaauguagaaaucuguccuauugcaugcuuaagagaaaguuguuuaaccuguacuucaauacuuuucagaauuggagaaauuaguacuuguggcauagauuguugugcggucagcucuuacuguucuugagcagcauuuuaagagaagaaaugacaggacuugaugaaaaaguauaagaaauauacaguauaaaaaaagcuauaugaguaagucaaaaguauaggagugaguaaaugauggguaggguaugauaaaguuguuuucacaguugagggaaauauuuggaccaguuagagauaauauuugagaacuuaacaugcugugucuucauguauuauaucauucaauuuuauaacagcccaguuugguaaauacuguuaacucugguuuauggaugaagaaauucagcagccaaaaguaacuuucccaacaucccaaaguauuguagccaggauuugaaauuaggcagucuaauuccagaagucuagguucagacauuuaauuggauuugugauauaacaaggggcuaagaaaaaaauaggaauaugccaucugugugccagcuggaaaaacagguuccaguugcagggacuuuauagauugggaaagucuacaacuagggaagcuggaaaagaagauagcugcaguaguuuaagucagguauggauauuggugaggguuuauuugcaaaaaacuaaauccauucuuaguaaaggcagaagaggauuuauuguagaauauugaaugguuuacaaaguuguuggagggcugcagaagcuuuggauuaagcugacauaaauaacucccaaaacugcacuauggaaccuugucaucaagggagcuccugccucuucugcaaucccuugcacugcucuagaaccaugcugccacugccauggucaagaaaaugccacuacuccugccaugccaucuagaauucauacaggcauaagaggcagccccauauacuuucaauuucuuugguggccaucauggaauacuaggaccucuguucauggugucacaaaaaaacacagcccccaccacugugcuugucauaaaaaaauagaaguagcucaccuuccaaaucuuacagacacuguaucugauugcccaaaccuagaagacuacuggaacucuaaccacaggagacucugggaauuguacuuuuuacauuuucagccucggcaguagaugagggcacccaagaaggaaagcagaauagauguugagugugaaaccagcaucagcaguaugggaaagugaaggccuuagauuauuacaugcuguuagggagcaggcaugcagaggguagauguuagugauuaaaaggagauagaaugagcuauuuagaaaacacaaaaagggaaaauacaacagugaggcuucgguucuuagggcacagacaaauauauuucuuguuaauuacugggauuuuuuuuuuuucucuucuugaaauugacuagaauagcaguuacucuaacauguccucaaauccuauuaauaauguaggugaaaguucuguuacugugaaaaugugagauucuuuggaauaacugcccuacaaguaauuucuuacucccuuuccauaacacaugaaaacacaaugaugaauguuuuaguaaaaaacauugaguugguaaauuuagugaaaagaauuuucuacuuauguuugauaauagagaaguacaugguucuuaugucaaaaaauggauaacaagaaugagaaacuauauacuuuauugauuacuaggaaauuuuauagcaaaucucaaagaagcuuuaggacaucaaguaauaagaauaaauuaccuuggcgauuggggcaugcaguuugguaaguacacuugagauuuuauuuuucauuucauuguaaaauucaauuuguaaaaacuuugaucuggacagaauauaggcagaaucccauuggaugaaguaguauguccuaccuauuuuuuuuuuuuuuucccuaauggcucuuuugcauaaaaucuucuauuuauuugaguaauucucaccacacaaguuaccuuuggggaagguaacuucacacauucaaagaagaccugggccaggcaugguauuucacuccuguaaugccaacacuuugggaggccaaggcggguggaucacuugagcccaggaguuugagaccagccugagcaacauggcgaaauccugucuuuacaaaauacaaaaaaauuagcuagacaugguggcaugcccuuguaguccuagcuacucggaagccugagguaagaggaucguguuagcccaggaggucaagacugcaguccacugcacccagcgugguugacagagcaggaccuugucucaagaaagaaaccccagaguaagaccugauguaggcuuuugugguuuuaauaaagagaaauugccuacuuuuauuaguuaaauguagaagugaguauacagggaagaaguaagucuaacuguguacaccuuucucaaccacagcccugccauuuuucaaucuaaggacauccagccucccugggccauucuacaugaaguaggauccccuguuauaccauagccaguggcccagaagauaagcaaagggugauacuuugucuuccccuuuaacuguacagugagagguaggaguggguuggggaaaguccaaaaggaaaagagaaaaagagaggagugcgauccaaacaguuaaguacuaccacaaauuaucucucauauaaugaguuuacucagaaccauuccuaauucauguaaaccaguaaucaaggugugagagggcaagguaaaugaaguuguuaugguagugaaggacgggguagauugugaaauacaaacuuaaaaaaaaaucuguuguuaccaccauguguauuuuaagaaacagcucuaguaucauuucuauaaagcauucucugacacaaagacacacccuugcccaucuucucacaucaccaauuuccugguauccagcucuacucaaguaugguaaggcuccugucuuauguucuuauuugugugcuucccugcccuacuaggcauguuccuugaaggcguggacuuaacuuuuauaucuacagugcuugucacauaagaagcacucuaagaagaguagaccuugaaccuguuaacagaaccauuacuguucacuauggaagaaucagaauacaugcccugcauuuaaaaaaucaaccuguaguucacaacagcugguagucagagggcuaggcccuaggcucaauagucagacuuaauagauagcacugauuuuuauuaauuugaccgauuuagacauuucagaggcauuagcaaauaugugauuaggguauucauuaaauuuuagcugcaggauuucguuacagcaguuuuuucucuaaaggacugcugugguuaaugaucugucagcauuuccauuauaaccaucacuguuaaagaauauuuuugcuguuucagcuaucuccauuugaaaguuggcaguuucuaagcacagaauuaguuuuugaaaauguauuaggcugaauguuaaauggaauuggcccuuacuuuucccauuuuuguguuuuggaacacugagcaucuuuccacacacugcuccaaccacccugaauuauaaucacauuugcucuugcuugaaaguuaauagagcuucagucauccuucuuguuccuaaguuccaaaguauuguauauuccuguguccuguguucagucacgucccacuuucuacugaaccuugaauagaaaaauguguaucaguaaagcccuuuagaucugaagcuugguaauugauauagaaauaaauuguuuuuuuuuuuucuuucugagauggagucucgcucugucacccaggcuggcgugcaguggcaccaucucagcucgcugcaaccuccgccucccagguucaagugauucuccugccucagccucccgaguagcugggaucauaggcaugcaccaccaugccaggcuaauuuuguauuuuuaguagagacaggguuuugccauguucaucaggcuggugucaaacuccugaccucaagugauucgcccaccucggccucccaaagugcugggauuacaggagugagucaucacccccggccaauaaguugguuuuguuuuuuugcuuuuguuuuuguuuuuguuuuuguuuuuguuuugagacagaguuugcucuuguugcccaggcuggaaugcaauggcgggaucucggcucaccgcaaccuccgccucccagguucaagcgauucuccugucucacuuucccugguagcuggguuuacaggcaugugccaccaugccaggcuaauuuuguauuuuuuuaguagagacaggguuucuccuuguuggucaggcuggucucaaaugccugaccucaggugauccacccaccuuggccucccaaugugcugggauuacaggcaugagccacugcauccagccauaaauugguuuuuaaaguaauaaaacuaauguuccucuuuuuuuuuuuuauuauuuuauacuuuaaguucuaggguacaugugcacaacgugcagguuuguuacauauguauacaugugccauguuggugugcugcacccauuaacucgucauuuaacauuagguauaucuccuaaugcuaucccucccgccucccaacuaauauuccucuuaacccaggcugcauauauccuuucuaacggaaguuaugaucaucuuuaugcagaauaucuugagucuacauacucccagacuguacuaggaauuuugauauguaguuuaccaaccucaguuuuugguguuuggguuuuuuuuuuucuuuuuuuuuuuagguucaaauuaacacuaucccugaacucugaauuuaucaucaaagacuaaaaaauuauacacagucaaauuaaagauuuuuguugcuuggcuaccuugaaccugagaaauaaucaaggauguuccaaguuuuaccuugcuguuuuccuccaauuuuguuuaagaacuaauauaacaacaaaaccauugcugucuucgcauuaaugccuacaaguuuaaaaagaaaguuugaaaacaguuuccaucaguuuuuuuaauaaauuuugagugccuagugucuagcuucaugaugucacuucaacagaguagaugcuuaauaaauguuuauuuuuuaaugucugcuagggugguguucagcacuguuaguacaaagauaaauuaguccuagacuuuaccuuugaugagcucauaaccuauugguuucugugagcuuaauuucagugaucuauucaguauguugaauuuaugauuaaauauauugaauuugacuugugucagauuauggggucauagaagguaaaaguguguuuuguaauacuucucaggauacauaauaugacagguuggucuuuuuauagaauuauaccuauucccugucaugccuauucucuguuguucaacuuuauaauuuuucauuuacggauuaucaugguaggucuucugggaacuggcuuccagcuguuuggcuaugaggaaaaacugcaguccaauccucuacagcaucucuuugaaguaaguuggcaagaaaacauuucaaaaauuuuucagaguacuauguagcuuaguaacauguuuuuaaucccagagguuuauuuuucuuuauuuugagacagggucucgcucuguugcccaggcuggagugcaguggugcaaucucagcucacugcaaccucugccuccuggguucaagcaauucucaugccucagccucccaaguagcugggacuacaggcguaugccaccauaaccagcuaauuuuuguauuuuuaguagagaugggguuucuccauguuggccaggcaggucucaaacuccugaccucagguaauccacccaccuuggccucccaaagugcugggauuacaggcgugagucaccacgcccagccuccagagguuuaaaaaauauguucuuuaaaacaaggaaccaaaacauaauugaaaauguugcuuuuggcugggcacagugacucacacuugcaucccagcacuuugggaggccaaggcaggaggauugcuugacaccaggaguucaagaccaguuugggcaacauaaugagaccuggccucuauaaaguaauaaaauauuagccaggcacaguggccugugccuguaguccuaguuacuggggagacugaggcaggaggauugcuagaccccagggguucaaggcuacagugagcuguagucaugacacugcacuccagccuggacaacagagcaagacccugucucagaaagaaagaaaauguugcacuuauuuuacuagguuauuuuuauuuccuaaucuaagauuuuuuaaauguccuuuuaguugauuugggacaguauuucuucagguauagaaucuuuuagaauaaacaugcaagauaauuauucgacacagaaauuucucaauuuucugucaguuaauauguacugcagcuuuuuucgugguaauaacuguauaucaauuagacuugaaaaaugaguauuuuuguucuuuuucuggugugggggacagcaugucuauuucucucugaaauugugugugcuuuuuccauuuacaucuuucaccuccuuuuccuggcuuuuguccaaggugaauuucugccuacucuauuucauuuagucccuuggauacuuugcuucuuuaucuucaguucuuccugaaguuuauuaauaaagcccuuccuguccaaacaaucuccagggauguguuuccuuuuuguugucccuguuguuaucucugccguuucugggccucacaguggaaacgcggauacgaagucagccauauuggugacagaucaggggaucagacuaaacauguucugcuugugugugagaaaaagcacuugcaaaaauaaugcuuuacuucuccagcuuaagccacagagggugcuucaucauuuuccuguuaacgugauuuuuuccugcagcuggcuuugcaguuaaauugaacaaaaacauauuccaguuuuuuuuuuuuuuuuuuuuuuuugaggagucucacacuguugccuaggcugaagugcaauggugugaucuuggcucacugcaaccucugccuccuggguugaagcaguucugccucagccucacgaguagcugggauuacaggugcccagcaccacacccagcuauuuuuuuuuuguauuuuuuaguagagacaggguuucacuauguuguccaggcuggucuugaacuccugaucucaugaucagcccaccucggccucccaaagugcugggauuacagguguuagccaccgcaccuagcccauauuccaguucuuaaagaccuuuaaagguuugccauuuuccccugaguccaugccaacacugcacucuaaaugacugcauuuugauuuaucauguuaaccaaaagauuucuucucucuuucccauuaagaguuuuauugauagggaggaauauaaaaauuaauaauucuucaugguugucuauaaaguauguucccuuagugccuggaguuuuuacuguauuuauuuauuuauuuuuacacuugaauaauuuuaccucaagcuuaaucuuucaugagauccaggcccacagauguuauauguaaaaauguuuauuuagaaauagcaugcuuguuccccggugccacaaagaaauagcacuugaacauaaauuuaauuaucucagcaaggccauuuuuacucucugcagaaaggguacacucgccagcaguuuugccacgagaguauaccgaacaaaggagacagggucauuuauaacuugacacauccaccuuacugcugugucugguuuccauuggcuggaacggaaccucacauucuguauuugucccgauuggcuagcaacuuuaacuuuucaaaagaggcaaaggcaggggagaacaaaggaagcaggaaguaacuugugaaaugcugagaaagguaaaaacaccuccaaauaaggaagaggaacaggcugucaccuaaugcuugcuuggaccaauguaagcaugccaaggcagauauuuaggcuaaauuguaggagcuaagaacacaaaguauauugauuucuuuauuacggcuagcagauauuuaaggauguuaugacaggucuuugaauaaauuuuacuucuaagagaagucacuauuuguccuuaauuagacggggaggaaagugucuuugaaggggaaccucuacuucacuuuuuacacagagacaccccauguugcagaaaauacaaauaccugcuuggagaccuugugucauugauuuagagugcagcaugacaugugagaguuauucuuuuuaucuuucuucuuccccaccucaaaaguuuuuauuuaaucuugcaaauaguaaaccuuugucuucuaugacauuuuauuuuuaucuuuuauuuauuuauuuauucauuuauuuauuuauuuauuuaugugagacaggaucuuacucuguugcccagccuggaauauaguggcacaaucacggcucacugcagccuugaccucccaggcucaggugauucucccaccucagcaacccaaguagcuaggacuacaagcacacaccagcacacccaacuaauuuuuugauuuuuuauagagacagggucucccuauguugcccaggcuggucucaaacucuugggcucaaacaguccuccugccucaaacucccaaagugcugggauuauaggugugagccaccacacccaaccuauuuuuuaauuuuuuaaauaacaauagggucuugcuaugcuguccaggcaggucucaaacuccuagcuucaagugauccucccaccucagccucccaaaguauuggaauuacagacaugagccacugugccuagccauauauagguguagguuuuguggguuuuuuuguggaggugaagucucacuguugcugaggcuguacaauauuuuaaauauuucaggggaaucugucuucaaacuccacagaaaccuaagaauauauuucuuucuaugcaguuuaauauaauuuccugccuuuagagacucaaaaauaguggaagaucaacaucuauguuagagguuauuuacugauggguacacauauggaaggaauaagggcaauaagguacuucugugaauaacuaaaaagucgaauaauaaugguguugcuuucauuaguguucuuuugccgaauagauucacugggaaacugcauuuaaagacaaaagaaggcaagauacacccacuuugcuauuuguaauagacgacaagaccauuagaguauucaguugcucuuuuccuucuccuuuugcaggacagaaaauaugcaaagccuaaaauggcagccuacagguuauuauauaugcaaauuuuauagacucuguuuucauuuuaaaauuacauuugucacuuuggauuacuuucaaaaacaacuguuagcauaaaugaggaauuuuuuugagcuuuaagcaaauguugauguuauucuguuucuaaaagaaaaucugaaugucaacaacucaauuuauuuaauaauugaaagaugccuuugcuugcccugcaaugucacaaauagcguaggugguaauacagagacucugccccaucguuauuucuggucaccagaaaggugaccagaaagucagagaucgugauucuaugcuuggaaagugcuugguguauugguaaauaauguuggcugauuuauucgaaggaaaacuuuaagauaaucugcauuuacucuuucuuauuugugaaaaucuguuuucucaaagcuuugauggaacccuuguuuuuuuuccauaucaaguuguaguuaguagugagcucuuugagaggaaggaccaugucuuccuuaccuuccuuauccacaacccuaaauauuauggcuugcaguaaaugccugaaugaauuugcuuuuauaguucucuuuugcccccuuuucuaauuauauauaauuuguggaauauaaaauguauuguuuguccaggaaauaaguaacuauuauaggauacacuaauuaccauuugucagaauuuaacuuacuuuguuaacauaguuuacugcagaggaaaccacaggccaaacccaggauuccggcacagguagucuggcuccugagugcucuaugcagugaauguccccacacccccacuauagaauggcuuuaugaaccauugauuuccauugguuuaauuauguacauagaauuuuccuuucuuucaucccuugaguugcuauaccagggacacaauuaguaguuuaguuuuggcacuuucaaccuucuggcauauuuguuuugaauuuggcauaggccauccaguagcagauuuuauggccugccuuccucuaaauugaacuaugaucaguauucucuaaauugcacuauaaucaguauuaguauauucaguuucucagcuagcuuggaaaugauauuguaugauaguuucagaauuucuuugaugaaaauauuuaacacccacagucauuuauugcauuuccauuuuggugcauaugcuucacuagugguuuuucucuguaccuuauagcauucuuuucccaugacaucuagcuguuuuguacgugggaccuaggauuuuguuggcaagcauuugaaacuuuuucuuuaauuauucuaauuugguuuuuuugguuacaaaacagggaaguaguuuuguuauaguuccucuucccuugugaauuggcuguuaaauaacuaauauauuuuuuuuauuuagaauucacauuagugauucaggaaaacauuugcaauaagcuuuagacaauauaucaaaaagccuuuccacuuauauugaaaaguaauuucuuuuuuuuucuuucuuuuuuuuuuuuucgugauggggucuugcccuguugcccaggcuggagugcaguggcgugaucucagcucacugcaaccucugccucccggguucaaaugauucuccugccucagccuccugaguagcugggauuacaggugugcacuaccacgcccagcuaauuuuuuuguauuuuugcuagagacgggguuucaccauguuggccaggcuggucucaaacuccugaccuugugauccgcccaccuuggccucacaaaaugcugggauuacaggugugagccaccacgcccaggcaaaaaguaauuucuuaugguaaaaguuaacaaguguuaaaucugaaucauggauaugagggugucaucauuuacuuuuaccuauuuaaauaauacuuuuaaagguaacuuaucaggcuuccuuuuagauuuaaauuauuugaauagacuuuauuaucuaacaguaucucuaagcauauuaaccuuuuuuuuugcuauagaagguuuuauuaauagaacuugacucauugcauauugccuauuaauauggcuuuuguaaccauagccauucuuaugaaauguaagggcagccucuuauaagagauaaauaucaugccaauaaaauauggauuagccuguauccuagcacugacauuaaaaaagguuacauaggccaggugcaguggcucacaccugcaauccuagcacuuugggaggcugaggcagguggauugccugagcucaaaaguuugagaccagccucagcaacguggcaaaacugcaucucuacuuaaaaaaaaaaauacaaauaauuagcugggcauggugaugcaugcuuguaaucccagcuacucaggaggccgagggacgagaaucgcuugaacccaggagguggagguugcagugagcugagaucacaccacugcacuccagccugggcaacagagcgagacucugucucaaaaaaaaaaaaaaaaaacaaaacaguuacauaauaacacaaauaguauaaaaauuucuuuaaguucaaaauggccuccaaagguucuauuucaguauuucuaccuugccccuuucuagcaggauuuaagguaauuacagugaugggcauuuaauaaaagaaaaauagugagggguuaguguaucacuagauaauuuacguaauaguuuugacccugagcuuccccauaucaguaggcaaaaaaaaauuuuuuuaaauaggacaagaucaaagcaccgauucaaugagugauaauguuuacuugcucucauuuuuaaaaacauggaauuaguaucuauuccucaagacacaauguuuuuccuaacuuuagagucuccaauuucucaacuuuaaguaaauaauucaagacuaaauucucaucauauguagggauauuuaugcaguugaaguuuuuauuuuaugaaaaauugcguucaagauuucaucauuguuuuaaguuacauuucuuuuuccagggaauguuacuguuauggcuaguaugaauuuuguuccuuaauaacauuuauauguaagaaauaguuuuuaaaugauaagaaaaucugauuccagcuaucacuuguaagagucaguguaagucauugaauuucccaccuacuaaaucaugcaaaguuccccaggcucuuaugugucuccuaggacaguccuagaggacucuucuugucuucagugcacacuggucucuuacauguuuaguaucccagccugugugaugcuuggaggcaugcagcucuucuugugugacaaacauuagcuggugguccuugcccuguccacaggucuagagacaagaucgcuauguagacacaccgugaaccauuucccacugugggccugcaccaccccaggggcuuccuagcuucugcucuucuggaagucuuccccaucuccuccccauuccagguaauucuccuuuccucuauccuggcaguuucuccacuuggccauugcucccugcugucccuucccaacacugcuugcuuuucuacucucucucugcuuauuugggacagcacuacagugugucauuguccucuuagucuuccucuuagaaugaguuuugaaauaccuagcaagaacaaaguacacauuaauagcugaguaaauaucugacaccauugaaaugugcaaaaaauacuuuuaucagcaugagaaauguuaacauuuauuaggugcuuguguguggugcucuacaaggaguuaauaauuaucaucccugaauaaagauguaagauauaaugaaugugguuauguauauacauagaguaaaaguaggagauucuaaauaugaaaagauuaauggaaggugaaauacaguuuauauccuacuacuaauguauuaaggaggagaaauuugauaacucaugaaauagcucaaguuaguuauuuuuuuaccuaccacauuuuggcuuuauuauuaacuguuugcaguauugauacauucaauuuuaauuauauaaacacauuugaaugucuuuaauuuuucauuucauguucggaaucaacuagcagcuaagaaauuucugaucagugaaacagcauuaaacauaaugaaguuguucaaauuauaaucaugaauauuuuuacauguucuuuucuaaacuagguaaaaauucagugcauuuuaagaugacauaaauauaugaaaaaagggucugugguuucuaaguuuugcuaaccauccuuagcaguuauucucaguauuucuaagauaagcauggcuagaagugggguuagagccccacaucaaggaguuaaacugugcccauguggcuaaugguauucuaggaucaaauuuaaagggauaagaaaggcuuaucauacuacuuuuaauuuucaugcuuaguucuuuauauuugggcagaucagcccaagagcuuacuguaauuaucugaguuaaauucaaaauaaaauguuacgcuauuuggcaggcccaacaucuagaaauagugaaaagggaauguuaauuuuuuuuaaggaagucugagacauuuaguuuauucccuaaaggaaacacaacugguuuuuguguuuucuucuaagagaaaaauuguguuuccauccucaaaaacuuuacuaagccaugcugccuuauuaugaagcccaaauuuaaaauugccuuuuuaucucuuugugucuaaauuuagccuuaaaaggaagauaucuucaaaaugcguacuuuccaaggguuaauuaaaaagguacaugguaacuguuuaguuuuauauugugcauuuauagguauauugggaagugcuuauuaaagcucuucucuuugauagugucaguugauuuucacuaauguuuguuuuauaaguacauauugcggaaauacuaagaauauucacguuuuaagggcuuuuuguuuuaauuauuucuauuuuuuaagaaagagaagauucuggugaaguuuuuucuaaaauagucauaucauaaugcauaauagauuuuuaaauguuugguuauuugaguuuaaaguccuagauuuaaaaacaaagaaacuucacccugaagaaaggcuuuaugaaaaaaaaaagaaacuaaacucuuuugugaaaauaaagacauuuugcauguguuugcuuauaacuugugugcacauguauguaugugugugagauagaaucagaaaccacuugugaauauauauuuauguuuuuaacaucuguauacuggaccguuaagcaguugucaauggcugugucauucaaaagucaagaaguccgcaguuuacuaucuuauggggacccuuuuuguuuucccauacuuuaccaaagucuucuuuguuuucuaacugacauuguauguguuguucuggacuuacuaauaggacuacauaaacaucaccuuuuuaugaugugucagguauccuaagaccacuccuccccccgauucugugauucacgcagaggacucacagaacucagcauagucuuacuuguggcuaugauuuauuacagugaagggauacaaagcaaaaucagcagagggaaaaggcauauaugggguaaaguccagaggaaaccaggcuuuccagacucccaaauuuucccaguggagucacacaaggugcacauacuuccagcagcaaauuaugagaauacaugugaaauguccacuggcaaaaguucauuagauacccuguguccaagguuuuuauugagaguuggucauguagguacccucugcuuagaauguccuaaaucccaaacucccagaaggaaagcagaaguucagccuaagcuguacuguuugcauccacaguguaggcacaaugaccacuuuuaucaguuaaguugguggagacauucccaaaaaucuaaguuaauagaugccagccaguggccaaccuugcaagcaggauguuuuaaauauaacaguaucagaccugcuaguuaacucuuuucuagggggaaaaaaaaagguaauuuuaacuuuauuuagcaguauuuauuuauuuaagucugucauuccaguaauuaacauagaucaucuaugaaaggugaaacguuuuuaccuugagagauguuuaaugcccugucccauuuguugguaguaucuaguggguauaagccaauguguccuccagcaauaaaaucauuuuuuccuauccaaauacugcuguccggauguuuugauaauaacauuguaaggguuuagaagccuuauuuuuucauaguuuauucaccaauuuuuauugcuuucaugagacuuuaauagcuuucuggaaauaauauaguaaaguuaucauugauguuucaaccugcaggugaguuacaauuuguaaauauuuguccauauguauaacuucaguacuacuugaacuauaauauuaauauuuuaaugucauuuauuaacauuauauuuuggagacugaaaaaugauugaaacuacauugggaacacagauuccuagagcuggaagaguaagccugagcccuuaauaaaccaucaacuccacccuaguucuuggcugaguauggaacuaaaccagcuaagacaggugaugcaaaauaaaacuccagaagaggugcucaacacaguuuuuaggaucuuaaguuuagaguauaauuauacuaacuauccaaaagcaguccuuuuuaccaagaucaccuauuguauuggucuuuacacaguaagcuauuuagagaacaguuuuaaaaucuuugauuaaaacaaaugcuaaaucauccguuagcuguuucuuugccagaucgagccauccuacuuuauucaaccuuuuucagcgaaguuacaggauaauaauauggcauuuugaaaaauaacagaagaaaugccaguuuagucuuaaauagguauucuuacccuggggaucuguggauuuaguuggaaagaaaaaauuauacuuuguuuucccugaccucucucggaaauugaguauuuuccuccauuacuauaucacaaauuaauuuuuggcuauuugguuauuucagaguaauucuuuucuuuguaacccuguguauuuuauuuuaugaauuuagaaacauuuugagaaggggucuauaugcuucaccaggggcccauggcaaaaaagaaaaaguuacacucuguaauguacccaacuuggaaaauuuuaaaugagaauucucagaaugugcuuuuuuugcuuucuuuccguguuagagauaacaaugaccuguuauguacuucauuuaauguacuauuguacuuuuagguuuauguacaaguuaauaaagaagcagcagaugauaaaaguguagcaaaagcagcacaggaguucuuccaacgauuggaacugggcgaugugcaagcacuuucacuguggcaaaaauuucgggacuugagcauugaagaguacauucggguuuacaagguauugguugacccucccuucugcuuucccaugaugcagugcagcucucggcuguuaccugcauaguaaaguugcguguuaagcuuguguuuuaaaaauagauuuguaggugaauuuaaaauuaagacucaaauuuuuuuuuugggcugaaagaacugcaaaauaauccugaagcagugucaggugauauucucauacuucauuuuuaucugacuuuucuguucuagcauuccuucacuuuuucauauuuauuuuuuguucuuucacuuccuuaggcugguaugugaugguuaauaaacugauucauuuaauaaacauuugguggguaggggauaauacacaacagcgaauagaagaggaaaacccuuguucucgcagaccuuauauucuagccuagagacagcacaaacuaaacaaauuaaagauaaagcaagaaacaacuauguuuuuauuaagugguucuagaugcuagcuggggagaucagguauggagucuucagguggaacgacaguuuuguaaagaagcccgugugacuggaguaaguaagcaagaugaacgacaggagaagguugaagagcuaguagcauauggggcaugauucuaggauuucucuagggcuguccagugcuuuuugugguaaugggaaucuucuguaucuguggccgucuccuuaaguagccaccaaccacauguggcuugaagggugaauagugugacagaagagcuaaauucucaauuuugcuuaauuccaguuuaacaguauagauugucacuugggccuagugauuacuguauugcacagcacaguaccauugugaggacuugacugguauaguggaaacuauuaggagguuugagaagaggagugauuuuuuuuuuuuuuuaaacaaaaauaaugagguccucgccaucuugcccaggcugggcuugaacuccugggcgcaagugauccuccugccucagccucccaaagugcugggauuaugggcaugagccaccacacucagcccuugauuuaauuuuuauuguguucaugugugugacaggugguagagcauccuuaauuuugccuuaggguaagaauaggagauucaauuaacauuucuuugucuuuuuguuucugaacucuuuuagcgucugggaguauauuuugaugaauauucaggagaaucauuuuaucgugaaaaaucucaagaggucuuaaaguugcuggagaguaaaggacuccuacugaaaacaauguaugaucagguuacuauucuucaguaaaauuauuuguucuuugaaauuguuauugauguauccuuugaguaaggacaacagaaugcaaugugcagcuuucuugggauuuuuuauagugcuuuuuccuguucagaguacuuucccacauucuguauuuugcuuccauagcaaaagcuguucaggcuuggagaaaggauguuacuuguuuuuuauaaggcugggaacugaagcacagaaaauauaagugaccuacuuaaggucauauaaccugauaaugauauaacugaaaaaaggaaauauaucuuauuaucuucugauucaguuuuaccuuuuaaaagaaaucccugccuuuucaaaaaauauuuaaggcagugugugaagauaaguauacuauaacaggcuuauaaaugaggaaaaugaugaaaacaggaaguaggggcaggaaaaguaauaugaagucagagaugguguuagcauaucccuccuagaauucuguuuucuugcuuaugucagaguuuuuucuuuaaaaaaaaaguuguaauugaugaaugacauauuguauauauuuaugguguacaacaugauuugauauaugcacacugugaaauguugaaaucaaguuaauuaacauacccaucaccuuacguacuuaccuaugaugagaacauuuaaaaucuacccuguuagcaguuuucaaguguacuaugcauuauuguuaauuauacucacaaugcuguacaauagaucuccagaacuuacuccuccuguuuaccuaaaacuuuguagccuuuaaccaacaucuccccauucccugcccuugguaaccuccauucuacuucucugcuucuaugauuauaauuuuuuagauuccacaugugagacuauacaguauuuguuuucugugcaucguuuauuucacugagcauaauguccuuucaguuuauccauguugucacaaaugacaggauuuccuuuuauuuuaaggcugaauauuaccuguuguauauuuuaaagucuacucaucuauuaagguugauucacaucuuggcuauugugaauaauguuacaauaaccaugguagggcagauuucacuuggacauacugauuucauuuucugugguuguauacccagaugugaguuugcuggaucauauauauggauguucuguuuucuguuuuuugaggaaccuccacauuguuuuccauaauggcuauaccaacauucccaccaacaguguacaaggguucccuuuuauccacaucauugccaacauuuaucuuuuuuuuuuuuuuuuuuguuauaaaagccaucuuaacaagugugaagaaauaucuuauuguggauugugguuuuaauuuuguauuucccugaugauuagugauguucagcaccuuuucauauacuuguuagccuuuuguaugccuuccuuggagaaaugucuauacgggucuuuggcccacuuuuuuuuuuuuuuuauguucccaggcaaauguacaggaugugcagauuuguuacguagguuaaugugugccauggugauuugcugcaccuggcaacccaucaccuaaguguuaagcccagcauccauuaccuauuuuuccugaugcucucccgccuccccaucccccgacaggccccagucuguguucuuuccuuccuugugucucuguguucacauuguucaacucccacuuauaagugagaauaugugguauuugguuuucuguuccugcauuaguuuacugagaauaauggcuucuuuggcccacuuuuuaguuggguuuuuuuuugguaguggugguguugguuugguuuaguuuuuuuguuguuguuuuuccauugaguugaguuccuuauauauuuucacauuaaccccuuaccagauacauguuuuccacguauuuucuuuaauccucuagguugucucuucauuuuguugauuguuuucuuugcugugcagaagcuuuuuuaguuuuaugcaaucccaucuguguauuuuuugcuuuuguugccuaugcuuugaggacuagcuccaagaaaucuuugccaaggcuucaguguuuuccucuaauaguuuuacagcucaggucuuagauuugucuuuaauccacuuugaauugacuuuuguacauggugagagauagggaucuaguuuuauucuucugcauauggauaugcaguuuucucagugucauuuauugaagagacuguccuuuccuuuuuauuuuuuugagacggggucucacuguaucaccaggcuggagugcaguggcaugaucuuggcucagugcaaccacugccucccagguucaagcgaaucuccugccucagccucccaaguagcugggauuacaagcgcgugccaccauacccagcuaauuuuuguauuuucaguagagacgggguuucaccguguuggccaggaugaucucaaucuccugaccuccugaucuacccgcuuuggccucccaaagugcuaggauuacaggcgugagccacugugccuggccgagacugucccuuucuuauuguguuauuuuggcaccuuugucaaaaaucaguugaccuggcugggcaugguggcucacgccuguaaucccagcacuuugggaggcugaggugggcggaucaccugagguugggaguucaagaccagccugaccaacauggagaaaccccaucucuacuaaaaauacaaaaauuagcugggugugguggggcaugccuguaaucccagcuacuugggaggcucaggcaggagaaucacuugaacccgggaggcagagguugcggugagccacgauugagccauugcacuccaaccugggcaauaagagugaaauuccaucucaaaaaaaaaaaaaaauucaguugaccauaaaugugugaauuuguaucuaggcucucuauucuauuccauugguccuauguuuuugucuaguaugaugcuguuuugauuacuauaguuuguaguagauguugagauuagguagugcgaugccucuagcuuuguuuuuuuuuuuaagacagggucuggcuuuguuauccaggcuguagugcauuggugcuuucuuggcucacuacaaccuccaccuccagguucaaccuauucuccugccuuagccucccaaguagcugggauuacaggcaugugccaccacacccagcuaauuuuuguauuucuuaguagagauggaguuucaccauguugcccaggcuggucuugaacucuuggcuucaagugauccacuugccuuggccccccaaagugcugggauuauagacgugagccaccacagcuggcccaacuuuauucuuuuugcucaauauugcuuuggguauuuggagguuuuuugugguuccauaugaauuuuaugauugauuuuucuauuucugugaaaaaugucauuggaauuuugguagggauugcauugaaucuguagauugcuuuuggugguguggacauuuuuuaaauauugauuuuuccaauccauuaauacaggauaucuuuccauuuaucuguguuuugauuucuuucaucaguguuauauaguuuucaguguacagauauuuuaccuccuugguuaaauuuauuccuauuuuaauuuuguugauguuauuauaaaugggauuuuuuuuuaaauuucuuuuucagauaguuuguuguuguguauagaaaugcuacugauauuuggcugggcgcgguggcucacgccuguaaucccagcacuuugggaggccgggggcgcggaucacaugaggucaggaguucgagaccagccuggccaacauagugaaaaccugucucuacuaaaaacacaaaaauuaacuggacgugguggcgcgcgccuaauuccagcuacuugagaggcugaagcaggagaauugcuugaacccaggaggcagagguugcaaugagcugagaucgugccacugcaccacuccagccugggcaacaaagugagacuccgucucaaaaaaaaaaaaaagaaaaaaaggcuacugauuuucauauguugauuuucuauacugcaacuuuaugaaauucauuuauucuaacaguuuuuggcggauucuucaggguuuuccauuuauaagaucauauucagaguuuucuauuuauaagaucauauugaaaaaaaaagauuauguugccugcagagacaauuuaacuucuuuuccaauuuggaugccuuuaauuuuguuucuugccuaauuguuuucuaauuuagcuuuuagcuuccugucagcuaaacagagaaauagcagugaaagaagcccagaccucuauaauguagaggcaaaccaauugcuuaagagacaugucacuuuucauaguaccaaagcaaacuuucuccugucauauuuguaaggaagaugugaaacauaguuaauagcauccucgguaauguccuuaaggaaaauuuuuagauugucauauacagauuccaaauuuuggucauacaggaaagacaaaaaucuguaguuuuaauacuuggguacuuuguggcauguuaaaaauuaucccaauauugaauguuauaauaccaugaauuagaaggagaaugugugacauuucauaguuacaaugcagcugcaucucauuuuucaacuggguauauuaaagaauuuaucucugaguaccuuauccagagcuacagauuuaaaagcuaagauaaccaaauauuaauuacaucauacccauucauaagagauucuuggucauauucuuguuuuuuuccauuguugauuaaagcuugaauuggcacugcucauugcaacguggguaauaaaaauagcuucugguuugcuaauguuuuagauauuaaaauuuuaaaggucugaauuuauuauguugcuucagaguuaccuuuucgaauuucuagaaaaggaacggcuguaguagaucucucugggaauggcgaccccuccucaauuuguacuguaaugcgaagugaugggacuucucucuaugcaaccagguuuguagccucugugagggucaacauuugguucuaaaucuguugcuuucagaugaaacacuauguacaauuaauuaugcauuaucggauuccacagcugaugacauuauucuauaaacuguaaaacugaaguacuucauaaucaacuaaaaguauuuuacaauggcacguuggcaggaaauguauacuaaaagaugaccauauuagcucagggguuuccuuaugcuguaaagaacaucuuacaugcacauaaauaccagaacucauugggauuugguaaagcaggcugagggagaaagcagccaugucacauuuuuuuuucccauccaucucugugacugaccuuuguggaagggccaaucucuguucaucaguaagaaguggguuuaucagcaccuuuauuucugggacaaagcuaauaggaaagagaagcacugcuggcaaaagugucucccaggccagaauuuuauauuaggucacaaaucacuuuuguaacacaaagucaugauacuuuguuguuuuauauuaacuaccauaauuuguuccaaacaacuuuaagcaaccaauuaagucuuuuaacuuccccuuaggaaauucaucucuuaccuucuauuacuuuucgacauuucccuuuaccauuucuaugcaauugggauuaggaagugagaagagcuuauauaucuaagagguacauuauuuuucuagauaagcaaauauauauauuagaaaaguuuuuuguaucaacuaauuauugcuagauagauuaaguaaauaaacuauugcacagugguuauaagaaguauccauugagaacagaggcucuguaacuauccgggucugguuagugucuuuuuuggguuaucauuaggugucaguuuuucaacaccuauauuuuucuuuggaaaaagaaacaucccgucagaaaaggggcccuaugacaugaagucucuauaacuauccuaauuugguguuuuuucaggcugucauuagauguagacuuuucuguguauuuaccuuaacaccuguacuuucucuuuuuucuuugaaaauaauugucuuuuugccacuuauugaaauguuugauuuuuucacuuugcuuuaaugucaguugcuucugccuucuaauggguuucuuauagaauaccuuugugugggggauguaaaugaaaguuguuauagcagacaaaacugcaggagaauacugaaaagaacagagugugaggcuggagaccugggacugucguuuaacucucugggccaugauucucuacuuugugaaaugagagaucuggacuaaaugaccuagcacgucuucuggcuuugaaauucaguuucuacaaacucaaccuagaaauuuuucuuauucuuuuuuguuuuuugauugaaucaaaaaauuucccuuuguuuuguccuuaucuuaaaccaaaaaaauauaacaggugucuauuugugacaucauuuuugugauaaucugcucuacaacuguuucucaacauuuuaaaaauuauaauuccuccaagcaaccuuuucagccauauuuuuccuaauugccaauccucaugaaauuuuaucccacagauauucuguaucucuguauauauuguauacauaucugugguuuaugcaugaagaauaagauuuuuuguuggccagcuguaguggcucacgccuguaaucuuagaacuuugggaagccaaagcaggaggaucacuugaggccagaaguuugaaagcagccgggacaauauaaugagacccaucucuacaaaaaauaugcaguggcucuugccuguauucucaggacuuugggaggacgaggaggguagaucaccugaggccaggaguuugaaaccagccuggccaacaugaugauaccccauuucuacuaaaaacacaaaaauuagccaguuuuugccuucauugagaaugcaugcucugugcaaugucaggaucaugagauagguacuaaugacauuuugaugaucccuaacauuuugaaagaucgagaaauuuuuucagucuuuccaguaucauauauaaucaaaaauagcucuaauuuuaaauuuuaauauuucauaauccuugacuugaaguuuugguuuaugaaauuuuaugguuuuucauuauuucauaugcaaacuagauauuuguaucuaaucagagauaaaagagauagaaauucugucaaaggacuuuauggucuuuuuuuuuuuuuuuuuuuuuuaauugagacggugucuugcucuguugcucagucuggagugcaguggugcgaucuucgcucacuguaaacuccaccuccuagguucaagcgauucuccugccucagccuccugaauagcugggauuacaggcgugcgccaccacgcccagcuaauuuuuguauuuuuaguagagacgggguuucaccauguuggucaggcuggucucaaacuccugaccucgugaaccucccgccuuagccucccaaagugcuugggauuacaggcgugagccgccacaccuggccgacuuuauggucuuuuaaaugcguuagaagguauucccccugacugacccaagacuuugaaaguccuuaguaauacuaauaggagaguaucuagacaauaccuguuuacuacaucaucuauauuuuaaauauguucauuaagagaauauauugcagagaaguaacaggugauucuuuuuaguagagacuuaaucauaaaacauuuaucuacaagacacuucacccagagcuauuuuaguuguuauuacuacuuguuguagaacuuuuauguauuaauuuuauuuauuuauauuuauuuuagguuuugcuuuucccaguguuuuuauuguuguuuuucccaaaccuauuuuuaucauuuuauaucaaaacaugauauucggauuaucuaaguguggguggaauuccucaggcugugguauaauuuaaauucuuaauuagaaaaugcucauugcuauuaaauagguaagaccaauuauuacccggaucugcuuaguaacucuugguuuauggccacuuuguuucagagaucuugcagcugcuauagaucgaauggacaaguauaauuuugauacaaugauauaugugguaaguaaucagaacaaaaaguuaugaucucuuaacucaugaaaacuacagagguagaaauuggaugccauguugaaaaacuauggaaaacuacagagagaagucaacauuaaguauguuuaaagugggcaacuucuauuuaaaaguuuaaacacuuaaaaaugaaaaaguuuacauugcuucauaguaagaaaaaauuaccugaaucaguaagaugguuaugugaaauuaauauauacaggucacuauaauaccaaguuuuuuuguuuuuuauuuuucaauucugauuugggcucaacaguuguuuuuaaauaacuuuauuuugaaguaauuuaauacucacaagaaguuucaaaauaguacgguguuuccccccaaagauaguacauaaccauaguacuuuuaucaauagcaggaaauuaacauugauagagaccuuacugaaauuucgccagcuuuuacauguacucuccuguaaauguuuguguggcuaugguuuuaugagacuuuaucacauguauagauucauguaaccaucaccacauucagaauauagaacuguuccaucacaaaacaaacucccucguggucagccacuuaauaaucacaccuucacccaauccuaaccccuggcagccagugcucuguucuucagcacaauuuugucacucuaagaauguuguauaaauggaauuauaccauauguaaccuuugagauuggcuuuuuucacucaguauaaugaaugcccuggagaacuauccaggcuguccugugugucaguaguugguuccuuuuauugcugagugguauucuaguaucuuuuccccuuuccuuacuuaucaugugaaaccuuccuuuccacuuagaagaaaguuaccaucaaauauuuauuuagaguuuagcuuuggucucagagaccagggucauaauagccgagagggcagaaacuuaaauagaauacucagaagauugaaguucacauuuccuacugacucgguggaguuguauggcucuuauuucccucccuuguagagcaguccacuuagacacucuucuuguggcauccucuuuguguuuaguuaaaacauaucaauugacgacuuuagucugucagaccucaaauaucuuaauuugauucaaguccaaccuauuuuuauacauuaauuugucaguauucuuuuauuuuauauauauuuucuucccaagacagauaaaggacaaaaaaagcauuuucagcaaguauuccaaaugcugaagaucaugggauaugacugggcagaaagguaaugucugcaugguucuuaauugucugugcagggucagcugagccugaaaauguaccuagugguuaaaguuuuucacucagauuucaauucuuuguuucaagauacugguguggaaagguagauuugauuuuuguauuaugucuugguuauaauaauuuccaccuuauaaacauuaaauaacuguauuuuuacuaguuaucugcucucaguggcuuaguuuucaaaauucuuaauccacaucuccuuuuucuccuaaaggcaacuaguaguguaaucacaugcuggugauuauaaagugaagcugugcuuaacguccuuuguagcauacaaaucacaucaauuucauuuuauuaauuuuuaaaaacucugcucugaugguuaaaguucaaaccacucucugaaagguauuauaugcuuucagcagcagcucuuguuuagcuuucaguuaacuagaugcccacucuuuuaggugccagcacgugcccuuuggaguaguacagggaaugaagacucgaagaggagaugucacuuuccuggaagauguuuuaaaugagauucaauuaaggaugcuacagaacauggcuucaauuaagagugaauucaguuuuuucuuauuaaagucauaacuuacgugccacuuuuauguuauucuggacuuugggcagugugauuuauuaugucugucccuccauugaagugucacuaacuuugucaaaaauaccuuucacuaauuagaggugccagaauuuuuauacucgcuacucaggaauuggucacuucaauaaucugaauuacuauaaccuugguccucuuuucaugaacagcuugagcacugacauucuguugucuaggugauuacgugaaguuucuauguuauaauuuggauacaagucaccaguccuuaugacuuuaauuaaccuucacccuuggaaaacuaaguaucagauauauauagauauauauauauacacacacacacacacacacacacauauauauuuauauauauauacacacauacauauauauauauaaaaucagaaauccaaauuuauuuuuccuacaaguaucuuuugaauaaauaaauuuggauuucuuucccuuuaauguaggcaggggaaaugucauuaucaaagguaaaauagccuaaauuaggcaaguaauuacucauucugaaucuguucuugauugucagcauacauuuuuggcagauguuaccuucacuuggauccaugauuggcacagugucauguagacuaaagauagcugccuuugucuguuucagcaacuaaagaacucaagaacccacaagagacugcagagagggucgggcucgcagcacucauuauucaggucuguuaagacuccuaccugugaggcccuuuuguuugguacuagagcaaaucccagcagugaagauuuccucugucguuuuaggacuucaaagguuuacucuuaucugacuacaaguucagcugggaucguguuuuccagagucgcggggacacaggagucuuccuacaguacacacacgcccgccuccacaggugagaagaggcugcagggaaaccuugugcugcacugugcuuacuuaggcuagguccugugauucuaagaccagaggcccuguuuucugggcuuuuccaauaucuucuauucacaucugacuagaguagaccuucuuuuaggaaaaaaaaaaaauuuauugagcaccuauguuagaaauacauuuauguguauuaucuuaguccucagaauaacccugucgaaaaauauacuguuaccuccacuguguauggauauuaaggagaccaaaauuguguauuauaaggucauguucaucacuugcagcucugugcccuuguaugacuuuuuaaucuuuugauguuuuuaacuuuaaacuuuugauaaguuuggaagagacuuuuggauguggguaccugaaugacuucaacacugcuuguuuacaagagccacagucuguuucaauucuucagcaucuucucagguaugauguuuuccagggaucaucaagugugcuucugcuuaucaaaauggcuauuagcauuuuugcugcccaguagagucaacaguccaguagcugccuucugccucuagacuuuucccaaagguaugccuuaaaaagugauuauuugcauuuugaggacagagggcauagauuaagccaaugcccaaggaggacagucuuugggucuucagaauauuaucacugaugaauagcgcacaugucuagcugccucuagcucacauaaagccuuauaaaagcauaaccuuuuuuaguuuuaguuugagaaagagcaucuucuugcucucugugguaagugaaggaaaauaccugccuuugugcagcuucccagagaccguaaguccuucauuugccucuugguuucgguucacaaucucaaauacauauauguaugugaugcucccaugcuaggcaagacacccacacauuuuagcucugacgggcauuguuggugaagccaaacaugccagagauuagucucuagaagggauguggaugguuaugaacaaggugguuuucuuugauugccauauaguagucagugguucuuuccuggaaucagaaaaauuuacucacauguacaauagggaauguacggaaaaauaagccaacuggguuuucuuagcauugaggguagacuuugcuaauuuauauuuuauauucuuaaacauggcuggaggcuuuuuacauucaccagccaugauuuaaguuuuugcuguggacuaggucuaggaaauagcaagaugauuuagaaagucccugccaucaaagaauuuggaagaaagaaaaauguuccuuugccuucaaauguacacacaguuuuuucauauccuucuacucuucuuuuuuuuugagacggagucuugcucuguugcccaggcuagaguacaguggcuggaucucggcucacugaaaccuucaccucccggggucaagugauucuucugccuuagccucccagguagcugggacuauaggcgcgugccaccacaccuggcuaauuuuuguauuuuuaguagagaaugggguuucaucauauuggccaggcugcucucaaacuccugaccucaugauccacccaccucagucucccaaagugcugggauuacagacgugagacacugcgccuggccauaccuucuacucuuaaucgugucgagucaaccuuauauucacaaucuuuuaaugucuaaugucuuaguguaauguguacagucuuuuccuguucacuguuccugucaucuuuuagguucgacgaggugcuuuauaaaucaucucaggacuuucaacccaggcauaucgucaguuaccuucuaacuuuaagguacuuuauaaucuuccuguuuucagguguuaauggcauuugagaccuuucuuucaucuaaagguuuccuguaaacaaauuccuuggccuaaaauuugaugugcuuuuaguuacaggaauuauugcuucaucuauacaaauuagcaguuaauguuccuucauucauucagugauacaagguacugucacuguagacuggagaaugggaacugacaacuacaguuacagcacagugcauguguuauguuagagugaacguaagagaugguguuagggcaaccagcccagccuugagcgaucagagagggcuucucagaggaaaggagauauuaaucagaaggaauguggcugggaagaagaagaaagcccagaguugagcaagaacguaauaauacauuuuaaaggauccauaagcauuguccugggagggcugaugaaugaagcguguauaaaccuguuugccauguacugaggcauuuaaacuuauuuucgggguggugggguccauacagggauuuuaagcagaggcacagaaaaauaagcuagaaaacuuaauuuuucuaaucuuuaaugacaauuucauggugucuauuuuagcaaauugaaaucaaaauugaguccacccuuguauagcagcagcagcuguaucuucuguaaagccauuuaauaaaggaaauguugcuuuuacucaacaaguauugaaaucagacacuuaacaggacuguuuucuugauuauacuuuuuaccuugucuucucuagauuuauguaaggauuuuuuucuuccuuuaaaugacacuuaagacauacagaggugaagaagcuacaaagucuuuuuuuuuuuuuuuucuuuuuuuugagauggugucucgcucuguuguccaggcuggagcgugaucucggcucacugcaaccuccaccugcuggauucaagcgauucuccugccucagccucccuaguagcugggauuacaggcacgugccaucaugcccagcuaauauaccaagucuuaugaaaugucauuuuaucauuaaaacugaugucuuaaguaucauuucuccggcacauuguuauacuugcugccauaccuaaauuuaaaaagauacuuuaaagaguggccaguguguguggagaguggauaguuucuacccaccucacuguacagagggaaaggccaugcuguguuauacauuggauuguaggcugccuaaaugaggaaaaaugauuagaaaaggauucuuuauauuuguaaaauuaacauugaaaucauaaucuuuuuuuuuuuuugagacagagucucgcacucuugcccaggcuggagugcaguggcgugaucucggcucacugcaagcucugccuccuggguucacgccauucuccugccucagccucccgaguagcugggacuacaggcgcaugccaccacgcccggcuaauuuuuguauuuuuaguagagacgggguuucaccauguuagccaggauggucucgaucuccugaccuugugauccacccgccucggccucccaaagugcugggauuacaggcgugagccacugcgcccugcgaaaucauaaucuuaagaauugcccaccucuuaguaguagaauagggccaagaucuaaagcuugaguuuugaauuccaguuucaacuucacaauuuugaauacauccuuuaaugguucugggcuuuauuaaguugaaggaguaagauuagauaucaagcucauaucuuacaacaggaaauuacugcugguacuaucgugauuucucucuuccuguuucagucaucuugcagcuguggcacacaaaacacuacaaauaaaagauaguccuccugaaguggcugggguacguuauguugaauguuuucuguauaaucccuagcuccugagacuaauauuacuaagucagucuuguaaauuuuucuaaaauagcauucuguuguucaacuguagcaguauacuuccuuagcuaauaauuaggcuguaacaaucaauguguauauacuucccaacauacuagacuauaaagcacauuuuccuacaugaaauauuacagugauaaguuccccuuaucugaagccauacuguauaauacuaucacucccacuccaugacacuuuauguacagguuuuacuguaagggaugccaggaauuuaucuucucuugccuauaguaacucuagggcacuuugacauauuguuccugcuuuaaacuagaaagaauaaccuuuaaaaccauucucauguauugaauacauuccuguuacugaauauuuuaaaucauucuuugauuuauuuuguaggccagacuucaucuuuucaaagcuguccguucuguccuagccaauggaaugaaacuucuuggaauaacaccuguauguaggauguaauuuccauuaaaauggcuuuuaaaaugucaagugaa

SEQ ID NO: 191359 - RNA, 71023 nt, Homo sapiens
uaguuauuaaaguuccuaugcagcuccgccucgcguccggccucauuuccucggaaaaucccugcuuuccccgcucgccacgcccuccuccuacccggcuuuaaagcuagugaggcacagccugcggggaacguagcuagcugcaagcagaggccggcaugaccaccgagcagcgacgcagccugcaagccuuccaggauuauauccggaagacccuggacccuaccuacauccugagcuacauggcccccugguuuagggagggugagugucuccagcggcgccuucucggcggaaaacaauugaggacuuguuuuucucuugcuucguucccuucuuuuaaucaaugcagagagccugccagacuccccagguuugugguaagaucuccgcagcauuuuaggcuagagguugccagaguuugaggagcccucggaggccuagguggggaaacugaguuccagcgaggugaagugacuugcuuaagggugcucaucuauuuagguucaaagcuggggaagaaauuuuguuucauuuauuuucacuaauauuaaagucuacugugugcuuggcuggguacugacagagauugagaaauaagauaagggcucuuccuuaguauacauuacaguccaagggaugggacacaaagggcagauaauuacaguacugagcacaaagugcggucugagcuuaaaggaaguugaugcuuacucugccgaaucuuauuugcacgccuaaagaaguggaagcuggagaggagccggacuuuuccagaccgaauagcuuuaggcuuuaauacagguguuuccaucuaacuucggagacaggugauccuggguaaugaccauuuuguaaauuuguaucgaauuacuuugugcuggagaugagcagaggcuucugggaaagaggugaaaggaggugguacuuaaaagauaucgaugaggccgggcguggucccucacgcuguaaucccagcuguagagcacccgaugcuguugcuguucggggugccacuauguaacccgcacggaccuaggggacugaacaaagaggggcgaacgcgggaauaaaagacaagagacaaaagaguauaucuggaagaaggggucagggggcaccuugccucuaguggacaagggcccugagcuuuacacagcccuucuuauuaggcaaaagagauagcgagaaggggaggugcuuguuggcuggcugcuugauucacagcaggcuugcaagacugcauucuuugaacaauaggugcuagauuucucaauaaauaauuucaaggagccuggcgccagggagugaggcgcucagcaaaccauuugguggcaaggcagugugaguuugcccaggugcugcauucaugauaaacaguuugcuguuugaucauauagccuccagcggaaugcugaguuggucacaucccaagggccuucggcucccugcagccagcacuuugggaggccuaggcggguggaucacaaggucaggaguucgagaccagcuuggccaauauggugaaaccccgucucuaccgaaaaauacaaaauuagccaggcguaguggugcacuccuguagucccagcuacucaggaggcugaggaaugaaaaucgcuugaaccagggaggcagagguuauggugagaucgcaccacugcacucagccugggugacaucgugagacucuugucuccaaaaaaaaaaaaaaaaaaaaaaaaaaaaccgaaaaacaaaaaaaagucgaugagagggggccugggaauccuaaaagucuccaagugccagucuuuccugauguuauugcaguuuuuggaaauggcguuaagaccggcaacuaacuugaaugcuaauugcucuacaaaacuaaaagaaagguuguggaauggcauucuagugaccaguguagcuuggcaccugaagaaguacuuggaagaaacacuaacaacuggugugaauuccauuuuuucaugcacucauauauugauuugauacacuuugauggaauaaaauaagcaacucgugucaguauuauguuagcauuggagguaauuuacucagcaccuauuaccuaauagugucauugaaaguugaggaagcaaugaugagcacaguagaaacugucccugcccuaauagugauuagugugucuaugugaaugcagguaacaaaauaguaaauaauaaagugcagcagugcuuugauggaaaaaagcugggaugucuacuagaguccaaagggcacagccaaagcuucccagauauuuggcauuugaacugaggucuaaagaaagaggaaaaauuagcuggaaggagacaauaaauugcaguuagagggcuccuuaugugcaaagguccaaggugaaagagaaacuagaguguuccagguauccagaaaauauuaguaugguggcauuguggagagagaggcaggaguucagagagaugaaacuugacaggcaagcagaagugggauaugaacaguuuuggacuuuauccacugaaaugugauaaggagaggggaccaaaauagaauuugcauuguagaaaaacgacuuugacuucaguuugaggaauggcuugaauagguacaagacagggagagagagaauggcagaugcaaugaugccaggacagcagaguggaaaaacuggaagcaaggauaccaguuaggaaaauaggaauccggaggaauggggagaaauggauggauucaagacacauuuggaaaguauaaucaauaggucucuuggggaguuguggugaggagguaagggugaggacaggguggaaaugacuuccaggucucuggcuuugguccuugggugaauaaaugguaguuucugagauaggaaaugugggaagagggacagguuugcaggaggaggagaaaaauucggauuuagguaugcuggguuuguaugccuuggauacauccaugaagagauguucaucagauuguuggcugcacagguguggaguucaggaaaaggguccacaguuggggagacauuaauguggagauccuugcugaaacaaugagagugggugcaauuguuacugaaacaccagggauucagccuagguucuuuugcuggcugcacauaaagccaaucacugagacaacaaguuuugccaaggcuuuaauugggagcugcagcaaaggagguaggagaucagucucaaauccaucucccugacccguugaaauuagggguauggauagaaggaaagaaauauaacuagguguuggaaaauggacucuggagggguaaggaagcaaucaugauaaaugaggggccuggugucucauugucuggaugugauggucugaugaguuucaguucuuuuauaccuuuugagaggccuggggguccuuuuccuggggaaggaacucagauaaaacaaauauaaguuucagcuuuaagaucaggagggucaauuuccauguuuauucgaaagaauuguauaugggacuauuguguugguuucagucccccucuuucuauuuaucaauuccuggaucauggggaaucugauccucaaucuuucuggcagcuucaugcugaggaauggcguggugggcaguuccauacuaugggugaccacguggccauccaggaaucaaaaguuaaucuaauacuauaguuuucuucugagacacaaucuguaucauuacuguuccccgcuuccaccaaagacauaucacagcuggaugggccuaccugcaaaauaagccucaguuacauauacuuggcuuauuuacccacacaaagugcagcaaaaauuauuguccauaugggcucuccuaauuggcuuugcuggaaccucucacaaggccauuucagucaaagcccugggaaaauaacuuguuccuccaacuguguccccuuauaaaagaaaacagauuuuuauuaaauguaugcaagaaaacacauugccaugaacuaagaauauucacaaauaguuuauaaauucuggagaaauuagggagagagaaaaugccucaaauucuguuuaaaaggguauacucuacuuaauauacuguauucuuaaagguuaugaagagcuuaaaagaaaaaauucuccagauuccaaaaaacaaaaauucuccagacuuuuucaaacaaaaccauaaaaaauuauuucagucccacauuaguucaguccaugcaaucaacuccugcuguguuucauauuggguuaguaaucuuuauaaacaugucagccuuuuaauuaagagggacucuaauuaagaguccuagaaguuuucuguauuccaguggcacagucuccaaaguuaucagaaaucugcauucaagacuccuuuucaugaaguccccuaaauaaacaagcucuggacuauaucugauuauaagucacuuuuugaaaagaaucaaugcaaaacaacaauugcaaugacaaaagucuuaggagagccauaaagacacaguugacaaggaaauuuuuuuuucuguuggcauacaacaauuuaacauaauaaucaucauuacugacaccauauauuaagacauaucagaauuuuaggaaucucauauaguccugcaacacauauuaauagcacaucuauacaaauauaacccaaaggaaguuaaauaccaccucacauuugauaaugcugccuguauaauucuaauauaccaaagaagccuaacaugucugucuguauuggaauucaaggaagcuaauacacaaaaaaguuaguuugagguuaaaaaaaacccccugaauuuagaacuugaaauauuugcuguugggaagucugucaguaucaaagauuuaagacacuugauaucacaaaauaggaucacaggucgcuacaaaauaguuauucauuuagccaaaaagauaaaacaaacacauuuacccuuugauaggcgacucaguuucccaacaauaaggccuaauaaagacagcaugaggccaacuaaaugucucucccucuuccuuuucuuccccccacaguucacucaaaagguaaacaaauauuuuaugucaauauuauacaaacauuuuauucaaaagagaacaucaaauuuuaccuuuguaugguauauuuuuaauguuaaagcuaauuuuaauaaaaccuuauaagccgaauuuuaaucaguuugacuauaagauaggauuucugugaaguuuuuuuuuuuuuuuuuuuuuuugagauggugucuggcucuguugcccaggcuacaguggugcgaucuuggcucacugcaaccucugccuccuggguucaagcaauucuccugccucaaccucccuaguagcugggauuacaggccaugccaccacacuuggcuaauuuuuguauuuuuaguagagacgggguuucaccauguuggccaggcuggucuccaacucguggccucagcugauccgccugccucggccucccaaagugcugggauuacaggcgugagccaccacacccggccugagucaccagccccggccugagccaccacgcccagccugagccaccacacccagccaucuuuuuauaacguuuuacgauuuccuauuaaagaguagaguaaugcuccaagaaaacccuguuaugacacaggggcccagacauuggccuugcaucagugugcuuuugauguuaauguuuaauuuauagaaaaacccugaacuaauuuuauaacucaaaaucagcccuuacaagcucacgugcucaccuuuugugcaauaguuccugggcguagagggauugaaugguuuuaauuucuagcccuaugucucaugaaagcaguucauuuugauugucaccuucuccugagucugaagacgaggcuucauuuggugucagugcucaagauuuagcagguauuggugucuuuuuuggauccaggagucaaaggccuuugaauuacuaaauaauuguuuccuaagaauuauuuaauagcauauuuauacugcaggaaaccucaucauucucucuaauaugucacaaaauaaaacccugggauuuggugccuaguaguuacugucugaaacacuucaacccauuauacaauccauuguauuaaagugguuagguuacuccuugcauuuaucugcuagcauucuagugacaaaacugugaccuagagccucaaaaaugugguaaguccugugccaaacuuaccaaaguaagauaguuaacuuuucuuuccaucauuaaaaaaaaaaaugguaaaugcaaguaucaguuuuggaaauucaauaugaagauaaaucuuucauuuaaaaaguauacaacaaaacaaggacaaagugacaauaagcacacaguaauuucuuuucagcuauuuugaaagagccucaucauacauuuccaagauugguuucuagauaaaguacugacaacugauuuaagugacuuacaccacuagaaucuucaaacuggcauaacacuuguauguacauauuuuguuuucaaguauacaugugaaggcccaucagugauaaauggcuuaggauaaaaaaaacacuagaaagucuuauaauuuuuuuuaugacuuaauccaaguaaauguuauuuaaucuuaauaauaguaaacacaacuaaauuaguuugagagaaagcccaaucaauauaauuuccuuaaagacaaagccaauuuuuuucugaauauuaagacuuuguacccauauagcaguuuugccucauuaaaggaaaagaucugaaaccgcuauuguuuauugaauugaauuaccuuggaaauaaacaccacuuaaacauuucucucaccuacuuuuccaaauaaccaauaauaauguacuauuucuguucagaacuuagaagaauaaaccuuuuauuauuuuuugccaggaaucuuaaaguucuuauagcucucuaguucauuagagguaagcaaaaccaaacaaauuuuaaaggcugguguccaccaacaauuuuuggaagcuugaaaaagguagcuuaggaacuuuggauaaguagagcaaaugaugagauacuggaaaugcauaggaaacaaaaugauuauucauggaaccaaauaaaagccuuccuuacauuagaaacuaaaagccaucaaugguuuuauuaauauguauauauaaguaaaaccuaaagaagaagaaacagcaaauaaaugcaaauuaaaagaaaaaacaaacaggaaaccaaccugaaaauuuucuacucaguuuaacuuggaggcuauaguguuacccagagccaaaaaaacacaugaugaauauuuuguuccugaugcacaauuuaaugucuuuaaguucaccaauaccacuauauauuuugugcaauuaagaaauucacuuuaggcugggcgugguggcucaggccuguaaucucagcacuuugggaggccaagaugggugaaucacuugaggccaggaguuugagaccagccuggccaacaugguaaaaccccaucucuacuaaaaauacaaaaauuggccaggcaugauggcacacaacuauaaucccagcuacucuggaggaggccgaccaguaaguauuauacuguaaugauaguauaucuaugcagaagagcaaauacagugugaagcaaugcaagcauguaggugaaauuugguuguugcuauaucuggcuuuuaucuggcuucaugguuaacuauauuaagaaaggauugccaaacugccaauguguuucuuuacaauauuucuuauuuuacuuucaucaagacuaagagcuuuaacuaugagcaguguuaauuagccagauuucuccaauauucuaucugguuuuaagagaauauuauuuaagccuuuuauacuuuguauuuucucugucuguacauaaagguagacacacaaagaaauaggaaagaaacuacaugacuuacacacaccaucuaugauaugcuuagacuuucugauuuguccuggauuuucguucuuuuucuucuucuuuuuuuuuuuuuaaacagucauuuuacuuuaggacaaaaaaaauaccauuauaagaugcuuugucauacaaaauuauuuucuuuauaaccuuccuuaccaaaaauacaucuuuauacucauaacuuucuccacaucucucucgucuacuuguucuuuucuaccuuguuucauaaguaaccuuucaaguccauaauuauuaauaaacuuuagauaacuucugaguuagauaaaauuuuuuucugaauaaaaacacauugucuuuugcacauuuuauauauagaauuacauaugaacuagaauucuuauccuuaguaacaaccuuaaauuucaguaaaaaccuaggaagcaagaaaucuugagcugccuagcagauauuaguauuuuauagaugagaaccauuccacaauuuuuagaaacauguuccccacaucauaaccuuuucuuaauuggaaaugacucaaacauccaaugauuauauuuccgauuaugccaaaaguucauuuacagcauuugaccauuuacauuuuauuuauuuuuagcaguuuaucuagauuauuucugcaucauuuccuucuuaaccauuuuauaaccugugaaugucagguguucaccuaaauaaccuuaaaauuaauacgugggcauuuugaucaauaacucagaagauucagcuguuuucauuaaacuaacagcauuaaauuagucuuauaaagaauucacacaaauauucacuggguuuauagcuuuauaaccugcugccaaacucugauaccucaaauuaucuagcugagacaaauauaaagccgagacaaaaauguaugcugacaauucugaagacauuucuauuuuuauuuuaccaauaauuuuaaagacagcuuguuuauuaaagauuuacugaagucaugugaacuugaaaaacacuuuggacuuaauuuaugagcacucuuauuuauaagccaauuugguagguauaguguauaacauaguuaauguacaucuagauaaacacaucuaaacauguauacacacacaaagauccaacagcuuuuaccuuggaacucuagccaugagauagcaauacaaacucacgaaucuacaaccaaguccacauggcuaaaauuuguuugcuccaaucgguaauccaaugaaggcugugaaccagaauuuuggguaaagcaguuuccauggcaguuugauuuuuagaagcuagauuccaaagaaaccuggggccaaacagcacuacagaagaacgucauguggaaacuacucaccaggcccaacccugcuuaaaacagcggcauaaaagccagaauacaugggacuccaccuggcuuucccauucaacagccaacuccagauuccaaagaauauuggggcaaacguaguacaaaagaauauuuguuuguugaauucuaauuucccauuacuauauugacacauacaaucaacaaaacacaauccgacugcugaagcaauagacaagcccgaacaguguccaaacugaaacagucgaggugcuuuucucucucaaucgggcuuuauuaaccugcaaacagaaauuucuuaggaauuuuccaaauugagagaagccgaucccacugucugguacccaaaaaagacacuaacuuggccagacacaaacacagaaauuacaaacacgcucucuagaguaucauacugagagucagggugcuucccuuucuuagucaguugggcugguuuaaccugcaaauggaagcuccuuuuaaaauuuucaaauugagcagaucuugcugucugggccaagaaaggacacucacuuauccagaugccagugucacauuucaaaggcuguucuuccuagcaaucaggaacucagcuggggcuggcagcagcagggccagagagaccaaaacucacuuccagccaaaauugggugggcaguugcuuaggagggcuucugagacuccuagaccacagcaacccagccacaaaaaucuguuacugaagcaccagggguuuggccuagguccuccugguagccacacagaaagccaaacagggagacaacaaguauugccagggaagaagccuuuaauugggagcuguagccaagaagaugagagauuagucucaacuccaucucccugacccacuaaaauuagggguuuauauagcagggaagaaauguaacugugugggaaaacaggaacucaggaagcaaucaugaugaaugaggggccuggccucauugucuggaugugauaaucuggugaauuucaguuugauacuuuuugagaggccugguggucuuuugccugagaaaggaucucagauaaaacaaguguaagcuucaaguuuaaagaccagaagggucaauuucuguuuuucuggaauaaaugucugugggacuguggucaguuucaagauugcuuuuuggagugugaguagaaagagccugggacggaauccugugcaagcacucauuuaagagaugagcagaggaggaaaagagacugggaaagagugccacauaugugggcaaggaggcaucacggaaaccaagggagaaugaugugguggauaacauggcugaaugaugcugagaacccaaggucugucagaacuaaaaaaacguucccuuacuuuggcauuauugacuuuuggggccacccacaggacuaguuucuguggaauagggaugaagguaaagguauaagaugguugggaaacuaacugcaagaguagacucaggaauaaauagagggcaaggaaguggagaagauaaauguaggcaguucuuuugaaaauaugauucacaaaugaaaaauuacaagggagguagugcuuaauaguaucuucacacaaauccagucuauacaauuugguuacacuguggguuccaagaaaggagagagaagacagaagcaaagauaaauggaaaaaauagaaaauuuuacuugucugagaaagaaacagcacuuugcaugugaguuuauugagaagggaauacauuaguaggauuuucauauuucucagaugaagaaauaaucauguaaacauucaggaaaaacaaacguguggcuuuuuuuuuuuuuuuuugagacagaguccugcucugucacccaggcuggagugcaguggucugaucucggcucacugcaacauccacuucuggguucaagugagaugggguuucaccauguuggucaggcuggucucgaacuccuggccuugugguccgcacgccuuggccucucaaagugcuaggauuacaggcgugagccaccaugccuggccacaaauaagauuacucagguuuccucuaacggaaucaacaucaaguuggucucugacuucucugcaacucuaauguaacuaaagaguaaaacucugugcagcauuuaaaagguaaaacaaaguugccccuauuuuauauuuagccagguauuuauguauguaagcaagaagaaaacauuauuauauauguggggucucauauauauuucuuacagaaauuacuggaaaugugauuccaaacaaugggaacugaaaaaaauuagcuuaaaaaaaggaguucuuguaaugcaaggauuggucgugaauguugaaacuaggcauguagaguugauuuuaaauaauuuuauaaauuuguccacaaagguaagugcaauagucaagcauuucuuuuuuaaauuauacuuuaaguucugggacacaugugcagaacgugcagguuuguuacauagguauacacgugccauggugguuugcugcacccaucaaaccaucaucuccauuagguauuucuucuaaugcuaucccuccccuauccucccagcccccaacaggccccagugugugauguuccccucccuguguccauguguucuuacuguucaacucccacuuaugagugagaacauacgguguuagguuuucuguuccuguguuaguuugcugagaaugaugguuuccagcuucauccaugacccugcaaaggacaugaacucauucuuuuuuauggcugcguaguauuccaugguguauaugugccauauuuucuuuauccaguuuaucauugaugggcauuuggguugguuccaagucuuugcuguugugaacaaugccgcaagacacauacaugugcaugugucuuuauaggagaaugauuuacaauaguuugguauauacccaguaaugggauugcugggucaaaggauaucucugguucuagauccuugaggaaucacccacacugucuuccacaaugguugaacuaauuuacacucccaccaaaaguguaaaagcguuccuguuucuccacauccucuccagcaucuguuguuuccugacuuuuuaaugauugccauuauaacuggcaugagaugguaucucauugugguuuugauuugcauuucuguaaugaccagugaugaugagcauuuuuucauauguuuguucgugguauaaaugucuucauuugagaaaugucugcucauauccugcacccacuuuuugaugggguuguuucuuucuuuuaaauuuguuuaaguuccuuguagauucuggauauuagcccuuugucagauggauagauugcaaaaauuuucucucauucuguaguuugccuguucauucugaugauaguuucuuuagcugugcagaagcucuuuaguuuaauuagauucuauuugccaauuuugauuuuuguugccauugcuuuugguguuuuagucaugaagucuuugcccgugccuauguccugaaugguauugccuagguuuucuucuagggacuuuaugguuuuaggucuuacauuuaagucuuuaauccaucuugaguuaauuuuugucuaagguguaaggaagugguccaguuucaguuuucuguauauggcuagucaguuuucccaacaacauuuauuaaauagggaauccuuuccccauugcuucuuuuugucaggguugucaaagaccauaugguuguagauguguggcauuauuucugaugacuguucuguuccauuggucuauauaucugauaaucuguuuugguagcaguaccaugcucuuuugauuacuguagccuuguaguauaguuugaagucagguagcaugaugccuucagcuuuguucuuuuuugcuuaggauugucuuggcuaugugggcucuuuuuugguuccauaugaacuuuaaaguaguuuuuuccaauucugugaagaaagucauugguagcuugauggggauggcauugaaucuauaaauuaccuugggcaguauggccauuuucacgauauugauucuuccuacccgugagcauggaauguucuuccauuuguuuguauccucuuuuauuucauugagcagugguuuguaguucuccuugaagagguccuucacaucccuuguaaguuggauuccuagguauuuuauucuuuuuguaguaauugugaaugggaguucacucaugauuuggcucucuguuugucuguuauugguguauaggaaugcuugugauuuuugcacauugauuuuguauccugagacuuugcugaaguugcuuaucagcuuaaggagauuuugggcugagaugaugggguuuucuagauauacaaucaugucaucugccaacagggacaauuggacuuucuguuuuccuaauugaauacccuuuauuucuuucucuugccuaauugcucuggccagaacuuccaacaguauguugaauaggaguggggagagagggcaucuuugucuugugcugguuuucaaaggaaaugcuuccaacuuuugcccauucaguaugauauuggcuguggguuugucauaaauagcucuuuauuauucugagauacauuccaucaauaccuaguuuauugagaguuuuuagcaugaagggcuguugaauuuuaucaacggcguuuucugcaucuauugagauaaucaugugguuuuugucauuaguucuguuuaugugauggauuacauuuauugauuuguauauguugaaccagccuuguaucccagggaugaagcagaccugauuauggugaauaagcuuuuugauaugcugcuggauucaguuugccaguauuuuauugaggauuuuugcaucaauguucaucaggaauauuggccugaaauuuucuuuuuugguuuugccucugccagguuuugguaucagggugauguuggccucauaaaaugaguuagggaggagucccucuuuuucuauuguugggaauaguuucagaaggaaugguauaagcuccucuuuguaccucugguagaauucagcugugaauccaucugguccugggcuuuuuuugguugguaggccauuacugccacaacuuguuauuggucucuucagggauuugacuucuuccugguuuagucuuggaggguauaugugucuaggaauuuauccauuucuucuagauuuucuaguguauuuguguagagguguuuauaguauucugugaugguaguuuguauuucugugggaucacuggugacauccccuuuauuauuuuuauuguaucuauuugagucaucucucucuucuucuuuauuaaacuggcuuguggucuauauauuuguuaaucuuuucaaaaaaccagcuccuggauucacugauuuuuuugaaggguuuucugugucucuaucuccuucaguucugcucugaucuuaguuauuucuugucuuuugcuagcuuuugaauuuguuugcucuugcuucucugguucuuuuaauugugauauuaugauguugauuuuagaucuuucccucuuucuccugugggcauuuagugcuauaaauuuccaucuacacacugcuuuaaaugugucccagagauucugguacguugugucuuuguucucauugguuucaaagaacuuauuuauuucugccuucauuucauauuuacccuguagucauucaggagcagguuguucaguuuccauguaguugugcaguuuugagugaguuucuuaauccucaguucuaauuugauugcacuguguucugacagacuguuaugauuuccguucuuuugcauuugcugaggaguguuuuauuuccuauuauguggucaauuuuagaauaaguaugauguggugcugagaagaauguauauucuauucaucugggguggagaguucuguagaugucuacuaggucagcuuuguccagagcugaguucaaguccugaauauucuuguuaauuuucuguuuuguugaucuauuauugacagugggguguuaaagucucccacuauuauugugugggagucuaagucucuuuguaggucuguaagaacuugcuuuaugaaucuggguauuccuguauugggugcauauguauuuagcauaguuagcucuucuuguugcauugaucccuuuacuauuauauaaugcccuucuuucucuuuuuugaucuuuguugguuuaaaaucuguuuuaucagagacugggauugcaaccccugcuuuuuuuuuuucuuuccauuugcuugguaaaucuuccuccaucccuguauuuugagccuaugugugucuuuacaugugagaugggucuccugaauacagcacaccaaugggucuugacucuuuauccaauuugccagucugugucuuuuaauuggggcauuuagcccauucacacuuaagguuaauauuguuaugugugaauuugauccugucauuaugaugcuagcugguuauuuugccuguuaguugaugcaguuucuucauagugucgauggucuuuacaauuugguauguuuuugcaguggcugguaccaguuuuccuuuccauauuuagugcuuccuucaggagcucuuguaaggcaggccugguggugacaaaaucucucagcauuugcuugucuguaaaggauuuuauuucuucuuugcuuauaaaucuuaguuuggcuguauaugaaauucuggguugaaaauucuugucuuuaagaauguugaauauuggcccccacucucuucuggcuuguaggguuucuacagagagaucugcuguuagucugaugggcuucccuuugugaguaacucaaccuuucucucuggcugcaccuaacauuuuuccuccauuucaaccuuggugaaucugaugauuaugugucuugggguuguucuucucgaggaguaucuuugugguguucucuguauuuccugaauuugaauguuggccuguauugcuagguuggggacguucuccuggauaacauccugacgagaguuuuccaacuugguuccauucuccccgucacuuucggguacaccaaucaaacauagguuuggucuuuucacauagucccauauuucuuggaagcuuuguucauuccuuuucauucuuuuuuucucuaaucuugucuucaugcuuuauuucauuaaauucaucuucaaucucugauauccuuucuucugcuugauugauucagcuauugauaguuguguaugcuucacaaaguucucgugcuguguuuuuuggcuacaucaggucauucagguccuucucuaaacugguuauucuaguugucacuccucuaaccuuuuuucaagguuuguagcuuccuugcauuggguuagaacaugcuccuuuagcucagaggaguuucuuauuacccaccuucugaagccuacuucugucaauuugucaaacucauucuccguccaguuuuguuccguugcuggcaaggaguugugauccuuuggaggagaagaggaucacauuuuuuuucugccuuuuugcacuggcguuuccucaucuucauggauuuaucugcccuuggucuuucauguuggugaccuucagaugaguuaucuguguggauguccuuuucguugauauugaugauauuccuguuuguuaguuuuccuucuaacaggccccucagcugcaggucugcuggaguuugcuggauguccacuccagacccuguuugccuggguaucaccaguggaggcugcagaacagcaaagauugcugccuguuccuuccuuuggaagcuuccucccagaggggcaccugccagaugccagcuggagcucuccuguaugaggugucuguugacccugguaggaggugucuccccaccaggaggcacagguaucagggacccacuuaaggaggcagucuguccguuagcagagcucaagcacugugcugggagaucuguugcucucuucagagccagcaggcagcaacauuuaagucugcugaagcugugcccacagcugcccuuuuccccaggugcccucucccagggaaaugggaguuuuaucuguaagccccugaguggggcugcuggcuuuuuuucagagaugcccugccuagagugaggaaucuagagaggcagucuagcuauaguggcuuugccaagcugcaguagggucuacccaguuugaacuuccugguggcuuuguuuacacugugaggggaauagggccuacucaagccucaguaauuguggaugccccucccccaaccaagcuugagcaucccaggucaacuucagauuguugugcuggcagcgagaauuucaagcuaguggauuuuagcuugcugggcucuguaggggugggauuugcugugcuagaccacuuggcucccuggcuucagcccccuuuccaggagagugaaugguucugucuugcuggcauuccaggugucacugagguaugaaaaaaaaaacugcagcuagcucagugucugcccaaauggccacccagauuugugcuugaaacccagaucccugguggcauaggcaccggagggaaucuccuggucugcugguugcgaagacuuggggggaaaagcauaguaucugggccagggugcacuguuccucauggcacagucccucauggcuucccuuggcuaggggagggaguucccagaccccuugugcuucccaggugaggugacacccuacccugcuucagcucgcugucugugggcugcacccacugucuauccagucccagugaggugaaccggguaccucuguuggaaaugcagaaaucacccgccuucuguguugaucucucugugagcugcagaccggagcuguuccuuuuuuggccaucuugcccugguuccuagucaagcauuuuuuaagagaggauuuucauauaguaaaaaaaaaaaaaaaaaaauuaaguaaauacuuugguuuaaaauuuuagauugagucuguuaggagcuagggaaaauuaugauaaauaagaguuaaaucccuugccucaaaagggggagacuuaaaauauuaccauuuuccacuugcuucuguaguuuuaaaaagcuauaugaaugguuacagauaaugauaccauuuaaaugagguuuuauauguuuuguuguucuugagaggagaaaagaaacuaguaauuuaagcuaaccagaaaauauaggaaagggaaauauaaacaagauaacacaaggaaaacuaguuauaucagcuauggccauguaauuaggucaaacaucuuuuaaauaggugugaaugagucagaaagcagaauccagguuuuggucaucugccagagacccauguaaagucuaauaacauaaaaaauaaaaaugggggccagacuuggcagcucaugccuguaauuccagcacuuugggaaccugaggugggaggauugcuugagccccgaaaauugagccuauggugagcuaugaucaugcuacuguacuucugcuugggcaauggaacaagacccugucucauaaauaauaaauaaauaaaaaagagauaaagaagggacaaauauauauuaaauaaaugcauacguaaagaaagcaagaauuauacuuaaauugcacuaguggaaaguauuaagauaaaaugauaaagguauugagauaucagugaagauuugguacacauaaaucuuuguuuauuaaauauuagaaaacgucaagaaauaugggaauuauaagauaucuuuauuaguacugcuaagucagauaaaugauaauaaaagcauaaaugaucuguuuaauaagguugauuuaaugucuauguuuuccauuuuguaucauauagcaaauauauccuucuccuccaauucuuaaaaagcuuugccaaagugauccuauaugaguuacagauaaauauuuaauaaauucccaaagcauaacuuuuaugaguuuuauuuucaaauuuguaggcucugugauacugggcaaaugucuuaacucucguaugccucaguuuccucauuuguaaaaucagaauaaaaaccauguuuggguguuuuggaaauuaaacugcaugguauuaaauuacuguuagcuauuauucuauaucccagaaauuaaucauagguuuaaaaaaauuuucacagaauuucaaaauagcauccuuuugaguaacuucuagcagaaugagaaaaucuaaacaaguauagcuacuuucaaaaguaagcacggcaaucagccaacauauuauauauuuuaagauguaauaagcuuuuaaucagaauuuauagccuaaauggauuuauugguauuucaaaagaaugaacacuuaugaauuaauuaauuugacugaaguaauugcaaaaagaacagccaguuaacuccaaagaaagcaaacuggccaaaauaaagaacaaaaacaaaauucccccaaauuacuggaacuaacagaguucauucagucuuguugcaauagauacguaaaauaaaauaaaaacggaggccacgcauuuuuaucuacuggaaaacaagugagauuauacuggaaaaacaguauuuucauauacuggaaaaacaaaccagauuauauaacauuucccuaaaugcauaaaagauucuuacaaauccaauuuagaaaaaaauaugaaugaccucucaaaacuagcugugagacaugaacaggaaauguauuaagaaauaaccaaaacaaaagacacuggccaaagguggaagaaaucccacaagaaaucauuaaaaacagugaaguuuguuuguuuggucuguuuuugucucucaguuuugcaaagguuaugaagauugagcaaauucagugcuauggagggaaauaucauucauacacuaucgauggaggguuaguacaguuuggaagguaguuggggaaaauguauuaacauucauuccuuccuucauugauucauuuauucauuuauggauugauugauugauugauugagacagagucucacucuguugccuaugcuggagugcaguggcgcaaucucagcucacugcaaucuccaccucccagguuuaagugauuuuccuaccucagccuccugaguagcugggauuacgggugcaagccaccacgccuggcuaauuuuucuauuuuuagaagagauggggguuucaccauguuggccaggauggucuugaacuccugaccucaagugauccgccugccuuggccucccaaagugcugggauuacaggcaugagccaccgcgccuggccuccacauuuaaaagcauauacuguuaaacugaggaauuauacuucugagaacuuauuccagggaaaaguugguaaagcagguaaagacauagauggguguguacuaaacgcauuuuaguuucguguuaaaggaauacauuaaauuauacuacauuuaugugacauaaaacuaugcagccacuaaaaguugauguagguacauauuuauuaauaggaaacaacaccuguaauccacugaguggaaaagagcagauuuguuaaaucuuacuuauuuaaaacuauauauuuauacacauaauuagauauguagaaggaugguuucuagaggauauuacgugugauugaagauagucauacauuuaacaaaaaaaaugcugaaaugauaugaagaaaacuaugaagucccugaagagaaaucugucucugauuugagugaggaagagacagccuauguuugugccuggggacuauagguuuguaaacaugucaauucucccuaugcuaauuuauagaguacaaucacaauaaaaauaccggaaaguaaguuaaaagaaaaagcacccugaagaacuucuuaauuuuuaaugugaaagauacccuugaggucuucuuuugauucccucugcagaggcaaccauuguuaugaaguugauuuacauuuuucuuauuuaugccuuuuuacuuuauaaugugcaucucuguccacauaccuuuuggguucaacuccuuuuucuauuuucuauuagauugauaaaguuuuucucuauucccuauuuuuuucuaggcugcuuuggaggcucuggauucauugguuaacuuuaauugugacauauauauuguaucuauuauauauuuaauauauaaaauauauaauguauaaaauuauauauuauauaucuauuguauauaauagauauauauuuaaacauauauauuauauauaaaauauauaugauauauaauauagaauaaauauauaauauauauguuuaaauauauauuauaucuauauauaauagauauaauauauacuuuuauauauuauauauuuuauguauuaaauauauuuuauauauuuuauguauuaaauauauuuuauauauuuuauguauuaaauauauuuuauauauuuuauguauuaaauauauuuuauauauuuuauguauuaaauauauuuuauauauuuuauguauuaaauauauuuuauauauuuuauauauauuaaauguauaauauauauauauauguuuuugagacagccuugcucuguugccugggcuggagugcaguggugggaucucagcucucagcucacugcagccuccaucucugggguucaagcgauucuccugccucagccucccgaguagcugggauuauaggcacuggccaccaugcccggcuaauuuuuguauuuuuaguagagacaggguuucaccauguuggccaggcuagucucgaacuccuggacucaagugauccacccaccuuggccucccaaagugcugggauuacaggcgugagccacugugccgggcugugacaacuauacuuuaucagugaggauucagucagggaccagagacacuaaugaguguuauggcuggauauaaaacuuuugacucauauuuuuuugccauccguggaaagcaaagggagcuuauccacauuccccccgugcccacauccagcaucucguuuacucuaacccucucugcaaucagauauugugauuauugacgcuaguaacgucuuggaaaaggagcacugaagccauguuucuccuggagaacuugcaugguacccuggaagcugcagcacuuuucucacucacagguuguccaggauguuucaaggcagaccuggguguguguguguguguguguguguguguguuuggagucuugcucuauuacccaggcuggaguggaguggcaugaucucggcucauggcaacuucugucucccugguucaagugauucuccugccucagccucccgaguagcugggauuauaggcaccagccaccgcgccuggcuaauuuguguauuuuuaguagagacgggguuucaccauguuggccaggcuggucuugaacuccugaccucaagugauccacccaccuuggccucccaaaguggugggauuagaggugugagccacugugcccagcugcagauuuuuuauaguauuuuggagucaaaggccaaccaugauucuggaggggcaccaggugggcaguauucugaguauccauuccuuugguagcacuuucuggacacaugcgugagccagguacugugcugaugaucacaagacaaauguuccaagucacaguuucagguggaagacaggcccacauuuacuauauacuaugcaguguaaguacuuuagucaguagucaauaaagagcuuuagucaguaaggagacugagaaagcagagaagggaucaagaaauucuaccuugagaagcugagguuugacaucacaaugggccccaggacagcaaaggcagugggaaauacugucaaagaugaaguuuugucugcauuguuggugcuuuugaggaaauugucacuacucuguagcagcagauauuggggccagguaguagaaggaugggccugaccacaugcaaaguaaaugugaacugcccagcauacugcaaggcaguuuaucugggaaggcgguagcuguggcugggauaaauuugcaucuccacguggaauaucuguaauggcuguuagcauguugaaaggaagcucaagcagcagggaggccugggaacaaaaguacagcuguaaggaaugggcuuaggaacagaaugaacugacucaauggaauacgguaggauuguggguccagggaagcugggauaggugacaagauagguugcuguuaugaguugaauugugucccccuacccaaaauauauguuaaaguccuaaaccccaguacuucagaaugugauuuauugggagacuguuucuuuacagagguaauuaguuacgaugaggucauacuagaguagggcaggccccuaguucaauaugacuggugucccucuaagaaaacagccaugugaagacauagagacaacgagaaugcugugugaaaacauaggcagagauuggagugauguggccacaagccagagaaacagaaggcaaaguuggagggaguguugucacaagccaaggaaugccagcagcuaccagaaaccggaagggcaaggaaugcauucuccccagagccuucagaggaagcaugacucugcuaacaccaugauucacaauucuggccuccaagaacagagagaauaagccucuauuguuuaaaccaccugguuuguccuaauucguuauugcagccacaggaaacuaauacagaaggcuaaaaugaaaacgaugguaagaaguacugucaaggauguguggaaauuggaauccucuuagauuacuggugggaauguaagauggugcagcuccuugggaaaaugguuugacaauucccuauaauguuaaaaauggaguuaccauaagaacuagaaaucucacaccuauguguguacucaagagaaaugaauauauacaucgucacauaaaauugcucaugaauguucauagcaugucuauuuguaauaaccaaaauguggacacaaaucaaaugcccacugaugaguggauaaacaaaaugugguguauccauacagugggauauuauuuggcaauaaaaaggaaugaauaauaacgugcuacaacaugguuaaaccuuaaaaacauuaugcaaaguaagaggccagacauagacuauguauuguaugauuccauuaauaugaaauguguaaaauaggcaaauccauggagacucaauuugauuaguguuugccuggggcuaaggagagggagaguagggaaugacugcuaauggauauagguuuucuuuuuauagugaugaaaauguacuaaaauaguagucauggauucacaguuccaaaaaccauugaauuuuauuuuuugaaaggguugauuuuauuguugucaagacagagaccuuggcagagauccuuuuaaguagagcaagauuauaaggcauuccuucuucucuuccuucauucauuaaacauaccuuuguuuauugucuauuacgugcuaggucuucuucuaaucuaugagaauauagugguucaccagccugacaacuugcuuacucccuuggaauuugcauuccaucaacaaugggaaagaaaacccagaaaauuaucaaguaucaggucauaccaugguagcauuuuuauuacuacucccugggcaugaaauuaguguacaaaguuagaaugaccaccagcagguugguagauaauuuucucccaaaaggaccauggaaguaucccuuacuuccuuccuucuccuuucuuuguccuauuucaagacaaguuuucacucuguuguccaggcuggagugcagugaugccaccauagcuuacgggaaccuugaacuccuugguucaagugauccucccaccucagccuccaaaguagcugagacuacaggugugagccaccacacccaacuaauuaaaaaaauuuuuuuuuuuuuuuuuuuuuguagaggcugggugcaguggcucacaccuguaaucccaguacuuugagaggcugagggaggaggauaguuugaggccaccaugacuucucccuuuuugcagggagauuuuuuuacacaucuucaagaaacuccuuuucuagaaugugugcucagaccuccacaccaaacuguagguuuccagagaggaugggaagaguggcuuggugaagaaugggcacagucggccugggcagagguuuugcugcuucuccaaagauucuuccaaugcugugacuugguacaauuccugucccuauuugggaaggucuggugauccuuuucugguuuuucuucuaaugauuaauaguucugcaguuugaugagucauuuuugcuucuguuuguagaagaggugcaguauauucaggcugagaaaaacaacaagggcccaauggaggcugccacacuuuuucucaaguuccuguuggagcuccaggaggaaggcugguuccguggcuuuuuggaugcccuagaccaugcagguuaguucauucuuuuuaaucacaaaucagaggauauuacuuugcugcuugacaauacuguaaaagugaaaagcuauuaaauuugaaguauccacuuauaguucaugccucuuagucugagacaauguaaagacuguuuuuaggcagaugauauaauugucuaccugaaacauccaacaaaagaaucugcagagagauuauugucacuaauggaagaguuuagcaagauuauuuggauauaagaccaguauacaaaaauuaguugcauuucugcccaauggaagcaaacaaaaaauguaauccaaaaugaaguaucauuuuuaauaauaacaauuguaauguauuuaggaauaaaucuaacaaaagauguauaaggucugaauggagaaaaugauaaaauguuauuaaaagauauuaaagaaguccuaaauggaaaaacauacccaugcacauagagaaggaggcuugagaucauaaaaauaucaguucucccuacauugaucuguauauucaauauaauucuaauaaaaauccuacauacuuuuucagugaguguggcagguugauucuacaauguauauggaagaauuacgacccaacaauagucaagacaccccuaaagaagacaaauuuaguagauuggggcuuuucuuucuacacguuagcauuuauuagaaagcuacaggcauugagacagugaaauguugguuuuggcauugacaaacugaccauugaaacagaauagagacccucuaauuaggaccauaucuuuauggaaaccugauauauuagacaucacugagaaaagaggauuacugggaaaggaggagcuauucaaaaaauagcauuuauaaacagaauaauauuaaaagccgaacaaacucaagcuggacaugguggcgugugccuguagucccagccucucaggaggcugaggcaggaggacugcuagaguccaggaguuugaggcugcagugagcuaugauggcgcugcugcacuccagccugggcaacauagggagaccccuguauuuaaaaaacaaacccugggccgggugugguggcucacaccuguaaucccagcacuuugggaggaugaggcaggcagauuaccugacgucaggaguuugagaacagccuggacaacuuggcaaaacccugucuuuacuaaaaauacaaaaauuagccaggcgugguggugggcaccuguaaucccagcuacccgggaggcugaggaaggagaauugcuugaacccaggaggcagagguugcagugagcugagauugcgccauugcacuccagcuugggcaaugagugaaacuccuucucaaauuuaaauaaauaaauaaauaaauaaacccuguauuuaaaaaacaaacgcuaacuuuuaugcccauguggguacgaauaaauaaauacauuuguauuccuuacaucauguuuaucaaaaacacuauaaagaaagcaaaaaaaaaaaaaaaaaaaaacaaaucacaaacucugggagaagauauuuucaaaauguauaaucaccaaaggauuagaaucuagaauauauuaaaaaaagucuuaaaaucaacuggaaaaagaaagaaaacauacauagagcaaaaaauuuggacaaacauuucaaugaauacgaagaaugaaaagugaauaaauguaaaagauucucagcccaauuaggaauuugggaauuguaaauuaggaacacagugagauaacauuuuauaacuacugaauagcaaaacugaaguccaacagugcuaaggcuuaaagaagauauuuaauggaaaucuuuuuuuuuuuuuuuuuuuuuuugagacagagucucgcucuguugcccaggcuggagugcaauggcacgaucuuggcucacugcaaccuccgccucccggguucgagcuauuuucaugucucagccuccugaguagcugggauuacagguggccaccaccacaucuggcuaauuauuguauuuuuaguagagaugggguuuugccacauuggucagguuggccuccaacuccugaccucaggugauccaccugccucagccucccaaaguguugagauuacaggcaugagccacugcacccagcuggaauauggugguucuuaaguuggauaguagguucacauauguuccuuuucuuguuauacucuuuauuauauauguugcaaauauucugguacaugcaucaaauauuacauaauuuuuacauuucuguuuucagagcuaugguguuuucuaucaacagaagaaucaugaaguucauaaauuuggaaaggagagcuuuauuuuucauaaaggguugcagucugcaugguggccauuuugacaggcugggaaguguagccucgggccagaagcaggaaacaggcacuuggaggguggggagaguaaaacagagauuuaugcugaauagggugaccaaauauucaguaagcuacaggaggagucaugaaaguagaagcaugcaccugggcaggugagcuucaugccuuucuaugggacccauguucaaaaacuggcaguguuagcaagauccaaggguggaguuuuuggcccucugaugucagaaggugaagcagaggacaugaaaacucucacugcacauccuucauagacuggccagacccacucugugguugguggucucuuaucaggaagaagugcugguugguugguguguugaaacugcuaaagggaggggcagucaggagguugguugaaaucagcaauggagcaagucuuuccaaagggcugguuucuguuucucaucagagaaagcacuguuucuccacuuuggggauaugauuaaucuggauauuauaaguuauuuuaauccuuaccaaccugucagguaaaaacaguacuuuuaauuuucauuuuaaaaauugaauaagguuuaguauuggaaguccuagcuggagcaguuaggcaagaaaaagaaagacaagguauccaaauuggaaaggaagaaggaaaauaaucuguuugcagauggcagaauuauuuauuuauuuauuuauucauucauucauuuuuugagacggagucucgcucugucgcccaggcuggauggagugcaguggcgcaaucucggcucacugcaagcuccgccuccuggguucaugccauucuccugccucagccucccgaguagcugggacuacaggugcucgccgccaugccuggcuaauuuuuuguauuuuuaguagagacgggguuucaccguguuaaccaggauggucucaaucuccugaccuugugauccgccugccucggccucccaaagugcuuggauuacaggcgugagccacugcgcccagccgauggcagaaucuuauauguagaaaacccuaaagauuuuagaaaaaacuauuagaacuaauucagaaaaguuucaggacacaaaaucaacaccucaaaauuagucgcaugucuauauauuaacaaauaauccaaaaaagaaauuaagguaacaauuccauuuauaauagcauuaaaaagauuaaaauacuuaggaagaaaccuaaccaaggagauaaaagacucauacccuggaaacaacaaaacauugcugaaagaaugaaagauaacacaaauaaauggaaagacauccccauucaugaauuaaagacuuaaguugccuauacuaccaaaagcgaacugcagauucaaugcaaucccuaucaaaaucgcaauggcauuuuuuuuguagaaauagaaaaaauuauccaaaauuuauagagaaucucaaggcaucuugaauagguaaaauuuugauaaugaagaauaaaccaggaggccucaccucuccuaauuucaaaacacauuacacaucuguagcaaucaaaaugauguggcacugccauaaagacagacaaauaggccaaaagagcacccagaaauaaauucucaaguauaugcucaaagauaccaagaccacucaauggggaaaggacagucucuucagcaaauguuguugggaaaacuggauauccauaugcaaaagaaugaauuuugacacuuauaccauguauuagaguucuccagagaaacaaaagcaauaggauauauuuauguguguguacauaugaugggauauguauacacauuguuacuuacauguauguguauauauauuuuuggaauuggcucacaugauuguggaggcugagaugucccaugaucugcuguccacaaucuggagaaucagaagagcaguugguguaauucagagucugaaggccugagaaccaggaccucugauguccaagggcaaaagaaaugaugagcucaagaaaagagaauuugcccuucuucucccuuuuuguucuguuuuggucuuuaauggauuggaugaugucugcacacaucagugagggugaauuucuuuauucagucugauucaaaugauaaucuguucugaaaacacccuuacagacacacccaaaaguaauguuuuaccagcuaucugggcaucccuaagcccagucaaguugacacagaaaauuaaccaucacacacuauauacaaaaucaaaucaaaaugcauuaaagagcaaauauaagaccuaaaacuauuaaaacuccuagaagaaagcauaggggaaaaacuucaugacacuggaauuggcagugauuucuuggacaugauaucagaagcauaagcaacaaaagugaaaaaauagacaaaugggacuauaugaaacuuaugugccucaaaggacauaauagggugaaaagucaacccauggaaugagagaaaauguuugcaaaucauauaccugauaagggguuaauauguagacuauaucaagaacuccugcaacucaaagacaaaaaaucaaauuaaaaaauaggcaaucccagcacuuugggaggcugaggcagguggaucaccugaggucaggaguucaagaccagccuggccaacauggcaaaacccugucucuacuaaaaguacacauagcugggcguggugucacacgccuguagucccagcuacucgggaggcuguggcaggagaauugcuugaacccaggagguggauguugcagugagcagagaucaugccacugcacuccagccugggugacagagcgagacuccaucucaaaaaaaaaaaaaaaaaaggcaaaggacuugaauagacauuuauccaaauaugauauacaaauggcuaaugagcauauggaaagauauucaacaucaguaaucaucagagaaauucaaagccauaaugcaauaucaccucacccccauuacaauggcuucuauaaaaacaaaaacaaagcugggcacaguggcucaugccuguaaucccagcacuuuggaaggccgaggcggguggaucgugaggucaggaguucaagaccagccuggccaagauggugaaaccccaucucuacuaaaaaauacaaaaauuagcugggugcgguggcgggugccuguaaucccagcuacucaggaggcugaggcaggagaauugcuugaacccgggaggcagaguuugcagugagccgagaucgugccacugcacucuagccugggugacagagcaagacucugccucaaaaaauaaaauaaaauaaaaacagaaaauaaugcauauaggugaggauguggagaaacugcaacccugugccugauugguaggauuguaaaaugguguuaacagccauggaaaacaguauggcagucccucaaaaaauugaaaauauauaucaccauaugauccagcaauucugcuucugguguauuuccaaaagaauugaaagcaagguauugaugagauauuugcacauccauguugauaguagcauuauucgugauagcuuacaagguagaagcaacucaaauguccaucagugaugaauggaucaacaaaaugugauauacacauacaauggaauauuauucagccuuaaaaaaaaaaggaaauccuggcacauccugcaaaauggacauacauugagggugcugugcugagugaaauaagccagucacaaaaagacaaauauuguauuuugccaccuauauagauuaucuaaaguagucagauucauagaaacagaaagaguggugguuaccaggagcaggggugaggagagaaaaaggaauaguuguuucauagaguuuuagauuugcaaggugaaaaaggucuggauuuuuuuuuuauaacaaaaugaauuuaacacgacugaacuguacauuuaaaaauaguuaagaugguaaauguuuuaucuguuuuuuacuacaauuuuaaaaaagaaugagguugaacaucuuauguauguuucuuggccauuaguauuuuucucugaacuuucuaaauaugauuuuuaaauaaauaucuuuuaaaggcauguagaauaauauuaaguaaauuucccauuuacuuaauauuaucuuagaaaaauuagaaggaaaguuccuugugggcaggaauuaagguuuauauuucuuuuugccuucuuuacugcuuuccacugagaagauacuuaauaaaccuguugacucugacuuuuuaaagacaaaucagggauuguaggugaagucuaugagucacuuuggaagaaagauuuuauacuaagaucaaaauguaagacuucaaaguuuuccuuaguacuuuuucccaauagauaauaaauauugcuagaagaccuaaaguguuggcugacuaaaaugaauacuguuuucuuuuugaaaaaucaaugacaauuggggguaauuuacagauauuuuuugaauucuaccaccauacauucaaacaugauuucuaugauacuaaucucaaaguauuuuucaguugguuucauaaaaguccacauuuuuuuucuuuuuuuucagguuauucuggacuuuaugaagccauugaaaguugggauuucaaaaaaauugaaaaguuggaggaguauagauuacuuuuaaaacguuuacaaccagaauuuaaaaccagaauuaucccaaccgauaucauuucugaucugucugaauguuuaauuaaucaggaaugugaagaaauucuacagguaaguuaauauaaaauacuaaaauugggggaaauaauuauaacaugggaaggucuucuguuuucuauacuguuuuagaccugagaaagaucauugaaacccacaaaaguacucauagaauaguacuuuuuuuuuuuugagacggagucucgcucugucgcccaggcuggagugcaauggugugaucucggcucauugcaaccuccgccuccugaguucaaccaauucuccugccucgccucucgaguagcugggauuacaggugcgugcuaccaugcccagcuaauuuuuguauuuuuaguagagaugggguuucaccauguuggucaggcuggucucgaacuccugaccucgugauccacccgccuuggccucucaaagugcugggauuacaggcgugagccaccgugcucagccagaauaguacuuuuaaugugaacugaguaauuuuuaugucacaaaguuuuuuugaaguuugcccuauuuucaguuaaaaucaccacagucugugaauaguauuuuaugcaaauuuaaauugaacaguugagcaaaugagaaagggcuacagacucuagcaguuaaguguuuagacucuggacacagaugaauuuuguuagaaucauagcucaaccacuagcgguaugaucuugggcaaguuacuuaguuucucugaauaucuaucuguuuccuuguguguaaaauggaaauaauaauguuaccuuauaauaugguauuuucauaaggguaaugagauaauauauguaaaguacucauguaugucuugcacagaguauguguacaauaaacuuuaguuauuaugguuaguaaaagucauacaaauuccucaacccugaagaaaaauuuguuaauauuuuguuaucuguuuccaaauauugcuauaugccaauauacccauauugggaaugguugucaaaugauuauuuucuuaauauugcugaugaggauagguauaagaacuuagaggugaugagaaggcuuggcuugacauagugacaucauguguaaaggacaaagaugaaggaaaaaguaucuuaaaagacuguguuggauggggcaaaaauugucauggauaugacccacugagcuguaauguacaauggcuuuaaaucagauaguacaugacugacauuucuucaguaaaaauugauaaagggaaaacuuuugagauaauugaucaauaaacuacaguuaccuugcuuagauuugcucuacuaaggggaugauggcaggugcagagaaauugguggaaugccuucucagaucagacaaggaaaacuggcccaaaacuuugaaacuugcuuuggagaaagaaaggaacaaguucagugaacuguggauuguagagaaagguaagacacuguacccuccucacagcucuacuuaggacucgcucauuccaaccggucuuuuacaucccaucagaggcguuuuuccccucagauagccagagcuacaucucuaacgcgagaccagcaggaagcuggauucugggagggaggcaguuacuugccuacaaaauuaguuugguugcauauaaccccuaaaaauggacuggggaaaaccacucucauccagaauuagcccaucuggcccaaaggauuugaggaaggcaaaauccgaacucucagucuaaguuuagauuaucagagaaauagcuugagaauucuagaguuaaagguucaaacuccaggacuuacccccuuuucagaguugauuucuugacagacauugccugguucucuuacuggaagccaucuggaacugaauccgacgggugaaagaauugguugucauuaagugucugaacuaucauuugguuucuugaagcugacacucagcauuguuucaaaggcugaguuugguaaacaucugaauaucuggucuuagcuuuccuaggcuucuuuagaucauaaguuguuucagaaacuguauaaauacacaucugauuuaaugggucaagagucagucagaaaaggaagacaugaaugucugcuaaaucaugcucuuuuuuuuuuuuuuuuuuuuuggugcauacgaaucccuccgaggucuuguuaaaauguggauucugauucaguagggcaauacguuccacacuuugaguaauauagcucuaaauuacauuggaggucaacgccaaauugagauuuuaaacucaaaaugauucuuucaacuguuuuaaaaggugaaggggagugguugugagaaauuuuaauagaaguuaaaaaucuuaguguuaugaccauuuuguggagcuuucaccaucaaaacuauaaucagauuaugugaagauucuaagacuuuuuuggucuuaaaaagguauaaaagauguugaaacagaagaucuugaggauaagauggaaacuucugacauacagauuuucuaccaagaagauccagaaugccagaaucuuagugagaauucauguccaccuucagguaccugguauuguuuguccuuuuccauaauggugcucuucugguauuuggugugggggcuuguuuugcaguacccaaagucacagccuugugaaaaguuuuguaaggaaaauuaagaaaguaaagagaauuuauguuacaauagauacuuuuucuauauuuagaaugccauucucuccuaguucuuccacuaucuuuuuuucuucuuuuacuaucuuuuuuuucuucuucuaccacuaagaaaguaugggcgugucuauauuggaaaugcaaauagagucuucaccaaaacccaaugucuaugaauucccaaaucaaccuugcuuucuaaauaaauacuacuucuauuucugagucacuugcucaauuuccuuuuaggaucccugggcugcccugcaaguugaugaaguuagugugcuacccaaaugcgccuggcugagagguugaguaggggcugagauccagccugugucguuugcaacacagugcacugaggggcuguguccuccaagaggagcucccuuuugucauuuacacaaaggcacuguauaaguuagcuguggcccugugaggcccccuuaugcuucucaaagcauauuuucuugaugguuuuaugagaccggcaaguugcauaauaugccauaauaaaaaguuauguauaaaagaguaucaggaaggaaauugggauuaauaguggugguagaagaaaaaugauauuagaauaacaucauaaagagaaaaugugcagauuacgucugcaacugaauguuacaaguuuuuuuguuuuguuuuguuuuuuuggucauuucagaauaaaaucuguuaccccuuggaaaaaaaaaacagauacaugaauaugaguugcuuuaaauuuucugacacgugaagauucuugcaugccuuuuguuguuguuguuguuauuguuuuuugagacugagucucucgcucuguugcucaggcuggcgugcaguggcacaaucucagcucacugcaaccuuggguucaagugauucuccugccucagucucccaaguagcugggaccacaggcaugugccaccacaucugguuaauuuuuguauuuuuuuuggagagguggggauuucagcaugucggccaggcuguucuugaacuccugaccucaagugauccauccaccucagccucccaagugcugggauuacaggcaugagccacugcaccuggccuuuacaugucuuucgugugaguuuaauucacuuaaccuuuuagaaauucucccuuucucuaaaauggguagguuagacucaguagauaauuuccaaagucuuugcuagcucuuaaugauuuauaugccuaccuguuauugagauaaagccuuugauuauuuuuuaaaacuucugguuauguugagagaaaauaucauuugagaacuugaagaacgacaaagcauuauugcuccuuaauaagaaauugcuuugagaauccaauguuaacaguuugguuuucuucaaagaucgugggaggauuuguugcuuuuuucacauacagcauugccuuuaguagacagcuugucuuacccugaauggggccauucuuucuuugguuucuguuagccuuccaugauuguauaaaaaauaauucauguuuuuuuuuuuuucuuucuugccaucaauacuuugucacugagagaauucuguacuucaaauuaguggaaaagcuagaaugguuaccaagagaaaggauucuaaacuuucuccaaugaggaucuucuugcuggagucagaauuuguggacauuagacuguagcuauugccgugauuccucagagcaggaacuguuugguaauuuugcuccuuuuguauuccagaagugucugauacaaacuuguacagcccauuuaaaccaagaaauuaccaauuagagcuugcuuugccugcuaugaaaggaaaaaacacaauaauaugugcuccuacagguaagccuauugccauuacuuacauaguuuuucuguuugcuuccuuuuuuuucuuuuguugaauacugggacagaaugggcaaguuucaguuuuuuccuuguuccaugugucuuuugagaaaacuguccuaauauaauccuaauguuuuuuaugggauuauguaauuaauuaauuauguacauuaauguauuuaauguauuuucuuuaccuuucaugagaagguaaagaaaaguguccucuuuuagcuugcuuuuggguccuggcuguuggcaugcuacuuagggagcagcuugauauuuuuuagucauaguguaaauucuguaaucauuaacauauuuaaauuaucaauuaauuagucagcucagugguauuagaagagccaaaaauaaacaccuuuccagagaaauaucuaauauaugaguuacauguuuucuuuuuuccuuacauguuaaaagguuguggaaaaaccuuuguuucacugcuuauaugugaacaucaucuuaaaaaauucccacaaggacaaaaggggaaaguugucuuuuuugcgaaucagaucccaguguaugaacagcagaaaucuguauucucaaaauacuuugaaagacauggguagguauaauaguugcuucaacuucuuuuucuccagcuucauguaauugauguguuuucuguuuuguuuuugacaaaugauuuaaaaaaauuuauauuagauucagcuuuuuuauaauccagauguuaucccuucauggauucaagucuuuuuuguuagauguaccagaaaacuuaaacuccccugguuugcccuucuauggggaguaaaugacuucaggaauaaauuugauguuuacguggcacauuuaacuucuuuagugauuuuauaauuuauuugauauuauucuuuuacguacucuuuucucucuuagugacuuaaaauaauauauaguacuauaaauuacaacuagcuuggauuuauugaucucuuacuaugugucaggcucugugcuaaggacuugccuacagcuauucuucuuuuggacucagggagaauuuaaucaguugauguucugaucuagcauuucaucuuugugguuccuuauccacaucgugguuaguaauauggaauuucugucauuucccagguauagaguuacaggcauuucuggagcaacagcugagaaugucccaguggaacagauuguugagaacaaugacaucaucauuuuaacuccacagauucuugugaacaaccuuaaaaagggaacgauuccaucacuauccaucuuuacuuugaugauauuugaugaaugccacaacacuaguaaacaacacccguacaauaugaucauguuuaauuaucuagaucagaaacuuggaggaucuucaggcccacugccccagguaucuccaaagucagacgaaugcuucagaagagcuauaaucuuccuaacuccuauuuucuuacucuuauggccacacugaagauguccuucucaggucccaaguccauauuguacaacucauuaugaauuuuguuuccuuuauucauuuguucacuuaguaaauaugcauuaugugccuccaugugccauacacuguguguuaguaaaaacaaaaaaacgcccuaccccagcaggaaagaguuauaugagggguuguggaaacauuguaccauuucucagacaucuaaugauuuugaaugcuccuuacaggucauugggcugacugccucgguugguguuggggaugccaaaaacacagaugaagccuuggauuauaucugcaagcugugugcuucucuugaugcgucagugauagcaacagucaaacacaaucuggaggaacuggagcaaguuguuuauaagccccagaaguguaaguuggauccaauaacaagccuuugagauucuguuacucucuacuaccucuaguucagagccaucuagacgaauacugaacuuugacccucucucuguuuaguagaaaauauuuaaccuugaacuugaguaacagucacauuuuuuagccucucuaacugagcucucaucccaagcaauggaugaaccucagaaguggccuguagagagcaaacauucuuccucuuugcuuccaaaaaccucuuauaaauguacuagcaaugcaaaagaggugaugagagaauuuaggcaucagauagccaagagcugggcucacucagccuuuucccaugcucugugccuguguggucaucacuguuugaauauguauuugaucauuuuaguugaaauggaaugaucugaauucaugaugucacuccuccaaagaucagauaugauuuuuuaauaugacuaacaguuguuuauugauguuauuauuacacuaacccugaaaggaagagagggauacagaaaauauauaugacuucacccuugcucucugaguaguaugugacuguauuucugagguagaacaaauagacauguaauagggagugguguagauaaguuccuuuuugaaggcugcuuguaaguaaggauuuugauguaccugaucccaacuuuucagugucacauaugaauuucuuuacaauccgguuccuccugcccucugagcuucaucaccuccaaacauucauaaacccaaccauguugcauuccucugggcuccucaaucaugccgugugcuuucucucucccaccuuuugucugugcuuccuuuguacaucacugcucuuuuuuuuuuuucuuuuucuuugccaaguugugauggaauauacaugacuacucuugcuuucuucuuucuucuuccuguauuuauucuacaacucugacuucccuggaagaauuagguguuacuuucccuguguuuugugacacuuugcguguacuacuucuuuuuuuuuuuuuuuuuuuugagacagagucucgugcuguugcccaggcuggagugcaguggugcgaucucggcucacugcaaaccuccaccuccuggguucaagugauucuccugccucagucuccugaguagcuggaauuacaagcgugugccaucacgccuggcuaauuuuuuguauuuuuaguacagacaggguuucaccauguuggccaggcuggucuugaauuccugaccucaagugauccacccuccucggccucccaaaguguuaggauuacaggugugagccaccacacccggcuacacuuuacauguacuucuguuagagaacugcuacgguuaguuagccauguauauuucucucccuuaagaucacagcccuguauggagcaugaaguguguucuuucaacugucuauaaucaaagcauggcacauugcaggcaauuaauaauuaggcugaaauaauauauugauaaaugguaggaucagugugaauacugcugggagcuguguggggagggagaauaucaaagcacagagacaggguuagauuguggcacuugcagagacaugagagaugcccgccucaucagagaggagguaacaggacagccacaguaagaagcugguuaggccgggugcgguggaucacgcuuguaaucccagcacuuugggaggccaaggcgggugggucaccagcucaggaguucgagaccagccuggccaauauggugaagccccgucucuacuaaaaauacaaaaauuagcugggcaugguggugugcgccuguugucccagcuacuugggaggcugaggcagaagaaucacuugaaccugggagacggagguugcagugagccgagaucgcgccacuguacuccagccugggugacacagugagacuuggucucaaucaaaaaaaaaaaaaaaaaaaaaaagaagcuaguuagaccuacaccaugaaagacagguguuagaaucaguacaagaagcaacagggagccauugcauuuugagcauuuguuguaucaucuggaccaccugccaguuagccuggaaccuuagguuuuucagaggaaguaucaaaggcagagaaagguuuuagagauaccuacuuugaacuacaaucuguccuuccugaaaauauacucacucuuuuuuucuuuuucuuuuuuuuuugacgucucuaguuuucaggaaaguggaaucacggauuagcgacaaauuuaaauacaucauagcucagcugaugagggacacagagagucuggcaaagagaaucugcaaagaccucggugagauaaaucucauauuuuguguucucucuacuggggaauagccauuuauuguucacuaucgucuuuuuguguucuccuuaguucagacaaugucaagaccauauccagagguugucuuccuugauuauagguuauuuaggagccuuauauguccuccucuauucuuucuuucuuccuuuuuuuccuuuuaaauccaaaguaaguucauccagacacaugcaccugaaaaauaaccauacuuaagucaguucauugcuuucucuaccuucuaaaucagcuuucccuccugacuuuccuguucaccugaaugaaaccaccauuccucuacuggcucagauuuauaucuagggacaaucacccagcacauuucccagcauuaaaggagugcgacuagagaugggccaggggaagacagugaagggccuggauuugaauuuuauccuaaaaacaauggggaaaaaagugaagauuaaaacugauuagugacguaauaaagauaccagugaaugagaaggaccaaagagaggcaguagagauggauuggagaaggaaggagacacaugugagaugcuuccaacugugaguguuaugauugaauggcuaaacggauuuggguggggaugagaaaggggcaggaggggcugauuuccccccaggcaucuggcuuaggcaccucuaugaaugccagugggugguccugguaccaggacuagaagcagccuuggcagguacaagguuuugaguuuugaguuuuagggauguuaaaugugacgucuguaagacaccucauggagugucuccucucacacuuauuuugcuuuucucuccccuuuucuuucacaguuuaauuucuauuauaauuguucuaacagccuucuagcugauuuugccuaccucugcucucucuuccauucaaccucucaugaacuaguuagucuucaugaauacauuuuaucaugucccuguccugcuuaaaaacccuuugccuacaggauaaucuucacgccucuaaccugcagucugagcccugccugaacacccagguucuacuuaucuuuccaauguuauauucuacuacuucccuaccugaauccuuuugauuuagcaguuucccgaauguguucaugcauauguucauucauuuagugcuaaggaaugggcuaggugaugggaauacagcaugaacccuaagauacagccccuggccucagggcauuucuagucugaugguaagaccaaaauuagagaaguaauacuaauacuaaagcagcugguguggugggggugauaagguguguuucaggcacagggaauagcauaugcaaaggccaggagacuagaaagaguauagggacuuccauuaguccuguagaaugcugaaaggagaguggccagaaaugagaagcaaaagcaagcagaggccagagcauggggaggagugugugagcuggggcaggauuuuggcugcaggaccacuaaaggcuuuuaagcaguggggugggaugauuucucaucugcaauuuugcaaacucccucuaaccacuggguagaguauggguuagagggaacaaggcaagaggaagggagaccaguuuggagauugucauauuauccagcagcacacugaugugguuugaauuggggaaguagcagaaggauggagagacggugauggagucacgugaguuucuauuuucuuacuccucccaccucccguacccugccuccaccuuuuugccaguccgaauccaguuagcugcucaucucuaaacugcuuaggcuauuuuuacaccuacccagguucaaucaguaccuguuggcucaucuucuuuacugcuggccaccucgcuguagcugcaacuuggaaagaagcaugucaauacuacuuguuuggguagccuccuuuguuccuauuauugaaaaugaaugagugaggggaagaauuuaacccagaaauacagcucuugcuugugacuuuuguuguacugugcucuucaugaggagcccuggcgaacugauaccagaguaacucacagacucagcugcuugagaacacagccauagucuccucaucuuauccccagcacccuacacagagccuggaccacagcagaugccccagcuuugaaccaagcaacugaggcuuauccuaggagaugcacacagacagaugcaugugugauaagugucuuuugagggccgauucuaugcuuggcccugagaaugcugcucuggagaacaggaggcccaaguucacagcaaagcagaacauagggugaacugaguccuaaaucuccuccuugauuuuuuuuuuuuuuaagagucucacucugucgccaggcuggaguacagugacgugaucucgguucacugcaaccuccgucuccuggguucaagcgauucuccugccucagucuccuaaguagcugggacuucaggugcgugccaccacccccagcuaauuuuuguauuuuuaguagaaacgggguuucacccuguuggccagggugaucucaaucucuugaccucgugauccacccgccuggggcucccaaagugcugggauuacaggcaugagccacugcggccggccaaucuccugcuuuuauauauccuccucugaugaagcucuugagaccuguuauuuuuacuucuucauuuuuaaaggcaaaguuggguuuuucaugucuacuguuuuauuucugggcugcuuugguugucagcucauagagccaguagagcuugggcaucugacacauguggguuugaauuccugcccuuucuccacguacuugcugugugacuauggguaaauuacuuauuacuuggcuuuucugaacuucaguuucccaauauaugaaauguaauauguaucucauggguugugaaaauuaaaugaaauuaugaauguaagguacuuugauucuugguacacaguacucaagaaacaaucaaacacacacacacacacacacacacacacaaacaaacacacagaugcacugcuuaaaacucaagggagggaacaaggcaagagguagggagaacaguuuggagguugucauauuauccagcagcacagugguguuaucucaaugggggaaggagcagaaggauggagagauggugauggagucacaugaguuucuauuuucuuacuccucccaccucagguacccugcuuccaccuuuucaccagucugaauccaguuaaauaguuuuaacuagaugacuuaagacuauuucaggaggaauauccuguuugcagagaguaagaaagaaaauuaggccaggugcaguggcucacgccuguaaucccagcacuuugggagaccgaggcaggcggaucaccugaggucaggaguuugaaaccagcuugacaacauggugaaacccugucucuacuaaaaauacaaaaauuagccaggcgugauggcacacgccuguagucucagcuacuuagcaggcugaggcaggagaaucgcuugaauccgggagguggagguugcggugagccaagaucgugccauuguacuacagccugggcaucagagcgagacucugccucgaggaaaaaaaaaaagaaaaagaaaauuagagggugaggccuguuuauaacccuaaaugacugaccauaugagacagugaaaaacuuuuuuuuuuuuuuuuaacagaaaacuuaucucaaauucaaaauagggaauuuggaacacagaaauaugaacaauggauuguuacaguucagaaagcaugcaugguguuccagaugccagacaaagaugaagagagcaggauuuguaaagcccuguuuuuauacacuucacauuugcggguacguuccucuuuuuaagagucguauucuggucacagcaccuacugggaguggcaccguggaagccaagauaacaucaacuucucauccuguccucaagagcucacuuaggaaccuuuccagaaaguucuuaugaagcaaacuccaaaaguugucccauucaacaucaucucgauuuccuuucugaaauuucauacugcaggcaacaggacugaaauaaaggcucagauucuaugccaugccucuagcauuaacugacaugguuggaaaaaauugggugauugugagagaacauuauuccagauacaagaccaguccagugacagcaucuugaaagcucagcaaguggaaaguucuguugcuauguccugaagcacacauuucuucaccuuuggugacgccccaugcucagaaauccagguucucuggcucaccaagaaguuaaggaacuauagugacagcuaucaccucugcuuauccagccauugaaaauauauuaaaaugcauucaauuagcaugcauuuguagaauuuuaguuagcuuaguuguacauuugauggauguggucagggccaucauuuuggaagguacacugacaauuuagugauggcuucagauguauauagaaaucaagugaaauguuggaauuaugaggcagguugauguggaaguugauuuacuuuccuuauuuuuaaauuuugauauguguuuuucgugcaguuuuucuuuucuaagguaaaauucaauaauccaaagugaugauaauuaauguuacuagcuaauugaguuuucuuuuaacaguauuugguucaaagauuuuguuacauaacuguuagaggccauucaucuuuaaaaagcuaaguuggaauagauuugaaaagaaaaguuuucuuaaaacaauucguuaaauacaacgaauugaacuuaaauacagugaauguguuagacauuggaagcauauugagacaguuuuuacuuucaacagaaauauaaugaugcccucauuaucagugagcaugcacgaaugaaagaugcucuggauuacuugaaagacuucuucagcaauguccgagcagcaggauucgaugagauugagcaagaucuuacucagagauuugaaggugagugguguuuucagaggaggaagccacaguagcauucuuggugacuggaauggcaaaacaaacauguauugcauuuaauauauauaaacuuggggaugcuuagggaguuguccuggauguaggaagauggagaugguaggacuauuuagcuucaaugaaaucuaguaccuaugggaagagucuguugcuuauaccauucccuauuuagaagaaggaaaaacaagauuugcaaaggguguuucccauaugguucacagacaguagcauucuuuuuguuuaacguucuuuuuuaguaauuuuauaaagcuuuaaaaauaugaaaaaguguuuuaacgauauuaaaaaaaccauaauuuauguauacuuuuuuuuuuuuuuugagauggagucuugcuuugucgcccagggucaagugcaguggcucaaucauggcucacugcaaccucugccucccggauucaggcaauucucaugucucagccucccgaguagccaggacugcaggugugcgccaccacacccggcuaauuuuuguauuuuuaguagagauggaguuuugccauguuggccagauuggucucaaacuccugaccucaagugauccacccgucucugccucccaaaaugcuggaauuacaggcaugagccacugugccuggccuauauauauuuuuacauaaagaggaaaccaaaauggcacauaaucucacugccugcauaugauuaaaaaauagauauuaaacaaacaaaaaaaaguuuuccuucucccuguuuugaauucuuucccaaagguaauuagugcuaauaauuuugggguuuuuuuggccucuaccuaaguauuuacuguacauauguguaaccagugcugugcugguuaauauuuaacaacccacuagagaaaaaauguaugcauauauauguacauaagcuuauuauuuuauugauauagaggaguuauacaaaccacaauuuauaaauaaaaauaaacuauucuuuauuguaaauuccacauagccaauugguucucauagaaugcuuuuggugguuuuugcagauuuuuuguauccauggccaaccaaggguugcaaugacaaagaagugugguucuuucugauaugguuguugguauauaguuucauuaauguuagaagauaaagaugaaacaacaaagguguauguuggaacuucacucguuugccagugaugcaagcaauuuuuugcugaacuguauaauaguuuuucaaaaacugggagaauguuucucaauauuuugugcuauucaauguaauagcuaaauuuaaucuguauuauuauuuuuugaucauguucauaagucuaaacucucaacauaaauuaagccgggcaugguggcucacacuugucaccauggcacuuugggaggcugagguggguggauuacuugagcucaggagcuggagaucagucugggcagcauggcgaaaccccaucucuacaaaaaauacaaaaauuagcugagcauagugguaugcuccuguggucccagcuccuugggaggcugaggugggaggaucaccugagccuggaaggcagacguugcagugagccgagauugcaccacuggaccccagcuugggugguagagugaguccuuaucucaaucaaucagucaaucaauaaagcacugauuuuuuguguuuucuugauuuccaugguauaacugcucccacuguagugaauuccaggcuaccaacaugaugucauugaacuaguguuaaaaagagaugagcagcagcacaucauucuauaguauuucuaccauauagauaacaauagguguaacuaaccucaaaagcguagauaauuguaaaaaguaauaaaauuuaacaauuggccaggcaugguggcucacaccuguagugccagcacuuugggaggcugagaugggugggccaccugaggucaggaguucaagaccagccuggccaacauggugaaaccccaucucuacuaaagauacaaaauauuagccagauaugguggcacgcaccuguaaucccaguuacuugagaggcugaggcagaagaaucgcuugaacucagaaagcagagguugcagugagccaagagcgcaccacugcacuccagccugagugccaggagacuccaucucaggaaaaaaaacaaaaacaaaaaccgauaaaacagaaaccacaacaguugacucccauagucccauaguccgguaugaucuggcuguaacacaccccuguuuuauaacuauauguauuuuuuuucuuuuuccuuuuuuuugagacagaguaucauucucuuucccaggcuguagugcaguggugagaucuuggcucacuguaaccccugcuucccagguucaagugauucuccugccucauccuccugaggagcugggauuauaggcgcccaucaccacgccuggcuaauuuuuguauuuuaaguagagaugggguuucagcauguugaccagucuggucuugaaccccugaccucaggugauccacccaucucagccucccaaagugcugggauuacaggugugagccaccacacccggccugacuauauuuuuaaagaugggauaauacugaacauacuguccuuaccuugauuuuuuuaaccuuaaaauauuuuugguaucauauauaucauguacauagcucccuuauuaauuuucacagccacauuguauuaacaucagaugcauagcccaugaucuuuugaacuguuucccuauuguuggguacuuagguuuucuguuuuucuuuuacacccugaacagugguacagugaaauccuuggagaccucuuccauaauuuucuaaauauaacugugucucaaauucuuagauguagaauuauuggaucaaaagauguguguguauuauguuuugauauauauugccaaauuaccucuuaaaagguuguaccaauuuaaaacaguacuuacuacucauaaaauucuggucaaagauuuagagaucagcuguuugaacgauagcuaaaggucacaguguguucuaaauuuuuagaauuuauaagccauuuauaaaauguuucccauuugcagaaaagcugcaggaacuagaaaguguuuccagggaucccagcaaugagaauccuaaacuugaagaccucugcuucaucuuacaagaagaguaccacuuaaacccagagacaauaacaauucucuuugugaaaaccagagcacuuguggacguaagcuuuuuuucuccuuguagauaacaaauggacccagcacuauucauugaaaagauugggcuggguauggugucucacgccuguaaucccagaaguuugggaaaucaaggcaggagaauugcuuggggccaagaguucaagaccugccugggcaacauagugagaccucaucucuuaaaaaagaaaaauuagcuggugcugugcaccuguaguuccaguuacuugggaggcuaaggcuagaggauugauugaggcugcagugaucaugacagcguacucugcacuccagccugagcaacagagguagaaccugugucuaaaaaaaaaaaaaaagccguuuucucucuacggucaagaaaccauauauguguaugugugagucuguucugaguuucucuauucuguucugauuauauguuuauccuuauacuaauacucuaaugccucacuguguuguuuuuuuuucccccacuuagagacggggucucacucugucaccuaggcuggaaugcaguggugcagucauggcucucugcacccucaaccucucaaacucaagcgauucucccaccucaucacccucugccaccaugcgugggacuacagucaucugccaccaugcccagcuaauuuguuuauuuauuuuuguagagguggggucuuguuauguugccuagacuggucuugaauuccuggccucacauaauccucccaccuugcccucucaaaguuuuggaaccuggcuucaugcugucacuauguuagucacucuaauuguaaguauugauacuuguagagcaagcauuucuuccuuuuuuuacuuuuuaaauuuuagucauuuugugaguagguaaugauaccucauuagaguuuuaauuuucauuucacuaaugaguaauauggcugaacaucuuucuucugcuuguuagcgaucuguaacugccuuggugaggugucuguucagaucuuugaaaaccaaucuuuugaaaagauugguauaucaucugauugaguuuuugagaauucuuuuuauagucugacaaaaaaguccucugucagaaaugugauuugcagauauuuucuucuggucuguggcuugucugcuuauucucuugacaguaucuuuugcagauggaaaguuuuaaguuuugacaaaguucaguauaucaguuuuuucuuuuauggguuuuugccuguggugguauuaucucuaaaaauccuuugcuuaccuaaggucacaaggauuuucacuauguuaucaucuagaagcguuacagcuuuacauuuuacauuuaggucuacagucaauuuuaaauuaauuuuguauaaggcgugagguauugguugagaugcuuucuuuuuuuuuucuuuuuguguauggacauucaguuguuccaguucucuauguugacaagacuauccuuucuucacugaauugccuuuguaacuucugaaaacaucaguugacuauauuugcauggaucuguuucuggauucucuguuuuguuuauugauccauacauacaccucuucacccauuccaugcugucuugaucacuguagcuugauaguaagucuugacauggggugaugugaguccuccaauuuuuuuuuuaaagguuguuuuuagcuauguuccuuugccuuucuauauacauuuuagaggcagcugguccacaucuaugaaaaaaucugcugggauuuuauugaaucugaacacaaaacugaggcugggcaugguggcucacaccuguaaucccagcacuuugggaggcugaggcgggcggaucacuugaagucaggaguuugacaucagccuggccaacauggugaaacccugucucuacuaaaaauacaaaaauuagccuagcgugguggcuugcaccuguaaucacagauacuugggagacugaggcaggagaaucacuugaaccugggaggugaaggcugcggugagcugagauugcaccacugcucuccagccgagugauggagugagacuuggucuugaaaaaauaaaauauuuuuaaaaauacauaaagauaaaauuggggaggaaugacaucuugacaauauugaguguucuaauccaugaccauaguauaucucuuuauuuauauauggcuuccguauuaguuauauaaugcugaggaacaauuacccuaaaacugagugucuggaaacaacaaacaucuauuaucuuacaauaucugugagccaugaaucuggaaacaauuuaacuggguguuuccggcugaagaucucucaugaggcugcagugaaggugcuggccauggcuugacuggggaagguuaacuuccaaacuccucucauauggcuguuggcugaagagccucugaguucacucaugugggccucuccacagguccaucucacagaccagcagauggcuuccccuagagagagugaucccagagauugagauagagggugucuaauuuggaagccacagucauaacuucaucuuggaaaugaugccacauugcaucuguuguauuuuauucauuagaagcaagucaguaaguccccuucacacucaggggaggggauuacaugaggaucugaauacagaagguggagaucauugagggcuaccuuagagguagacuaaccagauguucuuugguuucuuuuaucaguguuuugucauuuucagcagauucugcacauauuuuguuagacuuauaccuagguauuaauuuuuugaugcuauuauaaaugguacuuuaaaaccuuuuuuuuuuuuuuuuuuuuuugagacagggucucacucucauugcccagguuggaguacacuagugugaucacagcucacugcagccucaacuucccuagcucaggugauucucccaucucagccuccccaguagcugggacugcagguguaaaccaccacacccagcuaauuuuuauuuuuauuuauuuaauuuugagacggagucucggucugucacccaggccggagugcaguggcacaaccucggcucacugcaaccuaugccuccccgguucaagcgauucucuugccucagcuuccugaguagcugagacuacaggugugugccaccaugcccagcuaauuuuuguauuuuuaguagagacaggcuuuugccauguugccgagguuggucuugaacuccugggcucaagugacucuccugccucggccucccaaaaugcugggauuauaagugugagccacuguguccaguacuuaaaaacuuuugaaauuccaauaguuuguugcuaguauguagaaauucaguugaauuauguauauugaucuccuguccugugaucaugcuaaacucacuuauucuacauacccacuauuuuugaacuuuuguuuuuucuuuuaaaaaugucuuagagauggccaggugcgguggcucaugccuguaaucccagcacuuugggaggaugagguggguggaucacgaggucaggaauucaagaccagccuggccaacaugaugaaauccugucucuacuaaaaauacaaaaauuagccaugcaugguugcugaugccuguaaucccagcuacucgggaggcugaggcaaagaauugcuugaaccugggaggcggagguugcagugagcgaagaucgugccacugcacuccagccuaggcgguagaccaagacuccaucucaaaaaaaaaaaaaaaaaaagucuuagagauuaaaccauaucagguuacagagaucuaugccauuuuaguuaauuauuacauagaguucaauuccaaaaugcuuuuuuucucagguuugucagucugaaaacuguacguguacuaacuuuaaauuuuuuucuuuuugcauguauuucaauauugaauuaauacaaaugauuuauaaggaguguccaauugauaauugcuuuucauuuucaggcuuuaaaaaauuggauugaaggaaauccuaaacucaguuuucuaaaaccuggcauauugacuggacguggcaaaacaaaucagaacacagguauuuauauauagugaauuagauuuaguggauuaugcauuuaagaauauguguguguguguauguauauguguguguguauauauauaauauauauuucaaauucuguuuuaauauauauuucaaguucuguuuuaaugcuucuaucagucaagguuuaaccacagaagcaaaagcaguaggugauuauacauauauaugagagguguguguuguauauguguccacauaugcauauauacagagauuucuugcaaggaauuuuacacaauugggcuggcaaagcaagucugaagcguguagggcagguagucaggaagagacuaucaggaacagacuggaaccccccagacaugagcuguuuggagucucugacuuuggagaaggccuaagccgucuuuuaaaaggcucaccugauuaggccaggcccaccuggagugaacucucuuuugaucugacuuaaagucaacugauuagggacuugaaucccaucgguaaaaucucuucagagcaguaccuagaugaauuacugggaacuguuguuuggccuagccaaguuaaugcaucaaaaagccaucacaaugcucaaaugccaaaaaccacuccaggcucuuuccuuguagacauugccuccucucauauguccugcagacaaagccaggguuguuuuuuaagucaugcuugcacgcauuaucauccugcucaaauuuucaaccaauagauuaagauugucuagaaauagaaauguucuauuucuguuuuauuguuauucuuuaagcaguagauaugcauagcuuuuguguauauuauguauuuuacaauuuuaaaaaguccaagcagacaauucugaaauccagcuagaguggucaaaggauaaaaggcugccuguguuauuaucugggaggauccuagguggcccgcccucauccugaccaccucacagcugugccccccaccccucagugacuggcacugacaagucuuccuauuuaguguuguuuauaauaagcacccucccauacccacccugucagucccuaguuaucacccucgcacuuucccuucaugucauuuuuaaacuucauaaauaugaaaaguagauucagaucuuaaaaaguggcucaccaaaugaagucuaacaccauauuuuugugguugggauucaaaguucucugcgaucugacuccaacaugaguccuccuugauuuucaaacuuuguuguuccuccacaaguagacacucaggaaauauuuucuuauugguuuguucauuuauucauccguucauucaacaacauuuauuuauaacuugugcugugccaggcauugugcuucugccauguagccuuccccaaccuccaaaaacugguagagagcuccuucuuccacauucgcauagcauccuuucugugcucaucauacucaauuauagcuucuuauuuauauuuuucuucuacaaaaugugagcuccuuguggauaaaaauggaccuuuuaaucauuauuuuuaucugacaagccauaauugcugaauaaauguuugacugaauagaugaauaaacuaagaaauuaaucacguaugaugucuguuccagagaugcucauuguuuaguagaugaugauggugaaaagaaauuguuuuggccuuagcaaaauauaucucaagauuugggcuggaaauauauuaggaaaaaauuggaacuuuuauuuauuuuauuuuauuuuugagacagagucuugcucuguuuuccaggcuagagugcaguggcacgaacucagcucacugcaaccuuccaguuucaagugauucucaugccucagccucccaaguagcugggauuacaggugcacaccaccaugcccagcuaauuuuuguauuuuuaguagggacaggauuuugccauguuggccaggcuggucuugaacuccuggccucaaguaaucugccaccuugaccucccaaaaugcugggauuacaggugugaaacaccaugccuagccaauuggagcuucuauaaauucuguuaacccugagguagagaccacugaaguauuuucuucacucaguuuaucagugugaacucuauagcuuuuaucgaauggguuaaacuugauuuaccaguaaauuaagacaauuuuagcugaauuuguuucuggucugauccucuuccuugcacaguuaagcuagaagaauugugaacaccuuuuuuuacaaaaagcugcauguaaacaagcaaaaguucaguuugcuaaauuuguauauuuccacauuuccauuucuuaauuuccuguuucaugaagaagcagguuaccuaaccucuucaugacuuacuuucuucaucugucaaauggaaaaauaauaauaguaccuagcugagaggguuaaugucaguagcaaaaucuggcucacugccugcuuaugaaugacucuugagcugagaaugauuuuuguuugaaaaaaaaucaaaagaauauuuuaugacaugugaaagguuugugcaauucaaauuucauugucuauaaaauaacuuuuugggggaacacagucaugaccauucauguauguauugucuguggcugcuuuccaacuauaauggcaguguuggguagcugagacagcaugacccacagagccuaaaguauuuacuauacaucuagcccuuauggaaaaaguuugcccacuucugguuuagaacaaugccuggcauguggugagugcucaauguauguuaaauguuaguuacuauucacauccagaacuuuuauguaaugguccacaaugcucaucauuuguuugauuuugguuuuacugagaauacauggauucaaaaauaacagaaaguauguaucuuuaaaaaaaguauucuggauaaagaaagcucaaaaguaaaaucaaaauaauguuuagagauugauuuuuaagcaacuuucugaaaauaaagcugccugcauuugaauuuucaugacuuugaaugguaaauaauucaaaaaccacaagggaucuuuuuccacaaacucuugaguccacugccagcuagguaauggaaaguaauauggauuaccuugcucuaccugccugagguggguccgcccugugagcagugaguggagaucaggugauucuacuaauagauaaacguagaugucuuuaggauccacacgguuugaagugcgcauauuguuugagccaccauuuuggguguccgccaugauuacacaaacugggugauuaucacauccaaacuucacacuguauucagacaauuuaaauuuagccuccacuaucgcaggauauuagaaggcaguaugugguugucuuagucaagauccuuucuuuuccccgauuaacagaaacccacuuacgcuagucuaaguagaaggggguguggcugcuaccgggauaauugggucuaccauagaacccgcaguucggaagugcacucgggcuuuguggacaauugcaauccugaauccugcacaucugcuucacaguuuucccuuuacagauugcugucucugcuucuccauucaugacugccccacaccuuccugauuuacuaccugucuccaaucccaauuucagauuccaagagggaagaauuggauuggcccaacauaguucaaaugcuuauuucaguccaguagcugcagccaggaacaggcuguguauaaaucaguguaaucuaauugcucuaacagacaacccucacgaucucaggggcagggcaaaauaaaaguuauagcucacacucacagauguggauagguaggggugggggcucugcucacuuaugcucccaaguguagauagguaggggugggggcucugcuccauccucuuccacuuauuguagggacccaggcuccuuccuuguuauggcucugucaucacagggggucuccaaauccuccacuaugaccuuaucugguccauugaugagaaauaacaagaacauggacaauuuuuaggggucugguuuggaagagacacacaugaccucugucuacaugccauuagugacaguuuagauugcgaaauauaauucagcugugugugccuagcaggagaaagaaacaagauuggugagcagauagcauugccucuuucauagagaaacauaauacaacuguauuguggguggguguggcagaaaaugauucuuaguuuguguauggggaggcagacaccccaacagugcacacuauuagggucuuaaacugaaguucaaggcccaacacugcugauagcuagcuugucaguuuaccucacuucuggaaccucaagccccucauuugugucuuuuuuuuuuuuaagauagagucucauucucuugcccaggcuggaguguaguagugccaucauggcucacugcagccucaacuuccccagcucaggugauucucuuaccuaagccuccugaguagcuggggcuacaggugugugccaccaugcccagcuaauucuuaaauuuuuuguagagauggguucucccuguguuaaccaggcugauuucaaacuccuaggcucaagugauucaccugccuuggccuccuaaaguguuaugacuauaggcgugaaccaccaugccuggcacgacccucguuuguuaaggggaaucagagcacuuacccuuugaccuauagggcuuuaugaugcucuggugagugagaagaugugaaaauguuuugucagcuauaaauucuuacacacauguaaagguguuacaauuagguguugauauuucugcaaaaaugucuauuucuuggauaauauggcuaaagccauacaacuaguaagucccccagagcugggauuugaacucagucuuguggcagagucugaguguuagaugccacccuaaauguccuuucugaaacaggcauaggaauagaucccacugccuagguguguugugagaucauggauauaaaguacuuaucacaguacuuggcauauaauaagcauuccauaauuaguagcuguuuuuucaagggggaaguucccucuuuggugaguuguauaaugcccucuuacucugacacaggaaugacccucccggcacagaaguguauauuggaugcauucaaagccaguggagaucacaauauucugauugccaccucaguugcugaugaaggcauugacauugcacagugcaaucuugucauccuuuaugaguaugugggcaaugucaucaaaaugauccaaaccagagguaagagaagcuuugaggccauuccuacauggauucuguuuugacugauuuauaaguguaugugucauucuggccuuucucuuuacugagccaugguugaguaugugaccaauggcacagugcacuuugguaucauuggcccuuaagguggcuacaguuuuguucacuaacauaaacucuacuuugauucuuacaaugaugcugcucacuugccuggcauugacugauauauuuauggaagaauaauuccaacuuggauugaagcuuugccagucaacauguaaaccuuucaugguggugcuggugggcugaagggcccccuguauucaagaagggauacuccagaguuguucugccccaccuggacuugacuagucuccuaacuauucuuuccuccuuuuuccuuuucuucuuaaaauuccauaaguacagcuaucauauuacuuuuccugaaaaacagcucgaucgugucacuuccuuguauugaaacaccagugguuccccaauuuacuugaugcuaaagaguuuccaaaauccaacaccuauuucauuccaacuuuauuucccauucuucccuuuugugcauuauccacuuccgccaaccugacuuccucacuuauugcuuguugacggaacugcucagauacugcuacucuucauuuuaccucuuccccugccuccauaucaccugacccuaauccucccagcuggcaaaaaucucucuuuugaacauauaaagccuauaaccuuuuauaucugucuuuguaauagcacuuaaaauuuuccaccuauguuuugcugguuaugaagagaucuuauuuccucauugucuagaagguucuugaaggagggccuguuuacugcucaucuuagagccaucacagugucauacuggggguucauguagguaucuuuaaagcaguguuucugacaguacggcugucuaaucacccugcauuguugagacccugagaaagccagccuaaggugggcuccuaguuuuuccacauauuuaacaugcaggugcacaccugcauuugagucuuuuuuuuuuuuuuuuuuuuuuuuuuugagauaggucuugcucugucacccaggcuagagugcagugguguaauccuagcucacugcagcuucaaacuccuggguucaagcaauccugccucaugaguucacucuuuaacagcucaacuuuccugggaagugggauucagugaaccaaaguugaauuuuaggaguaccucuauuuguuuaccuauuugcagauuauaucagagcuuuaagucaaaaacaccaacuaaaauauuuauuuucuaauaggcagaggaagagcaagagguagcaagugcuuccuucugacuaguaaugcugguguaauugaaaaagaacaaauaaacauguacaaagaaaaaaugaugaaugacucuauuuuacgccuucagacaugggacgaagcaguauuuagggaaaagguaagucuacguuauucuuccagcaucugaccauaaauaacuaucagggaaugugaggaggaugguugguaucuuuuaucauauugcuuagaguguuauauuacaacaaaaaguuuauacuuagugaauauuaaauucauucuguuuuuaaaugucaaugagguuaaauuauauuuaauagugcuaauaacugaaguuauguuuucagaucuaaaaggcaaauugagcuaggauuucucuaguugacaguucaucucgaggacuauauccuaauacuggaaaaaacagcuguucuuagucucuuccuuaaaucucucuccaaagaguccucagagaaaagcuccuaggucacugugcagguauuggaaugucuuuuuauagcuguggacaaugauauacaccuuggaaugggaugccuauucagaucaaccucuuaguguaaugaccuucauuucauuguaauuuccguaacacagaaacaugaaaucagauuggagaaagucaagaaacacauacccauacuuucuccagacccauugcagagauuuucaucucagaaucucuggaagcaugaucacugcagggcuaggggagagcuuuaacacuagaauccaugguucaaaucccaguucuaucaguugcaagaugugugaccucaggcaguugcucugucuuuuaaauaaucaaucuccucauguaaaaaguggggaaaauaauaguauuuaacucccaggguggucaugaggauaaaugagauguaugcauugcaucucuuagcgccuggcauaaaauacgugcccaagaaaugagagcuguuacuggacagaagugugagacauaguuuaacuucaugaagaugaaccuuacaguuuaauagaccaacuccauagugucuauaauuuuaaaaagucauaaucucugugcuccaaaaaguauugaccaucaauuaucuaaagcagauuaacacuuauuuuaggacacaaaucaaaacuuugucaauguuuacuagucuaaaaacauuuuucuuccuaaagcugggagauuaaguuaucuagaaccaccucuuccacauuuucagugagaagaauugcagggaaauuauuuaguuccucccuuaguuuuacuggggaugggauucucuauucucucuucacugagccaccuuuccauuuuguaaaauauauugccaauacacguuuuaaaaccacgaguuuuaauagccauggcauaauuuuuaucucuucuccuaggugacaagcuacuuagacucaugugacagaagcaacagaguaaaagucuguugaggaagagagaggcuagaccagauguaggcauucuuuuguagccagcacaccaggauaaggaguggggugaggaggaaauggguuaaguaucuguugaaucaggcuauguaauagcauuugggguucccguaacacuuacagauagauaggcagagaugguagggaacaagaagcccuauaaccaguguagcugggaguuacuggcagcugggaagccugaguuguguugguaucccuguccuaucauacaugaccaggcccagcugcccugcucaaaggggaaggauuugcuuucaaaggcuuaguaaaggccgggcgcgguggcucaugccuguaaucccagcacuuugggaggccgaggcggguggaucacgaggucaggagauugagaccacggugaaaccccgucucuacuaaaaauacaaaaaauuagccaggcgcggugacgggcaccuguagucccagcuacucgggaggcugaggcaggagaauggcgugaacccgggaggcagagcuugcagugagccgagaucgcgccacugcacuccagccugggcaacagaguaagacuccgucucaaaaaaacaaacaaaaaaaggcuuaguaaaaguauaacgagguagggaaaaucuuauauucuuaagacuaaagggaauuaugguucuaggggugagccccccuuuugugggugcuuugauaaggguuugggguuuggguuugagcauccuggucccuguauauggguuuuaacggaaggaaggaacucugcagaacagagggcaaaagcuuggagcucuuuagggcaaucugcaagaacaggaaagggagagggaugagcagaguacuggcagacugcuuucuuccccagcgccccagcuguacuguccauugucuguguguggccugcugucacuagagcacuccccaucccccgccccagaauucucuggucacucugcagccaucuuaacauguagacagcccagagguauccaagaacugauuuccaugguggacgcuucaggauuuggugguguuucauucuggaggaauaagggaugaacgguaugacaguugugguugugaagguuuauuugaaaucagaaugaggaggaagcuguuuuucuuuccucauggagcagagaauaaagauggggugaaagaaaguucauucugaacaaagaacuuccaacaugcauacccaugacuacacauaauuaagauaguuugcuuuucuccaccucaguguguggagcuaggcugcuucuuuagccacagguugcaugggugaaggucaguaugccauagacuuaacuuaugauugguugagccucuuuacccaguuauugauuuuuacuuaguuuuaaguauagcuguaauaguuuuaacuuauuaggauuuauaccuauugccuagaguaacacuuaaaauauuugagauuauuaguauuuaauugaauuucaguauauaauugaauaccauuauaagugaauuuuuuuaaaaaguuggaugccugaaaggcaagguuauauuuucaccuucuuuccugguaaccucuauucugcuuaaguagugauuagaaccauaucugaaaaagaaauuaaaaaagaaaauuaaaauugcucauaggaaaauguguaucauauaacccagggauuucaauucuagaaauuuguccaaaggaaagaaugggauaaauacauauaauguaacaguuuuacaacugaaaaauuggauuaaaaacaggaggccuggacacccuuuauuuuuacaaaaauaaugaagauaauuucaggugggauggggccaagaaguggggaaggggaaauuauauuugguuuuuaauuuuuuaauuauuucuuauuuauuuuuuugagacagagcccaggcuggagugcaguggugugauauuggcucacugcaaucucagccucccaagcagcuaggacuacaggugugugccaccacgcaucacuaauuuuuguaguuuuaguagagauggggcuuugcuaugucgcccaggcuggucuugaacucuggacucaagugauaugccagccucggcauaucccaaagugcugggauuacaggcgugagcuacugugcccagccaguauauuuguuuuuuuaaaucaaaacauucuaggucuagcugggcaugauggcucacgccuauugcgccagcuacaugggaggaucauuuaagcccaagaguucaaguccagccagggcaacauaguaggaaucuaucucaaaaagggggagugggggaaaggaagccgggugugguggcuuacaccuguaaugccagcacuuugggaggcugagguggguggauaaccugaggucaggaguucaagaccagccuggcugacauggugaagccccaucucuacuaaaaauacaaaaauuagcuggaugugguggcaccugccuguaaucccagcuacuugggaggcugaggcaggagaaucauuugaacccaggagcuggaaguugcagugagcugagauugugccacugcauuccagccugggugacaaaaugagacucugucucaaaaaaaaaaaaaaaaaaaaaagcuagaucuaauuuuuuuuuuauauaaagcaaauuugaauuugaagugguaugguaaucaauauauuaucuauguaugauccguaaccaauuaaaagauauaagggggagggagauuuccauucgcagugacaauaaguguagcucaugcauguagaacacugacucuccaacagucccugcaaaugcuuuacuuacaucaauaggcuuuacagcaauccauacaguagugccuccuaugucauuuuauaggcaggaaacugagacuugaauagcuucagugccaguagaucacacagcuaguucaugguagaguugguagaacccaucuguuucaccauuacaucuaccagccuaaucagaaaaguuugaagcagaaaugaggacaaauaaaaaaauuuuacugggagauauuaagauaaaagaaaugccaugcucuugaauggaaugacugaauauuuuaaacacgugcauucaccccaaauuugcuuauucacgugucacaaaccauauugaaagcauaaaugauacuuuuaacuugauaaaaugguucuagaguuuauauaaaauaauaaauagaugaaaauagcuauauuucuagaaaaauaaaaauggggguagcuaguaguuucguauugauaaggcaaucccuaaugaauggagauugccuuaucaauacaaaacuacaagccaccccauuaacauuuucauggcucuuagcauaagacuagccuaacagagaagaggcaacggugaugggcauuuacccugugcugggcaggccugagcagucauaaacucauguuaucuccugacaguccgugaagcagaugcuauugucccauuuuguauguaaagaaacgaggcacuugccccaaaucacauagcugcuaagugacagggacacuauuugcaccuaggcugucuggauccaccugggacacgugaaagcauaaucugauauggagaggcgccaccauaaaccauaaaccagugggacggacagaaucuuccauagaagacauggaggaaaucaguguguucuuucuuccuucaugaggcuucaggguuccuuuuaucauuuccucuguuuagaaaacuucuuuuagccauucuuuuaggguaaaucugcugaugacagauucucaguguuccuucaucuaagaaugucuucauuucuccuuuauuuuugaagguggcauuuugcugagucuaggguucugggguggacuguucuuuucuuucagcguuuaaaaaauauugugccacuuccagguagccuccaucguuucuaaugacaaaucuccuguuauucagacugauuucccccuauggguaaggugucauuuuuuuuuuuuuuucuggcugcuuucaagauuuuuuucuucaguuuucauaaauuuaauuauaaccugucuuagaguguuuuuugaagggguuuauccuguuuggagcuuguucagcuucuugaauccugguugauguagcuuguuaaauuugggauauauuuggaggucauuucugugaauacuuuuuaagcccugcucuuucuucacuccuugcagaacuccagugccaugacaucauuuuuuauaguccuacggguccuugagacuuugcgcuuuuuuuuuccccaguguauuuuuuuguuguucagauuggguaauuucuguuguucuuucaguucacugacucuuuucuuugucccuuccauucugcuauggaaagcccauccauugaacuuuuuauuuugguuguaucuuucaguucuaaacuuuaugucuuccauuucauuguugagccuuuauguuuucucuuuauguuucaaaaguauuuauaauugcccaucgaagcaucuuuauuaggugcuuuaaaaucuuucucuucucaguguuggcaucuaugauugucuuuuuuuuucauucaguuugagaucuuucuguuuauugguaugaagaguuuuauaauaucauguccaugguucuaaguuggaccauguucuuagccaaggccuagauuuugaauuagaauacaaucauacuauacauaugcaacaauauucccuguggcugaaggggagagagaaaaaagguuuuagauguugggggcuguauuagucuguuuucaugccacugacaaagacauaaccgagauugggaaaacaaagagguuuaauuggacuuacaguuccacauggcuggggaggccucagaaucacggagggaggcagaaggcacuucuuacauggcagcggcaagagaaaaaugaggaagaagcaaaaguggaaacgcugauaaacccaucaggucuugugagacacaaucacuaucauaagaauagcacaggaaagacuggccccccaugauucaauuaccucccccugggucccucccauaacacgugggaauucuguuaagauacaauucaaguugagauuugggugaggacacagccaaaccauaucaggggcucuucugccuguuguaucacucacugaguuugugccugcaaauggauauaauuaugccugaaacagcgcauauuguauaucugguacagguuuuguuuuuuuucccaaguuuugccaaacacuaaaguagaaagcauaguucauaugacuauucuauggacaucuuuagugcuuuuaugagcauuuuugaugaagaaauugaaagacuaauuggaggccacaauuaagcauugacuaauacuaaguuaggagaaccaauaaaaucugugauuuuacaaagucagguaccauauguucauggaaguuguauaugaaugauuauacaugugcgugcauguauauguauuguacguaucugugccuguuucuugcuauauauguuguacucaaauuacauuugcggucuuucuuuuugcauuagauucugcauauacagacucaugaaaaauucaucagagauagucaagaaaaaccaaaaccuguaccugauaaggaaaauaaaaaacugcucugcagaaagugcaaagccuuggcauguuacacagcugacguaagagugauagagguaagcugccuuuuuacaaagugccuggucauguuuuagcacuagcuacagcuuacuguuggugaaauauuuauaauaaaacuacuauuauuuccauuguuacuguggccaugaucuguguauuuaaaaaaagcuaagaagugaaaaaaaaauacuaaauguucaauaauaaagaaauaguuuuuggccaggcauaguggcucaugccuguaaucaaaacacuuugggaggccaaggugggcgaucacgaggucaggaguucgagaccagcccggccaacauggugaaaccccgucucuacuaaaaauaaaaaaguuagcugggcguaguggcagguggcuguaaucuuaguuacucgggaggcugaggcaggagaaucgcuugaaccgggaggcagagguugcggugagcugauaucgcgccacugcgcuccagccugggugacagagcaagacucugucucaaaaaaaaaaaaaaaaaagucaugcuaaaugcaaugacguguccuggauuagcuccuggaacagauaaaggauacaacuagagaaagagugguaaaaucuguaguuuagauaauaguaauguacugauguuaauuaucuugguuuugacaaaugugcugugguauaugagauguuaacauuuggggaaacuggguaaaggguaugcagaaauuuucugggauaucuuugcaauuuuucuuuaaaucuaaaauuguuccaaaguaaaguuuauuuuaaaaaauuaugaaguuuauguaguauaaugaaaaacugcuuacaaacuaaugguaauaaggaaaaaaguaaccagaacacagaauuguaaagaugcuacuuuguagcugugugaaacaacagcagcaaauacauucauugucauugucaagagaaaaagucaaaaaaccuaccuugcuacagaaaaacaaaggcuaggggaacuauaccaaaauguauuaauauuuugguggugagauuccaugacuuuuuuucucuuuuccuacuaccuuauguuuuccaaacauuccuuuugggcuauggaucacuuuuauaaugaaaacaaaauaucuccuuauuuguaaaaugugacaucugcagauuagccuucuauugcagccuuauauuucuuucuuaaaacuuucagagaaaggguuagaaaaaucuccaaagagaaauaugggguauaacucuugcauggggggcacaguggaggggcugggcuggcucagaugaggaguuauuacuucaggauguuccguucgucuucagaaagcagaaaucucucaucagcucagcuguuugggcaaaaagccuauuaggagucauauugcuaaguucccuuaccuuucuaagucugcuucuuuagcuguaaaagguccuuucagcuccaauuugggugauuguucuacuaaaaauggcccuuuuagacccuauguuuuccugagggacuaguauguuggaucugcauuuguuucugagcuguuuacucuaaaguugacucuagguggggccuguggacacauuagucccugaccuucuucaauugcaucuugaccuuggucguuuucccuguauccuuuggauugugccugccagggccacuggugaacuucagcuucacaaauuuucagcaaacaucgcuucuguuuuugaauaaugaguaucuaccuucagaagcuggguuaccuggaaccuucuuaaucuucuucuuuaugaggugcccaguguccucacuugcaaccccacccugccuguagaggggagucaggugcauggauccucuggacuuugggugaaucuauuuuuuuuuuuccuccaauuguaaaauaagugagacccaccuguucuuugccucagauuauugugggguuuucuuuuuuuuuuuuuuaaaucacaauuauguacugguucuaacguucucuuuuguguguuauuccaucccuucaucuguaggaaugccauuacacugugcuuggagaugcuuuuaaggaaugcuuugugaguagaccacaucccaagccaaagcaguuuucaaguuuugaaaaaagagcaaagauauucugugcccgacagaacugcagccaugacuggggaauccaugugaaguacaagacauuugagauuccaguuauaaaaauugaaaguuuugugguggaggauauugcaacuggaguucagacacuguacucgaaguggaaggacuuucauuuugagaagauaccauuugauccagcagaaauguccaaaugauaucagguccucaaucuucagcuacagggaaugaguaacuuugaguggagaagaaacaaacauaguggguauaaucauggaucgcuuguaccccugugaaaauauauuuuuuaaaaauaucuuuagcaguuuguacuauauuauauaugcaaagcacaaaugagugaaucacagcacugaguauuuuguaggccaacagagcucauaguacuugggaaaaauuaaaaagccucauuucuagccuucuuuuuagagucaacugccaacaaacacacaguaaucacucuguacacacugggauagaugaaugaauggaauguugggaauuuuuaucucccuuugucuccuuaaccuacuguaaacuggcuuuugcccuuaacaaucuacugaaauuguucuuuugaagguuaccagugacucugguugccaaauccacugggcacuucuuaaccuucuauuugaccucugcgcauuuggcccuguugagcacucuucuugaagcucucccugggcuucucucucuucuaguucuauucuagucuuuuuuuauugaguccuccucuuugcugaucccuuccaaggguucaauauauauacauguauauacuguacauauguauauguaacuaauauacauacauacagguauguauauguaaugguuauauguacucauguuccugguguagcaacgugugguauggcuacacagagaacaugagaacauaaagccauuuuuaugcuuacuacuaaaagcuguccacuguagaguugcuguauguagcaauguguauccacucuacaguggucagcuuuuaguagagagcauaaaaaugauaaaauacuucuugaaaacuuaguuuacuauacaucuugcccuauuaauauguucucuuaacgugugccauuguucucuuugaccauuuuccuauaaugauguugauguucaacaccuggacugaaugucuguucucagaucccuuggauguuacagaugaggcagucugacuguccuuucuacuugaaagauuagaauauguauccaaauggcauucacgugucacuuagcaagguuugcugaugcuucaaagagcuuaguuugcgguuuccuggacguggaaacaaguaucugaguucccuggagaucaacgggaugagguguuacagcugccucccucuucaugcaaucuggugagcaguggugcaggcggggagccagagaaacuugccaguuauauaacuucucuuuggcuuuucuucaucuguaaaacaaggauaauacugaacuguaaggguuaguggagaguuuuuaauuaaaagaaugugugaaaaguacaugacacaguaguugcuugauaauaguuacuaguaguaguauucuuacuaagacccaauacaaauggauuauuuaaaccaaguuuaugaguugguuuuuuuucauuuucuauuuguauuuuauuaagagugucuuuucuuaugugauuuuuuuuaauugcuauuugauaugguuuggcuauauguccccacccaaaucucaucuugaauuauaauccccaugugucaagggagggaccugacgggaggugauuggaucacgggggcaguuguccccaugcuguucuugggauagugaguuaguucucaugagaucugaugguuuuauaaguguuugacaauuccuccuuuacacacacucucucucucaucugcugccauguaagacuugccugcuuccccuucugccaugauuguaaguuuccugaggccuccucagccauguggaacugugaaucuauuaagccucuuuucuuuauaaauga

SEQ ID NO: 191360 - RNA, 29036 nt, Homo sapiens
gacgucaucccgcagcgccggaagcggugaggcacagaugaguaacgugaauuuguccgucuccgacuucuggagguaaggcggucgucagccuaucucuucugcuggcugggcucaaugccgcgggugagcguucggccgaggcugcuccuacccuugagugaugugccuugaaugacgcugcuuucaugcgcugcucucacggcugcuuucuccguccuccccuguuacuaccuugggcuguuucagcgggcgcucgcguuggucuucgacccacuuugcguuuguucacgugugcucccgacaccuguauguaccuuggucgcaacacaagccgaaaaaauauuagagaaugggcccuguccaaccaaggaggcggcccagcuugucgggaagggcagcguuuccgccagaaaugcuucgugaaaggcacuugagggaccuuagcagcauccucaacaggccuuguagggaaugccagaagaagcaguccuuggccgggcgggguggcucaugccuguaaucccagcacuuugggaggccgaggcgggcggaucaccugaggucgggaguuccagaccagccugaccgacauggagaaaccccgucucuacuaaaaauacaaaacuagccaggugugguggcgcaugccuguaaucccagcuacucgggagggugaggcaggagacguucuugaacccgggaggcggaguuuguggugagcugagaucgcgccauugcacuccagccugggcaugccaagagcgaaacuccgucucaaaaaaaaaaaaaaaaagaaaaaaaaaaaaagccuuuccccauacauaccagugauaguggcuuaacaaagcagggauaaaauuucuauuuggaauugcugugaucuagguuuggaacuuuuggggauuguucauaugugagacaauacagauuugugcucguucuucuuaguuacacaguuauuacuuucuuuuuuucuuuuucuuuucuuuucuuuuuuuuuuuuuuuuuuuuuugagacagagucucacucuguuacccaggcuggagagcaacggcgugaucucgccucacugcaaccuccgucucccggguucaagcuaucucugccucagccucccaaggagcugggauuacaggcgugugccacgacgccuggcuaauuuuuuguauuuuuaguagagaugggguuucaccauguuggccaggcuggucucaaacuccugaccucaggugauucgccccccucggccucccaaaguguugggauuacaggcgugagccacugugcccagccgcaguuauugcuuucaaaugaucuuuuuauauguccacagcuccugcuugcccuaccuucgcuauuaacaagagugauaauaguguugaaugcuuuuuaucagacacugagcuuuacauacuuuguccuuuagcucuugugacaaccccaugguguagagcaauuguuaauaccgcuugacacuugagggaaugaaggcuuggagagguuaaauaacuugccucaagucacacagcgaguaggugguagaaccaauguuugaauucaggcaguccaacuucagagaccuugaucuucgccacuguucuauauuguuuuucuucgacuguccauuaagcucccagacaccuacucuuuguuaccuuuuauuuuuauuuuuauauuuuuuugagacggagucucugucgcccaggcuggagugcaguggcgcgaucucggcucacugcaagcuccgccucccggguucacgccauucuccuggcucaggacuacaggcgucuaccaccacgcccggcuaauuuuuuguauuuuuuaguagagacgggguuucaccguguuagccaggauggucuugaucuccugaccucguaaucugccugccucggccucccaaagugcugggauuacaggcgugagccaccgcacccggccuguuuguuaccuuuuauuuuauggagaaaauuagggucaugagaugugcuuucccucacauuucugccucugcuuucccuuuuaaagucaucaagauuuauacccuuuuccuuuugucucagaggaugaauugucucucuaaucagagcaguuucuuuauguuugcuucugauauuuuaugcugucacuuaugagaccuuguuuucauuugucauuucuguuuccagucguguauaaacaaggccagguuucucagaucucugacacuucccguugccgaagaaagaaaaacuccuuggugguccauuauaacuuuagcugucauccaauaacuuucuuucucuuuauauccaaacuguuuuagugaguauucugaacucugccuccauuuccucaccuuuuguuuccuucuguaucuagcucucagacccaucauuccccugaaauuucaccccaaggucaccagugacuauugucaaaccagauaaaaauuuuuugauuauuacuggaucucuuugcugcuuuuggaacuuggucaucccuuuacucccuucuucuuugcuuuacgugucagugcucucagaugauuuauucaacaaguauugauugggauacagagaugaacaagacagauaaauuguuuucucuuaaggaauuuacauucuagcuguucuccaugugccuuucuuaccagucauuucugcuauggguagucauuuuccuccuucccuaaaauguuggguguuucuguuguuugugacuuuggcauauaaacaaugaaaaacuguucuuuuuuuuuuuuuagcuugaccaauuuuuuuuuuauacuuuaaguucugggauacaugugcagaacgugcauguuuguuacauagguguauacuaagugccauagugguuugcugcacccaucaaccugucaucuacauuagguauuucuccuaaugcuaucccuccccuagccccucacccccugacacgccccagugugugauguuccccucccucugcccauguguucucauuguucaacucccacuuaugagugagaacaugugguguuugguuuucuguuccuguguuaguuugcugagaaugaugguuuccagcuucauccaugucccugcaaaggacaugaacucauucuuuuuuauggcuguauaauauuccaugguauauaugugccacauuuucuuuauccagucuaucauugaugggcauuuggguugguuccaacucuuugcuauuguuaauagugcugcaauaaacauacauguggaugugaagcuugaccaguuuuuauaaaaugauuauaccuaugugaccaccauccagauuagguuacagauacauaauauuaccagcauucagaaugaaaacuguucuuuucauucuguacacauugccugagugaacccaucagcuggcuugguuuuaacuaccuccuacaugcccccaaauugaaauugucagcuuagaccucucugagcuuuacccucacaucugacuauccuccuggacagcucugccugcaagucccacagacacuucaaauucagaugacugaaacugaacucagugucuuuccuggacuuaacucuuaucacauucaucacuaaguccugauaguuuuacccccuaaacaucucucaaaucugugcagucuucuccaucucuacuguuguccuuuuaccugcaauaucauggccuucuaacugauuucccugcuucuaggccuguucccccauaucuuuucuucacauuacuccccuccacccccagauggucuuuggaaacaagucuguaucaaauuccugcuuaaucuuuaaagaucuguccaugcauucauccauucuuuucucuaauucauucagcaaacauucauugucuacuggcuugcaaaauccauugaaaguucuaaaguuugagcuucucagccagggcucugccuguucugaacccugccuguaucuccagccucuucucugccucaugcuuuagguuccagcaacacugaauggcaucuucauggguacugugcuauuucuucuuuguguacuugcccuuguucucuuugcuuggaaucuucucccuguuuccuuucuccaccuccugcuccucaccuaauuaggcugcuccuuuucaccuaauuaacccaguuuauaaaugggacucaguuauaaaguuuagguccaccuccuccaggaaauuuuuuccugacaccuccuuccucccaaucucgguuggguacucuagcauugugcuuccacccuuugcacagagcaaucaucauguuuaccacaucuacuauuaacauaauuguuuguguuuuucuccuccacaagauuuauuuuuuuuagaugagguguugcuguguugcccaagcuggacuugaaccccuaggcucaagcaauccuuccaccucagucucccaaguagcagggacuacagguacgugccaccaugccuggcuaaggcugaguuuuuugaaggcugggcucauauauuaucucuuuauucccaguacuagaauggcacaagauacacaggaguguaguaauuuugacugaacgaucaaaugagugaagccaaaaguuauaugaugcagugguuaagaacccauucuuuggaauucaaauuguaguucuggcacauauuggcuaugugacuugaacauguuacuuaucuucucauccugaauuuucucuucucagaauggaguugugaguguuaaaaugagaccauguaaguaagacauuuagcauagugccuagcacauaguaugcacuugauaaaggugcugaaaaccgggggauccuggaguaaagacuaggccuggcccaggacagugaucucccgaaaccccuccucauuguuuugugaaugcguaggcagugaugcagucuguuagcagggagauuauaaucuuguuuggaaaguagaauuacauccacauuaaacagucagagaacugugaagguaguuugaccacauccaauaauaagauguagagaagagaagacagcucaaugaaggcuuuagggaggaggugaggcuugaaaguuaaauaggauuuggguuuuaggagaaaggaauaccaggagaccauauuaagaaugacuuaggccagguguggcuccuaccuguaauccgugcacuuugggaggucaagacaggaggauugcuugaggccaggaguuucagaccaguguaggcaacauagugagaaccccaucucaaaauaaaauaaauuagcaaggcaugguggugugugucuguagucccagcuacuccagaggcugaggcuggaggaccacuuuagcccaaggaaguugaggcugcagugagcugugaugacgcccugcacccaaucugggcaacagagugagacccugucucagaaaaaaaaaaaaaagagcgauuuauuugggagaugcuguucaguauauuauacuugaaggguauacauacaggcauaccucagagacguggguuugguucuagacaacugcaauaaagugaacauaugcauguuuugguuucuuagugcauauaaaaguuauguuuauacuauacuguagucuguuaagugugcaauagcauuauggcugaacaaacaauguacacaccuuaauuaaaaguacuuugcuaaaaauugcuaauagucaccugagccuucagugaguugugaucuuuuugcugauguagggggggucuugccuugacguugguggcugcugacugaucagggucauaguugcugaagguuuggaugucuguggcaauuucuuuuuuuuuuuuuuuuugagacggagacucgcucugucgcccaggcuggagugcaguggcgcgaucucgguucacugcaagcuccgccucccggauucacaccauucuccugccucagucuccagaguagcugggacuacaggugcccgccaccacgcccggcuaauuuuuuuguauuuuuaguagagacuggguuucaccguguuagccaggauggucucgaucuccugaccucgugauccgcccgccuuggccucccaaagugcugggauuacaggugugagccauaacacccagcccuuuguuggcguuuugguaauguucauuacaucuucaucaggaauagauuucaucucaagagaccguuuucuuugcacauccauaagaagcaacuccucauccauuaaaguaugaucaugagauugcagcauuucagucacaucuucagguucuacuuauaauuuuaguucucuuuauuucugcuauauugggagugacuuccuccauugaagucuugaaccccugaaagucauccauaaggguuggaaucaacuuuuuccaaacuccuguuuauguuaauauuuugaccuccucccauaaauuacagauguucuuaagggcaucuagaaugguuguauccuuuucagaagguuuucaauuuacuuuuuccagguccaucagaagaaucacaguugauagcagcuauacccuuaugaaauguauuucuuaauuaauaacacuugaaagucagaauuacuccuugauccaugggcugcagaauggauguuguuuuaucaagcacgaaaacaauauuuaucucccuguauaauauaucuccaucagggaucuugggugcauugucaaugagcaguaauauuuugaaaggaaucuuuuuuuuaugagcaguaguucuuaacagagaucuuaaaauauucagucagucaugcugucguccaggcuuuguuguuccauuuauagagcacaggcagaguggacugaguauaauucuuaagggccuuaggauuucugaaaugguaaaugagcguuggcuucaguuuaaagucuccaucugcauuagucccuaacaagacagccuguccuugaagcuuugaagucaggcauugacuucucucuaccugugaaaguccuagauggcauuuucuuccaguagcaucaaagaucaaagaucacugaucacagaucauuguaacagauauaauaauaacgaaaaaguuugaaauauugugagaauuacuaaaaugugacacagagaccugaagugagcacaugcuguuggaaaaauggcacugaaagacuugcuugacacagauuugccacaaacugucaauuuguaaaaaaugcaauaucuuucaaauguaauagagcagagcacaaagcagguaugccaguauguauguguuucuuggggaagagaggagagagagggaugggcaagugggacuaguucugugaagaggaacgggaggugaaauacauaagcacuguggaguuacaguaugaugagcuuaacuucaggccugagggacuugagauggaucagggcagggcaaguuuccaggacugugguggauauuaugguagccccccagccacguggaguuauuuaacuauuaaguaaaaaauguaguuucucuguuguacuagcuacauuuuagaugcucgauugucacgugguggguaauuuauuggacaguucagguuuagaacauuuccgucauugcagaaaauucuauuggacagcacuauuugagguuaccugauuucuggccuuguguggucuaucagaucacuugaguucuuuaaggaauaaucagaauuucuuucugacggauccccucaacucuagaaugaaagauauagagcugggccgggcgcgguggcucacgccuguaaucccagcacuuugggaggccgaggugggcggaucgccugacaucaggaguucgagaccagccuggccaacauggugaaaccccgucucuauuaaaaauacaaaaaguagucaggugugguaaugcaccccuguaaucccagcugcucaggaggcugaggcaggagaauugcuugaacccaugagguggaguuugcagugagcugagauugcgccacugcauuccagccugggcaacagcaaaacucugucucaaaaaaaaaaaaaaaaaaagauauagaggugaaaaauagagaauugggauuuauccaccuagaugugagaauggaugggauugcccaaagagaggaacagagcauuccaucguaagaagagccauagaaggaagggagagagaaggcaggaaagaaaacugggauaauuauuacucucaugcagagaguaaauagcauuugauaauucacuuguaaauauuuauuguaugcccgcuguaugccaaguguuagauuaggugcuacagauauauugauaagcgaaaauggacaugaccucuauugucauaguuuucaguuuauggaguuuuacuggagggacuggguugaagauucaggaacacccauccuucugcacuugccauauuguaaaacacuccauuucuaaaaguuggaauuggaggcugaaacgggugaaguuacuauuuaagguugguuacauaacuguugugcagucacuacuucagcuucucaggaaguaguaaaaaggaacaccauaacuugagaacuuugggggaauaaaguaucuguauugauggagggcagaaaggguaguucuuauuauccugcaucugccagccaugcucucugcugcucacuggauuccucucuugcccugcucucaaaaucuguucucuucuggcuucucuuauugucaguaugaguagucagucaccacauauuucccaaugccuagugaagacauauuucacuucucagucuguuaccugcucauucaucuguuuccagcaagugcaaacagaugccccuuggaacgcauagcauuuaaaagugggaccugcccauaacaccaucaucauuugaggcuccagguuuaggauuuuagauuuauagcugacucuucgugcaccugcaucagcuccuucacagagacuugcugaacugccuuuuugaccucucuggcucacguuauauuaacagccuccucacuaaucucugacucuggauuucuccaugcuagacugccuacacacagcuguuaaguguucuuuggaugcuguuguuuuaucuuacugugaagcucaaaaccuggcaguugucuccucuugauuaugguaaauguaaacuuuucagccuaguauucuuucaacaccucugucuuuuuuugugacucuccgaggcagcuccucugguucagccaacuaagucugcuuuuaccccgaccuauggcuugccauugccgaaaucuguguugucacuugugcuuuuuaaaauggaauggccccucccacuccauuucuucuuuaucaguccccuuggcuccuagccaucucuaaccaggagguuucuggaagccuguacuggcuaauacaggacuuuuuaccuccuuaguacucauauacucgcacuaaucuuauucauuugaauuugcaucuccucagcugucauuugcucacuuugccuugcauugucuugucuuugcagaugguaaugaaacugauuuuuaaaaaucggguuucuuuuuucuuugcuuauggacaugaaacuugugcagagggcauaugugcugccuugacuauaggcagguuuccgggagaggcauguuagaggcuugagcacugauaagagucuggagucuagagaggcaaucucucucugcccauaauucccuguuucaccucauugggugaucucauccucucucucuuugccucagccucugugacauguugaugccucucaaauauaugcauuuaguccauuccccucucuugagcuucauacccacauaucacagcuugagucuuggaucuuccacaggcaacuuaaaauaauuacauuucaauaugaaauugguccuucucucuucacuuuccuuuuuauccccaaauuaugucuccuuguguauuuuucauuuuuguuaaugggcaucuuccaaauuugaagucuuuggugagugucucgccuuuuuuuuuuuuucuugagauggagccuugcccuaucgcccaggcuggaauacaauggugcgaucucugcucacugcaaccuccgccuccuggguucaagcaauuuuccugccucagccucccgaguaggugggaggcaccugccaccacaccuggcuaauuuuuguauuuuuaguagagauaggguuuuaccacguuggcuaggcuggucacaaacuccugaccucgugauccgccugccuugggcucccaaagugcugggauuacaggccugagacaccgcaccuggccaguguguccuuuuauuccuuugucauuccccaaaugucaucaguaauuaaguaugucuuccagauuucuccuggcucuucuugcucuccauccccuuugcuucggccauuguugaggucucaucucucuucugaauuucuugucucuuucucuuuuacugauaguccacauggccauaaggguuguuuuucaaaagaauaucagcacuuccauuguuuugcgcguugcguauugcacaaaauugucacauucacacuuuagaaauuguagguuugcggccgggcacgguggcucaugccuguaaucccagcacuuugggaggccgaggcaggcggaucaccugaggccaggaggucgagaccagacugaccaacauggagaaaccuagucucuacuaaaaauauaaaauuagcugacuguggugacacaugcccauaaucccagcuacucgggaggcugaggcaggagaaucgcuugaacccaggaggcagagguugcagugagccaagauugugccauugcacuccagccugggcaacaagagugaagcuccgucucagaaaaaaaaaaaaguaaagaaauuguagauuugcauauuuauuaugacugucuccuggcagaugggagugaaauauauuguucuaacaucaguaugucaugacagggaaggaaaaccuaugacacauaaagacaccuaagcacuagagaacaucuuuuuuauguccuuaguucucuggcaggcaaacuccuucucauccuuuaaaaccgcacauuaauaucccuuccucgugaagccuuuuaaaauauucuccacaagagucagucaguccuuuuacugggcuaaugccauauuugguuacucucuucuuguaguguuuaucacauuauauuguauauauugguauaugauucugucuguccuacugcacuccaggcuccucaaggacagggacaaugucccuguuuuauucauccuuugacuuucaauauguagccuaauguccagcacauaucaauacauguguaacaggccaggugugauggcuuaugcuuguaaucccagcacuuugggaggcagaggcggguggaucaccugaggucagaaguuugagaccagccuggccaacauggugaaacccugucuccacuaaaaauacaaaaauuagccaggugugguggcgggugccuguaaucccagcuacucaggaggcuaaggcaggagaauugcuugaacccggaagguggagguugccgugagccgagauugugccacugcgugccagccugggggacacagcgagacucugucucaaaauaaauaaaauaaauaaauaaauaaauguguaauaaauauuugauugccuagcaugauucaggcagggagguaaauacuuacucacauuaucucauuuaauuuucacaacagccuccugagucccaucauuaucaugguuuauaggugaggaaauugagacuaggguggugaagucacuugccucaagaugaacagcugguagaucacaugcgugguggcaccggguguggcccuggaggacucgugcuaguggaucuguuuuucuagugauucuuuuguuuugucccuuagagugaugaugcgggugugcugguuggugagacaggacagccggcaccagcgaaucagacuuccacauuuggaagcaguugugauugggcguggcccagagaccaagaucacugauaagaaauguucucgacagcaagguaacuggucauagaaauguggagauuacuaugguuaugugggauagugauaaccaaagaugcauauuuucugggugaucuugauggaaaaucuauugucugccaaaaauacagcucaggaacugagcucuuuuagccaacaccagggcccuauuuauuccugauucugcccucccaaugugauaauguucaaggcagggugggugaagguugggagcagucaaguucauacuguuaccaugggaugguggaauugaguccugcccuccuuuccccagggacauugcucaaugggcagcaagauguaaacucuggagucuacaggugaaaccaugucuuucugagaaguaaugggguagugccguccuuuacauauugcuucacgcaaaguauuaugagacaguggcaucuagcacuugucuuaggguuuaauaacaugaaaguccuugcccucagaaaaaaauccuuaccauguaccuuguuuuuuccuguaaacaugcacacugcuggcuggagugugacccccccacagcaagguuucccaaggguucugaacuuagagaguuggcaucugcagcacugauuaugaucuuuccuauaugaguuaaucuaaguggagggauacaaagccaugcuugagcugaguaggcccaagaugcagaagcaguggcugcuucucucucuguucccuuccucacaacagcaacugaaggggcauguauguggcacccuguccucucuggggagcagcuauggugguucuucuuuccucccugucucaacuccagauaccuuguucauuuaucagaacaggaaugcuuaauguuaccacuucucacacaugcucagauuguucugucucugcaaucaucuuucuagaacauucuuuccacuccuucuacccaaagccaccugaguuucuguuuuccaggaaugugucuuuuacuguuuuaucuuuuaaagcaucuaauaguuguuguuuuuccaaaauaauaguggaagccugauuuaauccuuggucaagaguucgugugagaaauggaucuuuuuuuuuuuuuuuuuuuuuuuuuuuccuccugagauagggucucacucuguugcccaggcuggaguguaguggugcgaucuugacucacugcaaccuccaccuccuggggcucaagugauucucccaccucagucucccaaguagcugggacuacaggcaugugccaccacaccuggcuaauuuuuguauuuuuuuguagagacgggguauugccaugcugcccaggcugggagaaacaggucuucuuuucuggcggcagagucugugaucaugagcaggccagggguucuggaauagggaaacuuguggggauuaauugaagcugccucauagggaucuuggcaauagcuaagggaguauguacgcuguuggacauuuuauggaaggauuuaaaccuuuagaaauugguaggauuuggagcuccagccaccugcaauaacaggugauugcuaauaggccuuuaaggaaacaccaccuguucagcugccgccuguagugaagcuuguuuucuuuagggaagauaggagcaagugccugguucuuuguugcauuuguguuuaacuuuuuccaaucucuuucaguacaguugaaagcagaguguaacaagggauaugucaagguaaagcagguagguguauuuauaacuuggaauuuuauacucgaugauuuucuuaugcuguugacuuuagagugucugugccagccagugaaggcuucucugucauguauggaagugauggaguaauauaggugaacauaaggcaaggugcuuggcauauaguaagugguuaacauagcaguggcuaucuuacuguaggugcuguugcuauuauuauaauuauuuucugauuguuuauuccauagguaggagucaaucccaccagcauugacucagucguaauugggaaggaccaagaggugaagcugcagccuggccagguucuccacauggugaaugaacuuuauccauauauuguagaguuugaggaagaggcaaagaacccuggccuggaaacacacaggaagagaaagagaucaggcaacagugauucuauagaaagggaugcugcucaggaagcugaggcugggacagggcuggaaccugggagcaacucuggccaaugcucugugccccuaaagaagggaaaagaugcaccuaucaaaaaggugaggguagugugauugguagaugauguggagaagaaaugaaauauaaugacugcuuaauuguuuuguacacuuuaaaguucagaaaugcgugagggguuauuaaccaugaugaaagagucacuuguuuguggcgugaaaaucauuuggaugaauguuccuuuaugugcuuuuuucuuaaauuccugagguaagccaccugaagguacaacaauaauggcaguguguacuuaacauugaacaacuaaaguggaucaguuguuuaugcaucuauagaagguuuucauagaucauguaauucauaugcugaugucaaaguggagaauuggucaggcuguagcugcagugagagagggcaaagaagguaugacucauacucuggcauuucucgccuucauuuagaacagccagcugugaauauaggaaggcuggcugggugcagugguucacgccuguaaucucagcgcuuugggaggccgaggugggcagaucacuugagggucaggaguuugagaccugccuggcaaacauugugaaacuccaugucuacuaaaaauacaaaaauuagcugggccuggugguacacacaugcuuguaaucccagcuacucgggaggcugaggcgggaggauugcuugaaccuggaaggcggagguugcagugagcugagauugcaccacugcacuccagccugggcgacagagcgagacuccaucucaaaaaacaacaacaauaauaaaaaacagcugggugugcuggcucacgccuguaaucccagcacuuugggaggccgagaugggcagaucaccugaggucaggaguucgagaccagccugaccaacauggcaaaaccuaaucucuacuaaaaauacaaaauuagcugggcgugguggugcaugccuauaaucccagcaacuccagaggcugggcaggagcaucgcuugaacccgggaggcagagguugcagugagccgagaucacgccauuguacuccagccugggcaacaagagcgaaaccccaucucaaaaaaaaaaagaaagaauauagggucgggugugguggcucacgccuguaaucccagcacuuggggagguggaggccaguggaucaccugaggugaggaguucaagaccagcauggccaaccuggugaaacuccgucucuacuaaaaaauacaaaaguuagcugggcgugguggugggcaccuguaaucccagcuacuugggaggcugaggcaggagaaucacuucggagguugcagugaucacgccgcugcacuccagcuugggugagacagagugagacuuugucucaaaaaaaaagagaauauaggaaggcaauggagugaagcagagucaagugaaucuuguuuaauucucaaaaacuaagcuuauuuccaaguuuaguugugcuaucacacaguauuaacuguugccaaauuuaauuauuggcauuuguaauuuacauugcuuguuuuuuuuuuuuuuuguuuuuuuuuuuguuuuuuuuuuaggaaucccugggccacuggagucaaggcuugaagauuucuaugcaggaccccaaaaugcaggucagaauacaauuuuggaauuucaguacauuucauguuguaaaugaccacuccacagaggucuuaauuacaaaugaaaucaaaggauaucagucuuucugaaugagauucauuuuauugggcuguucugugagaacaagaggcuuuucacauuggcaauaaaguagcagcugucauuguuuggagagaaagcugaguucuucaaaugaauauccccucugccuugugccuuuuaaacuucuggguacuuuaagggaaguugcauuaaccuuaguaugguuccuuucaggggagcaucagagauaauacacugugacaguaguacugugcugcccuggcauuaacagucagacaucccuguaaucccagcacuuugggaggccgagacgggaggaucaccugaggucaggaguucgagaucagccugaccaacauggagaaacccugucucuacuaaaaauacaaaaaauuagcugggcaugguggugcaugccuguaaucucagcuacucgagaggcugaggcaggagaaucacuugaauccgggagguggagguugcggugagcugagauugcaccauuguacuccagccugggcaacaagagcgaaacuccaucucaaaaaaaaaaaaaaaaaaaaaaaaacaggcaucauccuugaggagccuuugagucccacuucaauuauauuccuuguugacaaggggcaggucuaauagggcucacuggaacccacguguacgugucacacagucugccauguuggaguggagaaggaugcuuuugaauuuaugucuacagagauuuuacaucacauucuugggaacuauuuuguacugugcaucuucuguguauucuguguaguguggugguugaaaacagacucuggagucaaccacaucugaguuggaauccuagauuucccucuuaggaacuaugacuugugcaagacacucaaccugucugaauuucagugcucuccucucucaaaacugggcuauuaaaaccauuugcacaagacugugggaauuaagugacuuagugaauauaacaaccaggcacacagaagauucuuaguagaugucuguuuccuucucuuguaucccucugcuagguuuacaaagaugagcaggugguggugauaaaggauaaauacccaaaggcccguuaccauuggcuggucuuaccguggaccuccauuuccagucugaaggcuguggccagggaacaccuugaacuccuuaagcauaugcacacugugggggaaaaggugauuguagauuuugcuggguccagcaaacuccgcuuccgauugggcuaccacgccauuccgaguaugagguaagccagguggguagugcugcuggcuccugguucuguccaggugggcagauagauucagccugggcuugcugagggcacauauugcacugagacccagggaagugggauggaguuuuuccaaagcaggugggcugaagcuuccaccucucugccugacuugcaugcaagcuuugaguucccacuucugccuauaauucagucauauuugguucuuuguuccucucaaaauauaaaucuucgagagccuaauauaugaacuagaugaagcagcuucauuauccucagauaaagaauuguggucaguggcuuuuaucagauucuucaaaagcgucuauaaccccagaaugauuaaggaccauuacucugaaggaaacaaacaucauagacuucuguaaugacagcguaguagauccaggauuugaaaauaaaaugagagaaaaguauagaauuuguuuuccuguggcuuaugcccagaaggauucagaaaggaaugacugauuucuuucaaagaauacaagcaagguggaucuccgugauuucuuugauuuaagcaauaagaugauaagucuagauuuuagaguuuuuauuuuguuuuuaaaaaacugugauauaauauacauaacaaaauuuacauuuuagucaucuuuaaguguacaauucauuggcauuacuauauucauauuacuaugcaaccauuacuaccaucuaucuccagaacuguuuucucuucccaaauugaaacucuguaccuuaaauaauaacucuccauuucccccucccacuccuggcaaccaccauuguacuuuccuucccugugaauuugacuacucuagguaccucauauuagaggaaucauacaaggacauauuuguccuuuugugacuggcuuauuuuacuuauuuacuuacuuauuuuacuuuacauaaugucuucaagucuuauccauguuguagcaugugacaggauuuucucugcuuauuuuuuuuuaacuaccaacacucacauuuuauuuaggugaauaauuaugacuuagguuacuggccacuugaaccaaaugaaaucuuugugccagauuuuucccuagucaguacugauucuuuuaaguugaggcauaacuuacauacaauaaagugcauaauaagaugcauaguuugaucaguuuucauaagcguguauaaucuuuucacuaucauucugauuaagauacagaagaugucuauccuuucaucccagaaaguucccuugugccccuuuccaguuaauccucccucaagcauugcuuuuauuuccuucagcauagauaguuuuugucucuucuagagcuaccauguauaaauggaaucauacauugcauacucuuuuuuggucuggcuuuuuugggucagcauaauuuugagauucauguguguuauuguguauaucauagacauauguacuuuauuuauuuuuuuccccuugaguaaauauuuagggaucccagucugggcaacauggcaaaaccugucucuacaaaaaauacaaaaaauuagccaagggugguggugcacaccugcuacuugggagguugaguuggaaggaucacuugagcccaggagguugaggcuacaguaagcuaugaucacgccauuguacuccagccugggcaacagagugagacucugucucaaaaaagaagaagaaaaaaaaagaauaaauauuuggagauggaauuguuaggucauaggguggauguauguuguaccucacuuuaaaaauauaaauauauuuuuauuguuaaaggcugauuugaaaauuuaggagggaaagucacccauaauccuguuucccuaaugcagagccccugacuaacagagcccuuggccacugagcccuuuucacguagugaucgugaugcccauaccuuuuuccuacagugaauguugucgugcuaaggagaaugcucacagcaagagcugugguagguauauaugggaggcaaaaugagccaauaagcaaaguugcuauuuauauacccuuuuauauuacucuguaugauguaguuuugaauaaaugaacauauuagaaaggaaaaggugauaaacaaguaaaauuauuuuuccuauuguaaaaguaauguuuucaauuaagaaaauauaaaaaauuaaguaugaaaaagaacaaagaccuuucauaauacuaacuguagauaacuaaacuauagaccuuauuuuagauaacuuacuaaacuguagaccuuauuugaauuucacccauuuuuccuguauuguucuuuuucuacuccagaauccaaucucacauuucauuuauuuguucucucuucuuagucucccucaaucugugacaguuccuacuuuccuggcuuucaugaccuugacacuuuugaugaauacuggcuaauugucuuuaggacgucuuuuaauuuggguuugucuaauuuuguuuuucaugauuagguugacguuaugcauuuuuuuaaucacugaagugauauuucugauuguguccuucucaauaugucauaugggggggcaugauguugagaugguuuauuacugaugauguuaaccuugaucauuuuguuaagguggugucugccagguuuucaccuucaaaauuacuguuuuuuuuuuuuuaauucaugaauauuuuggguuagauauuuugagacuauacuacuauuucuccucaaacucgcacccaaugauuuuagcaucuauuggugcaucuugccuguaauaguuauuguauugguauuuacucuauggugacuuuauacuuccuucaccuaacuuauuaguugaaauuauucugugugaaagcgcuguucugucuuucucauuaguucuuuauucaaucauuuaaugguauggacucauggauguuuauucuauagguuauaauucaauacuauaauuauuuuguugcucaaauuguucagcuuugguuauugaaagcuccuuuaggucagcucuugugucacuuagauacgccuucaacaucuuuugggcaauuuauuuucuggccccacaagauguuccaggcuuaucuggaaugaaccacuucuccaaagagcccuaggucuucuugggcacuagguuucugugagagaagugguugauuccaggguguccuugcuuucuagguccucucagccauagagccagaaaugcauguaugaauccuaagccauacacacacacacacauacacaccccuauaauucuguguuuaucuaccuuuauuuguaugugaaaaaccaugaguucauacugauaucucugacaccauuccaacucuaaguuucauucuuguuucccuuuuccuuuuuuguaacuacuuucuccaacagugagaaaccuggcucucauuaguuacaauaaauucauuuacuuguucaguccuaguguacccauaaaauaguuacaggauuccuaacccauaccccugugagaaggacauuuacuaacuagaguacaguacuugccuauaguucuuuuuguuuuuagccuuaucguaucuagucaaaacacuguucuccaaagcuagguuacuauaguauaguuaauauauuuucuuccucaauccauuuagugugguuuccucauucauuuguaauacagcuaugcuuauuuauuagugcuuauauuucauuuuggauucugcacacauguugauugauuuugauuauuuauugggagaacgugaaauauuacugauuauaagagugaaagcuguuauacaaaaaggcauucuacuugguuuaacaaguccaaaagagaauuccugauuuucuuccccaaaccugcuuuuucaccuaaccuucuuuaucucaguaaguaacacucucccaaagcaacaugcagcccauuaauaaguucuguuuguucuauuccaaaaugcauucaaaguaggauugcuuguugacaucucagcugcuacagcucagcucuaguguaggcugugauuuucuggccuagacugcuguagcagccuccuuaacugguuucuccauguuccucccuauccguccuuucuucacacaacagucagagugaucuuuuaaacauguaaaucagguugccccugugggcuugguuugugaggaagagccuggcucagccugucaggaccacugaggcuuguuucuugccauccuuuccaccucaguuuuacacacuucucaccuccagcuggcuggguguggggaagaccugccagagccacauuggacaaggugguucccauugccaaguagauggacaagauggugcagaagaauacagcuggagcauuggauuugccaaaggagcuuaaaaauauucccaugaccauggaauuauuacagcccccagaagaaucagaauaucaguuaaugcuaauggcaagcagcauaaagaugaagaaguuacaucuuuaacagucugucaugaaaucugggaaaaaguuacuaucaaccgagaaagacccugaagaaaagaaaaaagaaccugcaguuacauugcagaauaacucugaagcgagagaagaaaguagcuccgguggcagugcaagcagcagagagggugagacaaaugcucuagauacucguguuucaucuuuuauucaggaacgaagcacuucugacucucuuugguuaaaguguugcgaggugcuugcugcagcucuccaaacaggagauggcuacacugcuauuggagcuggugaggaagaauuaggaucucaaauugaggaggcuguauaucaagaaauuaaggaauauagguacgaaaugcaaaaguagaguaugaaguaggauaucaaaucuuaaagagcaaagaauccaaauuuaagggaaaauguaccaugugagaauauuccuccugucuuauuugcuagaaugauggcagaggaaauggcuagugaugggcucagagagauauggaaaaacuugaccaaagaagucaucagagagcauuagguggccaaggcagguggaacccagaguggcuuguucacaugugcaaauguagugcugauggacugauaacauucguugucuguaaugaauguggacgucaguggaaguucuguugaguuggaauaacuaccaaaauaucuggacuauuaagaaauuagauuuuguauguucauugcagcacuauucacaguagcaaagacaugggaucaaccaugauugaugcccgucaguaguagacuggaugaagaaaaugugguacauauacaccauggaauacuacacagccauagaaaagaacgagaacauguccucugcagcaacauggauggagcuguaggccguuauccuaagugaacuaacacaggagcagaaaaccaaauaccacauguucucacuuauaaaugggagcuaaauacggagcacacauggacacaaagcagggaaugacagacacuagggccuauuugacaguggcgggagggaggugggggaggauugaaaaacugccuaugggguacuaugcuuauuaccuggguggcgaaacaaucuguauagcaaacuccugugacauacaauuuaccuauauagcaaaccugcacauggaucccugaaccuaaaaguuuuaaaaaguuaccuauauuaaauauauuaaugauagaaaaaaaggagaaccaacuugguaguuagcaaaacauaaguuauauccaaaaaaauaugcuuuuaguagugugaugggacagaagcccaaucauaguaaauggaucaaaaagugaauaucaacaauagagcuuuaggguuugcgaaccacuguuguaagaaagugggucauggaaguggagucagcagaaacagugcucaucuggcuuguaguuaagggagaauuguagccuuuuccuguccugcucuccugucccccaccauggauauugaaggugggaggauacauaccauaaauguuuaugggacaggugauaccucauuuaaaaucugcugucuauuauuuaucagaaauugcacuugagcuuuauuucuuucauuucaucaucuuagcaacccuguaaaguagguaucuucacuuccauuucacagauaguguugcuggggcuuagaaaaugauaaccccaaauaaaggccucagaagcaaaauuucuccuugaccuucuccugcucccgucucuugccccucauucucccccuaagcaagccauagaaacuauaauuccucuuucucaaggcagguuauagaaacuagaaccuucuuccucaaagccaaccaaaaaccccaaaauauuacucuaaccuucuuuucuauguagaccuggcuauaaagaaauucccugaucuaccuuguuugaugguaggucauaagacugccauucccauaccugggaagaaggaaugcugcacaaagagguuaagaagaaucuggacagacaggccuugcugaguuuccccacucagucuauucucauuaagucguauacccuuuugaagcaguagugguucuacauggcuuuccauucuucaacaaacccaaguguaaaaauggauaguuuuccccguaucuuugcaucuucauuuggaaggcuccugugucacauaaaacuuggauuaaauaaauuuguuaugcuuuucaaaaaacaaaaaaggauggauuuuguaauuagauuuaaaacuggccaagcaacuaguuuuccuacaaauuagauuuuuaaagcaacacacuuggguuaguccuuguuuuugaccuaaugccccuucuuuaaauaccuucuuauaucagagaccauaugauaauuauaugguaucuguuuccguuuuuuuuuucuuuuucuuuuuugagacagagucucacucuguugcccaggcuggagugcaguggugcaaucucagcucccugaaaccccugccuccuggguucaagcuagucucaugccucagcuguccgaguagcugggauuacaggcaugcgccaccacgcccagcuaauuuuuguauuuuuaguagagaugggguuuugucauauuggccaggcuggucuugaacuccuggccucaaaugauccaccugccuuggccccccaaaguacugggauuacaggugugagccacugcacccagguuuuuucccccccauuuuuauaaaugaauuuuuuuauucauuuuuuguuuucguuuuuguuuuaagagaugggagucucacccucucucccagucuggaguacagugucaagaucauagcucacugcggccuugaacuccucggcuccagguauccuuuugccucagccucccgaguagcuggggcuaugggugugccaccaugccuggcugauuaaaacaauuuuuuagagaugagggucucacuauguugcucaggccaauguugaacuccugaccucaagugauccaccugcaucagccuccugaguagcugggauuacagguaugagccacgugcuugggucauuuuuauaaauugauaugaaacuuuuaucaauuaaaauucugguaauuuauuuuuaucucuuaagugaaaauguaccuugacuuuuuuauuuuuuaacgguuuaaaacaugugcaguagaaauucucuguuaauacauaaauggaaauuacauuuuuuuucauauuggcguguaucuacaaauauuaaaggacaagaaaagguaauauaauuuuagguuuaacaaauaugguguauauucaaauaauacuugaccagcuuaucuaaauuguacauaauauuuggacuagcauaugaauuugauuuuaauuauuauguucacaagccugggauaauuagauguuauuuugcaucuguaacuguaaucauuucuuguaauuucuugugcagguguauuguacuuaauagauuuuacuuuuggaaauaugacuguugaaauuagcuuagcuuuuauuuacuguuuguagaguauuuucguuuuggagaagaacacuguuuuaguuuaggacgcuuuucaagagugaaagcuucugaugauuuuuuucccucauaggaagaaauacuggaaagaaaauguuaguauaaugcaguuauuguaacagcuuaugacuugauuuugauuuggaaaccuauacugaccagauauuaagcuuaaggauuguauaaaucauuaaagcuguggucuuuucauauggagguugauagauaauuuuuuugucuugagucuuauuuggugacuuucuauucauguaauucaucaugugugagugagguuguugaacaaacugaacacaugggcuacagcaaguaguuuuuauuuuuuuuuauuauacucaaguucuaggguccaugugcacaacaggcagguuugauacauagguauacaugugccauguugguuugcugcgcccaucaacucaucauuuacauuagguauuucucuuaauguugucccuccccgagccccccaccccccugacaggccccgguaugugauguucccugcccuguguccaagugaucucauuguuuaguucccaccuaugagugagaacaugcaguguuugguuuucuguccuugugauaguuuauagcaaguaguuuuacaguacagaucuuuccauuacauuuuauuguuuaaacaaaacaaaauuuguuuuucuguuaggaauaagaaaaaaaugguuuuuacauagguucuuacgguacgcuuggaguacacuuacaggccacugcugcagucuacauuuuauugugcugaaucugcauucuaucagauacccauggaaagaccucaguauaugcuuugcacucugcuuugcuccccuuuuccaauuuccuauugcaaaucauuuugauguaauacagaaaaaacagcauuuaaauaucuacaugaagaguugacccacuaaugucagccgaccucuacuuugucagcucauaguuaaaucuuuuaucauuucaaaaauaaagugcauuuucuuuuucuuuuucuucuuuuuuuagugauggagucuaacuuugucacccagguuggagugcaguagcaugaucucagcucacugcaaccuccaccuccuagguucaagugauucuccugccucagccucccaaguagcugggauuacaggcaccugccaccacgcccaguuaguuuuuuguauuuuuaguaguuaguuucaccauguugggcaggcuguucuugaacuccugaccucaagugauccaccugccucggccucccaaagugcugggauuacaggcgugagccgccgcaccugguugcauuuucaaaagaaugaauuuaagaauaauaaaauuaaaauaggcccacuuuuaaauugugguccauuuuauaauucaauuuuuauuguuaacaaaaaaaaagaguauaaaucagauaguagcacucuucggcugaaaauccuucaauggcuucccaguagauucagaauagaaugcaaacccuuugucaccuuuaagaggcuuuaugaccuggcuccugccucguuucugcugcuuggcuccaacaauucaggccauacauuugggccauauuaccuucuuucucuuucuugguugcacugagcuuuuccucaucucagggccccugcucuuggccuccucacuuucugagacacucuucccacagaccuagcuugcuugggugcugucuccguucaaaucacuucccgggagaugcuuucccugaacacuguuaacuaaagagggcagcuucuaccccugggcacucuaucccauuuuccuuguuuauuuuuucuuggcaauguuaauucuuuaaguuuuuuuuuguuuguuuauuuguuugcuuauuuauuauuugucuuuccucauuagcguacaauuucuauaagggcagaggcuuuucccauuuuguuucuugcuaaagucucagugccuggaacaguguuuggccauaguacauacuuauugagcauuaaauauucuuaaguaaaugaaugaaucaauugaauuaaauggacacacuaucacuucaauaguaugaauauucaaagaguauucaauaguaugaauauacaauguacucauacucuuugucauuuugauuaagccauaguuguuaaagaguuuaaugcucaguuuuuuuuucuuucaacuagccauguacaucuucaugugaucagccaggauuuugauucuccuugccuuaaaaacaaaaaacauuggaauucuuucaauacagaauacuuccuagaaucacaagguaaacaguguuccuugguuuucacauuuguuucauuuucugagcuguucuuauauuugauuugguuguuucccugaauaacagucugaccucaaaaaccuauguacaacuuuguguucccuauaaagcgagcccugugaaaagaaacuggauuauuuggauuguaguauuauugccacuuugcugugaguugucuucuugggggaccuagaaagcuauuaugucagggucaguguuuuauugugacaaaaggggacuuaaaggcugccgugagaauuaguggaguucauggauaagaaagcuguggacaauucuuugucucuucugccaucaguugggugggagcuuuggggcugccuccugucaggaguggugaauuagcagggggaacccuguguauauguagaagaaagcauuuucuggugugugaugcuuucuuacacaccaggaaagcauuuccugguguguaagaacuuaagcauugaugggguguucacaauggcagcuggcauuuaccaagggccaaccagagguaaagcacucugaugagcucuugacagaguaacauggauugccuagaguguguccugaaggaguguauuauuucaaagguggguugcucauauuuauaaucugauuaagcucauuuugccugagggaagucuaaacuaagcuuacggagcuguagaauaccuggccuggcauacugauuggagucacguuuuugauuuuuuuuuuuuuuuuuugguaucucauauugguuuuccagaguagcugggauuugacuuuucuuccuugccugcagcugugaucgagaugguacaagaggcugguagaguaacuguccgagaugggaugccugagcucuugaagcugccccuucguugucaugagugccagcagcugcugccuuccauuccucagcugaaagaacaucucaggaagcacuggacacagugauucugcagagccugagcugcugcugugguguggcccacuggagcaaacugcuggcaccuauucuggguugcuugugaacuucuacucauuuccuaaauuaaaacaugcagcuuuuucacaaauuuauucuauuauugaguggccacaauguagaguggcucaaaguacuucaggauuaggaauuuggguuugucauagauguauucucuggugaggguggcugggauauaccugacccaccaucuucagaaggacccaugucaggucugaccauugggagcaaagccauguucacacugaccuaaugcagaguauggaagcauugggcugguuauacauuucuguuucuuagauuuauccuccgccucuguaggcauggacaaccuuuaaucagagcaucuagaguggccucuuguuuauccugaagauacugaugggucuuguuuucuguuagucuguuuuguaauauucuuuucccuuccuucauggggaggcuuaguuuguccaguccuuccaugcccuucuaucccagauuaccuaaauguucccuucucaggaauucugucucaucaguucuucacagugagaaaagaggcuagaugauggugugggggguuggaguuuucuucuaauaccgaggguuccuggcugugaggaaacagccacauguucgucaugauugagcugugaagucuucuuggaccuguugucugaaaauaaaguuaauuuguuugaggcaucucucuuaaguagguggaaacuauugaaguucagcuaacaaucacagcauagguucugaugcauggaaaggugguuggugaaugaaaaaguugcguagagccacuacuuucuuuuucccugagaauaaauuuggauaaaacaguuguauuca

SEQ ID NO: 191361 - RNA, 13854 nt, Homo sapiens
gcuuuuauauuugcguuuauucuucauuuaacuuuuuaaaacacuacuauaguuuauuaaaacaaaaacaagagcaaguagugagcauauuaugauuacaguccuucacucauucacuacugcacauuaaaugccagcagugaguguuauucacuggcccauuaagaggucugacacugaacaccaccucugggaugauguucaucauccucauaugcuucuccauuguaguggcgccgucuuuccugauuuggaucaaaguccaccaguucuacuugguccaucucaucagucucuuccacuuccuuccucucggguaggaguuuuuccagcaaagacaguuuaucaggagagagaaagccauucucaggaaaguuuaccuucaaaagaaacuuucacuguucaaucugauuucaucauuagcucccuuagaguaucauggacccauuuuccccagaaaaacacauguaaacacguaauauuuaggugaaucugccaaucucagguuagaacaggcucuaaaaaggcacagugcauagcacacucugaacuagaguucaaggauuaugaccagaagucaggcuuuauuaaaaaugauuguauuaaauaaaacugcacuuuaacaaccauuguucuauccagcaaacugacuuuuuaauaccaaaacccauccugcaacagccuaacccuucuuacgacauauuuaaacaaagcuauucuuacucucaaaaggguaguucuuccuuaccaaagauguuuuuaggccaggcgcgguggcucauacaauugggauuacaaaucccaacacuuugggaagcugagaugggcagaucaccugaggucaagaguuugagaccagccuggccaauauggugaaaccccaucucuacuaaaaagcccagcgugguggcgggcaccuguauucccagcuacucaggaggcugaggcaggagaacugcuugaacccaggagguggagguuacagugauccaggaucgcaccacugcacuccaccuugggugacagaacaagacucccgucucaaaaaggaaaaaaaaaaaaaaaaguuuuaauuaauauuuuuauggugacaggccaauuuaagacucaggaaaaugacuggauugcuuuauaccuauuaacaaaucaagcauuacacuauuuugccaagaaaucugcaauuauuauaaagcaccucucaacuuuaagaugccaguuacaaccuuucauuaguaaaauacccacuugucccacacacccuucccacaaccuaucuuuaaauauccaauuaaugaugcaaaaaaccccauccucaacuuguuaacaaagaaugcucaacaugacagaaguaguuauuagguaaauuuucuuuuuucuuuuuuugagacagggucucauucugucacccagguugaaguacagugacacgaucuugauucacugcagccuugaccaccuaggcucaagcaauccucccaccucagccucccgaguagcugggacuacaggugugugccaccaugccuggcuaauuuuuguacuuuuuguagagaugggguuuugccauguugcccaggcuggccuuuaacuccugagcucaagcaauccaccugucuuggccucccaaagcacugggauuauaggugugugccaguggcacguggccagauccauauauuucuugcuguggaaaaauguaaguuucagguucugaggcauucagaaauuuuaauuuuuuuuuuuuuuuguuuuuuuaaagagacaggguuucacuauguugcccaggcuguucucaaaacuccagggcucaagggauccuccugccucagccucucaaaaugcggggauuacaggcaugagcuacuugcaccuggcugaaauuuuacuuuuuuaucagauuuuaguaagccaauuguucucaaguauucuuaaaguacauuacagcuuaccuuaaauucgaugauuaggcgacccuuuucauauggucuacgauaaauuggcaugccuucauuuaguacacacuugauaucuccaugcuugacaaucugaccuaaaaacauugaagccaaguucuuccuuaaguauggucacauuuuuaugaggcagggaauauaaagaacagagcacuguccuagcucauuggcaggaguaaaacuuacguggcaaagcaauccuguuaccuuucacuuauggguuuuccaagggcugacaagagagccaagaccuuauaacuucaucuaagcccagagaaggauauguaaccgagaaagaaaaacaauggguuucccucagugccuauacuacacuuuguuaacaggagacaaggaaaauacuagaauagaaaagagaaguuuaagcuugccuaguucccauaccuggaugagaggugaugacgaugguucgguugucaagaguagauauuggcuucuggaagccacacagugcuucaacgagcuguauguccauacacaugaaaaggucuucuccucgucugcauaaaauaugacacauauuuauauuuuucaaaucacgaaucaguagauguaccaaagcaggcuguuuuuuuguuuaauaaaagcaaagggucuuuuacaaagacacccuuuucuucccccauuguaaaaaucaagcagagcagagaucugggaagagcaaacaugugcaaccugccagccccguuuccuaguuaaggauucaaagucauuccacacacucuaggcagccuuuaccauuuaccaucagugaacuguuucauuaccuaguuuuaaaucugguuucucagaggggaaaaaaaaaaaacaacucacaagagugaggguuaggccaggcacugugguucgcaucuguaauuccagcaguuugggaggcugaggaggguggaucaccuaaggucugaaguucaagaccagccuggccaacauggugaaaccccaucucuacuaaaaauacaaaaaaucagccaggcaugguggcgcgcaccuguaguuccagcuacucgggaggcugaggcaggagaaucacuugaaucuggaggcagagauugcagugaguugagaucgugccacugcacucuagccugggcaggguccuagauaauuuaggcucuaugaaauuaaacaaugaggauauguccaauuuaaagggacucuaacaauuuccucauugaugaaccugaaauaauauuuccuggcauauugugagugaacacagccuuucauauuuaacguuaacagcccacuuccuccuucucaugcuuagacuuuccuuuuccaacccacauuaauaaaacaucuuuaggcugggcgcgguggcucaugccuguaaucccagcacuuugggaggccgaggcagguggauugccuaaggucaggaguucgauaccagccuggccaacauggugaaacccgucucuacuaaaaauacaaaaaucagcugggcgugguggugggcgccuguaaucccagcuacucgggaggcugaggugagagaauugcuugaaccugggaguuggagguugcagugagccaagaucucaccaucgcaauccagccugggccuguugagcgaaacugcaucucaaaaaaaauaaauaaauaaauaaaacaucuuuaauacccuucucaaaugacagcaucaaaagccugagcuugacaacauuucccauuaucuucagacauuuguaaaauauuagucuuuuuuuuugagaccaaguuuugcucuuuuugcccaggcuggagugcaauggcgccaucucaacucaccgcgaccucugccuccuguguucaagugauucuccugccucagggccugccaccaugccuggcuaauuuuuuaauuuuuaacagagauggcauuucaccauguuggcuaggcuggucuugaacuccugaccauccaccucggccuccuaaaguguugggauuacaggcguaagccaccaaaccaagcugaaauauuaauuaauccuaaacuaguuuaagauguucccaauuucaccuccacuccauuaaaaaaaaaaaaaaaaaaagguggguucuuacugucacccaggcuagaaugcaguggcaugaucauaaccuugaacuccugaguucaagccacucuucugccucagccuccccaguagcuaggacuccuggccucaagugauccucccaccucagccucccaaguugcugggaauauagcaugcacagaggguguuauguuagccauggaucacaaacauuugcuguuaaucauccaucuuucuugugcuucaguguucaucauacucauuauuuagcucaaaaugguagaccugaauuuauacuuaguauugaguuacaauuuaaguuuccuacagagaugcuuuuggauauuuauaauuaaaagcaauucaauuuaucauaaaugagauugaaaacuggugagagcuuuaaggcacuuaaauugcuuuacaaagauugagggcaaauuuuuguccagggauguuuuccccacccaucugcugcuuagguucacacaaaacaucuaauugaaacacauuuucaacguuccauacuuagagacaaaaagcuaaaaaucugauccuauguauucaaccucuuaugaucugaacaaugguuaacaaucuuccugagaaauagguucuaagaguaauggaaaacacuuuaaaaaaaacaaaaaaacaaaaaacaaaaccaacaacccaaauaugugauaucaauuugagugguugauaaaagucuuuaccgaguaaaaacagcaugguccuucugaucuaacacaaugauaauaucgccuggcuccaguccugguucuuggucuccuucaccauggaauguuaucuucuggccaucuuucaugccuaaaaacaaaacauuaauuuuguacuuuuauuaaauauccaacuaaggucagaaucauaaaaucuauacauagauguuuguuuaugcauaaaaaucacagaaaugacuaagaaagcccacuuaaguaguucaguccaauuugcuccugaagaaagguaucauaguggagaacacaaacuccagaggcaaagagacuagccuucaaaucucagagcugcuauucacuggcuggauuacccuggggaaguaagcugcauauccuuuccaaguuucaacuuucccacagacaccuacaccucauuagcaauauuuagaguauuaacucaacagguauaugcugguacuaaaccaugacuggcuaacacugguuauaaccaaaaaauguuaauuaaguauuucaguuucauuacuuauaacacaucaaauuacuucuauuaaaagucuaacagcaauguaaaucaagacccuucuauuguaguauuuauauauaaaacuaaaaaaauuuuaaaucuauaaucuucucuugagauaggaucuugcucuguugccuaggcuggagugcaguggcacaaacauggcucacugcagccuccaucuccugggcucaagugauccucccaccucagccucccgaguagccaggaccacagaccagcuaauuuuugaauuuuuuuuuuuuuaauagagauggggguucucaugucgcucaggcuggucuugaacuacugggcucaagggauccugccucggcauccuauaguguucggauuacagaccugagccccugugccugaaaauccguauuuuaaagaacuauucaguauaguccccuuaaaaaaaggguaauuauacuuugagaggccgagucaggaggauacccugaggauagcacccuggagcacaggaguuccagaccuugucucauuuaaauuaaacaagcaaacaaaacaaucagugcuagacacucccuuagcccaugugguccguaaaauacaaggggaggaguauuuucuaacagggcaaaaaaacacgccuuuuuuuuuuuuuuuaaacugagacuucgugccccucaccucugacccacauauuuuaguucaguaaggguuugggcaacgucucuuagaacauaacucauguaagaaaaccuguguuuguagaguauuacaccaaagcaguuaucuccugauuauuucccaagaucacucugguuaccuaacagagcaaucauguuucaccuuuacguauggaaaauauuaauccuguauaaacagagccaacaguacaaugaauuccuacauauccauccaauuuggcuucagcaguuacuaacucaugacuaauauuucauguauuacaccccuacgcaugccccccacauauacuuucaagcaaacuccaacuauauccauuaacccacaaauacuucaguacguaccucuuaaauaaggacuuaaagcgcuaucaguaucauacacugacaaaauuaaacaaucugucuuuaaucguguauugaggcaaaauaacuuguuaugcuagggaagcaauuaaacucagcuagguuuuccugaauacagaguaagaguaggcacagcacaaaugccuucacuugcuauauaguuagggcauuaauuucaaguucucacuuacaguccauuguugauagguucuuggaaauugcuuuaaaugaaaugacacauaacaagaccaauuuuuuuccccucagcuguguuacagugacaugacauuauuugaggaccugcaugacauuauuugaggucauucugcuagaagucccaguuuccaagaaccuaucaacaacguuaagacuuacucuguaugcuauugguaucaagaacaccucaaaguauaaaccuuaggcaugggcccacuaagggguaaacacagauuuauuaaguucaacaacuggccaaggaaacuuauuuuuaccuuucaauguacuacauucuuggguggaacccugggggucagagaggccaguaucaugagucacaugauagaauccuauugcagccacuuauguuaauguagauuuguauauuaauauggaaauauguucaaauauuaacaguuccagauugguaucauaccacaguacaguauaauaguagacccauuuauaaacagcaaaaucugaaaagagauuaccauaauguugacuuaaguuuccuucugggguuauauacauuucuuaaaauuucugcaguguauugcuguaauacauuuuaaaauguuuuugcaaguugacaagaguaaaauuuaaaaauugacaaaucaaucaaaucccgagaauacaaaaaaaagguuauauaguuauuucuaaaucuggagcccaauggguuagggaagugucaagucuaaaaaaaugaaagguagucuaucaaaucaauuaacggagcauuuaaauauaauagaugggcaaguaagccaauuaagugggccaauacgcuuauuuaaacuagcccaggccagguaugguggcacacaccuguaaucccagcauuuuaggaggccaaggcaggcagaucauuugaggucaagaguuugagaccagccuaacauggugaaaccccaucucuacuaaaaauacaaaaaaaauuagccaggugugguggugcacaccuguagucccagcuaccugggaagcuggggcaggagaaucgcuugaacccaggaggcagagguuagagugagccaagaucgcaucacugcacucaagccugggcaacagagcaagacucuaccucagaaaaaaacaaacaaacaaaaacaugcccauugguuuaaaaaauaaacaugaggcggggugcgguagcucaugccuguaaucccagcacuuugggaggccgaggcaggucaucaccugaggucaaguguucgagaucagccuggccaacauggugaaaccccgucucuacuaaaaauacaaaacauuagccgggcauggugcugggugccuguaaucccagguacuugggaggcugaggcagaagaacugcuugaacccgggaggcagagguugcaaugagcugagaucgugccauugcacacuccagccugggaaacaagagcgaaacuccgucuccaaaaaaaccaugaauuuuuaugagacccaauucuucaccuaacuccccuuucaaauccuuaaaaguaugccuaucccuugaucuaguaacuccuaauuaagaauguguacaauucuaauguuuuaaaagauggaagaacuaugguuuaacaggagagaauuaaguuuggaacacuauucaaucauuuacaggaccacagauuucaaaagaugauccuguuauauuaaaugaggagauuccuaauauauucuguauuaguaauauaccaaugugcaaaauuaugucuggauaaaagaacauuauuuacuaagcugcuaagaguuauuucugauugauaggaucauauauaaccuaauuaagaaugauuuuuaaacaauuauaaaauguuaauaauaaaucugccacagcauucaagacuucagaauaaguaacucagaacucaccuuugucaauaugaacuucuaaaauuuucuucucucgaacuaucuuccuuccguugcagcuuuuacaucuaucuuuaggacugauccgcuccccauggcccuggcacuccaugcacacagacugaauuugcugaaccauuccagguccuaucugaugaauucuuauuugcauuccaguaccucggcaauugggacagcacucuacugcuccuuucuuaccuccucuaccuaaauuuaaaaagaaaauuaaauaauguaugaauuaguaguguauacaguaguaaauguuuuaagaagacaauuccuaaaugcuauacuuuuaauauuuucgaagccugauggaaugcuacccucugaauguacaacugaugagaucauuccaaugaguuucauucuuauuagaacacacuuuccaauaaauuuuacuuauuacaaaaaagauaccaaacuagcuugaucccaacuguauuuaaaauauacacagaaaaaagugcugauauuucuuuaggugggagguuuucaguugguuuucuucauaucugcccucuccucccccaaaaucuagguaguguacaugaaucaauuuuacauaucuaucuagaagucuuagcuccauuuucaggugucauauuaaaggugcuuaaaaacaaaacaaaacaaaacaaaaaaacaccguaccuucacauuugucacaaaucacauucuuuugcagagccaguuuucuuguugcaccauuauauaagucuucuaggguuacugagagcugauguacaacauuuuuaccuaaaacaaaauauuucucauugcaaaucuguuuaagaugcuggaucuuauuugugcuaaaggcacuauaaagaauguggcaaagaauaauaaaagaugagccucacaggguacaucuguugacuaccuacuauauacacagaauguucacguuaucacagaugauccucaaacugugauguaaucacagaugagggaaaaucaggucagagauuaaauauuugcuuaagggcacagacguggccaucuuggaaauaugguaagcaaaagcauuaccuucaaagucacuugagaaaaaccaauguuauuuaaaagggcacauuucacaauaauccaaacauucauuucugucacaauauauuuuuugaagcuuucacuucguaccguauugagcaacauggccaauuacuucauccaaaaauucuguagcacaguaaauucucauuaaucaagauuggccagggaagcugauguauuuauugagucaccacagaagaguaucaauuucuacuucuuccugauuuaguagaaaacagcccauuuacugcugggccagcacugguuguuuugaaggccaaauuucucauaccuuuuauaauagcauugcccaacagaacuuucugcagugauaaauguuuuauaucuguucuguccaacguagcagccaccaaucacaugugcuuauugagcauguaaauguggccauuuagacuaagaaaccguauuuuuguuuuugucuuaaauuaauggagccacacauggccaguggcuacuaaggagugccuuacuucacuuaaaucagaauaggaaauggaaggucaagaucucauaaggacacugagguuagaaguaugaagucaccugcuaguaaguuaguaaguuccuaacuagugguccuuccacaaggacuuauucacaacaauauuauugccuuuccaccaacugaaaaaaguucucaaacucguuucuguacaauaugccuaaugaacauuuuaacuuucuaaucaagcaugaaauaccauuaauuauguccuucugcuuauaguuccaccuuuaguuuuggcacgcuaaaaucuagcugcccuuauuuugaacaguguugaguauaaggaaggaaaaauaaagcuucuagagcuugaugaagcgcauuuccccagaaauaaccucucaauaugaucauaagccacauaaaagagcuugccaauguuaaccugcagguucuuuguaagguaagugaaaaaccaccacuacuuuuuuguggacaaauucuaacaauuuacuaagcaagucauuuggauuguggacuuucuuuuuaaggaguuuaaguaucuuaauaaaaacauaauccuuuccuugaagaucuuuaaagaaaaacugaauaaacaauuucccaaaucuuucugaaccuuaagaagcucaaagugaaauuuaauggcuuggccauucauucuaaaacugguucugcucaucagcccuuauuuguauacacuauacuggaaauaaagugagacugauuucucuugaacauuuuacuccuauaagcaguauuucuagagcccauaggccacuuuccugauaaacauauuaaauacauaauuuugacacaauaaagcugaaacaagaauagauagauggcaggcaacgaaccaguuuucagcccuggcucuguuggcuugcuauaugagcuugaagaaguuuuagguuucugaacuuuaacuuacucccauuugaaaaaggccacuguaccuaccaucaaauuccuuuggggagugagggaacaccaaauaagaucuguaaaaagggcuuggaaaauuauauugcuauauacuuugucuuuuuuuuuuuuuuuuuuuuuuuuugagacaagagucucgcuguguugcucaggcuggaguguaauugggcgaucucagcucacugcaaccuccaccucccggguucaagcgacucuccugcuucagcccuccugaguaacugggauuacaggcacgcaccaccaugccuggcuaauuuuuggauuuuuuuggguuuuuugugacagagauucacucuuguugcccaggcuggagugcaguggcgugaccuccguucgcugcaaccucugccuccaggguucaagcgauucuccugccucagccuccagaggagcugggauugcagaugcccaccaccacgcccagcuaauucuguaguuuuguagagaugggguuucaccaucuuggccaggcuggucucgaacccugaccucagugauccacccaccucggccucccaaagugcugggauuacagaaugagccacagcacgcggccuguucucauaauuuguuugauaauaucuaagauuuuuggaagcagucauuugcuaccacucuguuggcuauuuuuuaggccccuuaaaucucauuuuaaaaaaagcgacaccacuggcugggcaugguggcucacaccuguaaucccagcacucugggaggccaaggcagguggaucaccaccugagguuugcaguucaagaccagcgugaccaacauggugaaaccccaucucuacuaaaaauacaaaauuagccggguuugguggcacaugccuguaaucccagcuacuugggaggcugaggcaggagaaucgcuugaacccgggagguggagguugcugugagcugagaccacgccauggcucuccagccugggcaauaagagggaaacuccgucucaagaaaaaaaaaaaaaaaaccacaacaaaaaaacacgacaccauaaaucagaggcaauuuguggucaguuugcaacauuauaccaacauguaaacaagcauuuaaaaugggugauuucucaaagaucugcucugaccaacagcuaacuuuaguuagcugcacaaagacuagauucuucuuaccucuccuuucucucugcauccuuccuccuccuccaaaaaacauaucaaagauguccaugggggagccaaaaccgccaccugcuccacccucuuuaauugccuguucuccuccuuugucauauaauucccuuuucuuugcaucagagagaacuucguaagcuugagaaaucuguuuaaacuguuugagaaaagaggagugaauuucauuuuuuaaaaaacaaguguuaccuagcuacauuacacuugaucuuagcuaaaaaggccgagaagugaucauaguuacuauauuagauacucgauuucaggccauaauagaaauacuauacgucuggcaaagaacuauucagauacguuuaagaguagauacuauucaccuucucuccuucauuuggguucuuaucaggaugguacuucaaagccaguuuccuauaagccuuuuucaauucuuccugaguagcauuggguuugacccccaaaacaucguaguaaguuguuucuuucaccaucuucuacugccugaaauaagaaaaugcaacuuuaaccggcuuucaacugguagcuuuuaauaaaaaagagagcuaaggccgagcaaucucuuugcaaaauccgauuauaagaacaccaccuucccuaaauuucaccaaaaagguaacaauuccugcgauaauucagcuauaaacucgaacagacaaaacaaauaaucauuaucgggaaauaaucugagagccgccuucuagcagcugguuccaauuuuccuacaccaaagcuuccauacuaauauaacacaacuauuaucuggauucuucccguuugcccuagaggcggugacaguuguaaccaaaagaagcacugauauguucagucuaccggucauuacacuaucacugucuuuggcaaaucugauaaacuccauauacucuccagaaaaagacgucugggcacacaguggugggggggagugguuuauagaacagguuacuggcuccacacagcaagcccuccaccgcccacggcuuacagcuucuccagccgaaucccucucgccccucaggcuggcagaguuuaccugccagguuuccccuugcacuuggcgcugaccgauuuccuuccuuucucccucccacccuggacccaaguggcgguggggaaagcccagcccucaacaaacaaagggaggggaaacagagaaagcgaaaccaaaagccgcagucuccgcccggcuccccccgcagccccucgccccugccucccugugcgcgugcgcagggucgccaaccccacuccccccccccaccccgagcgagcacggacggggaggggggccgcgggggcgcgcacggaggggcagccgaagacaguagcuccuuggagaucccaggcuggggaaggagggaggucuaggaaaggucucgggcccauucacugugcgugccggggauggguugccagggcaccacaccagcccuccaaaagggaaaucgugggcccaggaacugacagcgguccuacccacgcggccaacugccucccgaccgcggcuccaucgguuucccggcgccaauggcgccagccaggggacuaggggcagcgcgagggcucaaacucaccggugcgggcugaggccggugugugagggagcgggaaggagcgccgagcugugcgcagccgggguaguuaccgcuccuccgccucucaccgagcguucuggaaaguuccgcccggcgcgccgcagccguccucuuuuguagccgaacccgggcgcgucacccgccggaagucc

SEQ ID NO: 191362 - RNA, 103220 nt, Homo sapiens
uucauggggaaguagcaauacagguauuuuauuucacauuuuauuaguagacagaugggcagaaaaagacaaaauaaaccacuaaaggggaagucaacacaaaauccgucagauaaucuuuucucauaaguuaaacugaagcaaaacaucuacaauuucagcuaaaacuauuaaagucagguguguccugcugguuucagaauaguugaaaauugcaucugaauccuuuuaguuguaaauguaaaccuuguuuguuuuaucaggaugggagggguggagaguuccuuuccaguggagagcugcacauuuccccuuccaaucaguuucuuacaacaugugccccaaacguaaggaaaccagcaaguaaagaagcaauuugccaggguaagggaaagaagguucuacaaaaaaguuugacuaauagaaaauaacucuggaaugauugauaaaaggagaaggggggaagacugaaagaaucaacagcagaaucauauacuucuccacccagccucaaaauacacagaacugaagagcaucuagugaggccucaauuagaacuaaaaggaaucuaaaaaugcaggauuuugaguucaugucacaucaaauaauaagcaaaacuguacguacaugguuccggauugagccugagaccuccacucccagaagggggaaaaaaaauuacaaacucaaguauuuuccacagggauguguucucagggacagagcucuggaaccagccucuggguuucguucagucagucuaaaauaccagaauguccaccugcuagcaagagacuuacccagucuucuggaacugauuguacucaucagaggcaaacccagcccuugacacuuuuaacaccccaaagggcugaaagguacaaccuccacuuggcgcuccggcucccugagucaaugucuaacagaggccaauagggccugauggaacagcugugcagcagagcaccucccgcaaugccagggugcuggggcugcccugggagugagaugcuuuagcaaaggggaaugaaaggcuuaauuuuagggcuccaagagaauaagaccaagcuacuggcuguaaacuugcauggggguuugggggcauuuugggggagguaaaucagcacugugagaggcuuuggcuccacaagauuugcagguuaaucuggaagcauuacuuacaaaguauggggaguaaaaagguaguuccaacaucuaugagaguuuguaaucagguaacuugacaauguauuacgaagcugcucuguuccauggaucugacuaaaaucacuagauucugggugcaaguagcaacccuggcccuguggagaucacagauucugggaccaggcucaacaguguccccuaagagccuugcuuguuaaacagucccauuucauaccagaccaaacuuuagaggcugggaagggcugcugggaccaaacuuuagaggccgggaagggcugcugggaagaagucauguguuugggaguuugaagagugaaaacccugagaucagaauggaaggaggagcuaaggaaguaagcgucaccuacucuggccauccuaggaucccuccugccccgucccuaaucugcccuuugguucuuucugaguuacgagccaaaggaggaguugacacuagugcccaggggucugaaauaggacuacagucaguccuugcugcauuuuccuucugaaaucugauuuuacauuauagcgguuuccuccaaauaaugcccuccuaugaucuggugcacccccauaacaaccaaaaauuaccuucaaguucugaagucuccuggauggugaaggcugcuggaucucaauauugauugaagcaacacgauugagaucuggaaaaucaaagcugcagcaagugcauugcaggaagaucuagccuuaucuggccuaaaaacugccugcagucaacucccucagcccugccacaauuucuaugcauaauucugcuugcacuccacagccuaaguauguugaaaggagaaaaaaaguucagaucacauccaaugaagaaggcgguaacucgucucacacacauccaaguuuuucacuaucaguauaagcagcucgaugaaaaccgaaaucuuaacacaugcaccuaggauuaauacugaguaauuaaaaguggcuacuuaaaaaacaaaaacaaaacgucaugguacgaguguauuuuugaugggaaggccaugcuaaaucuauaaaacagauguuuccucucccaacaguggucaccaguaguuucaacuuuuuccccccaguagcaucaaccaaacuuagcauagugauuuuuaacucuuugcucccacacgcacucaucccaacuuccccgcuugccccacucccuggggggaaauaacccugccuuuaaaauaaauagcaaccaagugcucaguucuauggaaaguaugaauauuuauuucaggcuuucgaucccaaucgauuucaaaaaacaaagucugauuucucuccucagagcagcugaggccuccauguuacgaugguuucauggagauugaaggagcacauuucaucaggcuuagcacaaagucccugaugcccaccaugucccagccuuaggaaaggaaagaaacagaauucaccaccauggggcugaacgaaugcacacacacuaauguaaaugagcagcuaaaccuuggcaaauuuguuuuuuuuuuuuuuuaaaguuuguuuuguggguuuuuuuccauuuucuuuugcuacccaguauaugcagcacuugugaacucccaacagguucccagcuuuaaacacauuaaacaucuugaaagacuauugaauucuucaagaaucuaaaaacagaccaaacguguuuugcugugaacauucuguagagacgaagugaggcgggaguuuggguucauauuuuuuaaaaaaagaaucaauauagugauggaaggguaaagaaugcaagaauucagacauucuguggaggguuacucucucuccauuaaagguccauaaaaaggagcaaacugagauccauaaggggagucagcaggagcuguguguguuuccccacccgcugugaauagguuuuugcugaggggccauggccagguccccacuugcuccccucccuuuggccugagauggcagggcaguacaggggcacugaaggagcacgucacgacuccucauucccagaaucaucaucaucauaacagucggcaucuuccuccuccucaucuucaucaucaaugucgucaucauacaagucgucguaaagcaaaucugagcuguugucauuggaaggcacuuuaguuuugaugcaguauuccgccaggguuguggggaccuucacuccauccuuuucugcuucggccuuaguggcugaaacuuguuuccugaagggagguugacacagaaaugguuuacgguaagucuuuuuuuaagacagauuuauaauuggccuuaaauaaucaauauuacuuaugacucagcucuccaaacuucaguaccugccugaaagcaucugacagauacccuguacuacaccaaaugcuuucaacccacuggguacaauuuugaaguaaacuuugacuuuuuaggaggggaaauacacuguuaauaucaagggaguuuaaagcaguggaucaauuauagccagaaucaccucgucaacuggcuguccuccgauucauguaagggccaauaggucggcgacuuaagaaucagaacagguauugacuuagugggcggaaugucaugcuuuguuguuugcaugugugaagcacagggauaacugccagaauaagaauagauaauagaagggcuaauacgccuccuaguuucuuggggcuagaucauaaagguugcauaugugaauaaaacgucccacucugguuuaaugugggguggggugcuuaggggauuggcuaggguuuuggccuagucaccucaccaccaaacucaagugccccaacaauucuuaauuuaauuauccucuuaauuuucacugacaguaaaauucaaaugccuaugccagauuccagugucuugcacgacccacucuuccccacccaagacggagucuugcucugucacccaggcuggagugcagcggcgugaucucggcccacugcaaccuccaucucccagguucaagcaauucuccugccucagccucccaaguagcugagauuacaggcucccgccaccccaccgggcuaaauuuuguauuuuuaguagagaugggguuucaccauguuggccaggcuggucucgaacuccuggccucaugaucugcccaccucggcuucccaaaguguugggauuacaggcaugagccacugcacccggccacaugacccacucuuguauuuucuccagcccuucaacacauucacccuggucuuuuuuuggcaucucggacacaccuuguugauuuuucugucuggaccaguugcucuuccccugccccacacaugccuggcuccuuccugucacucagaaucacggccucagauauuaaggcuuaaauaucaccuuagagaaggccuggccugacaacccaauuuaaagcagccaucuagucauucuuucacauuauccuacuuagcacuaucuaguauuuuuugcuugcucacucuucugucuccacauauuugaaugugagcguaaaugucuuucuuagucccauuuccccagucagugccuagcacauagccuggcacauaagaggugugcaauaaauacugauuguaugaaugaacaaacaauaaauuguuuccuucaacaauuauaaaaauuugagucaucaagacuagaccacucuuccugaucuuccuaaugucaaucucuuaguugugcuugaagcuuuucuucuguugccuugcuuugaauauugaugguccugaggcuucugggcuucaaucuccacacucucagcacucucccugggacaucaucucuguucccauaauuuuaaccaccacucccuuuaugcugacagcucuuggcuuauauaaacaaaugccuuuuggaagccucuguccuaauguuccauaugcagagguagacugcauaugcauuuucuaccucuauggacaguuucucccauuuuacuucucugaauaaaugagcauugcuucuuaaaauaauaaaucucacuccaaagaccuauugcuuuacagcuuaaauauuuuuauaucuguccccucauccccauuacuacuaccucaguuuaguccauguugguccccuggccaacuauuugauuuuuuuuuuuuuuuugagacaaggucucccacugucacccaggcuagagcacagugacgcaaucucagcucauugcaaccucuggcuccagagcucaagcaauccucccaccucagacucccaaguagcugggauuacagguauaagccaccucuccuggcuaauuuuuuuguagagaugguauuuugccauguugcccaggcuugucucaaacuccugggcucaagcaaucugcccgccucggccucccaaaguccugggauuacaggcgugagccacugugcccagcugacugucuuuuuuuuuuuuuucuuuugagacggugucuugcuuuguuucccaggcuggagugcaguggcgcgaucucagcucacugcaaccucugccucccggguucaagcaauucucuugccuucagccucccgaguagcugggauuacaggugugugccacuaugcccaacuaacuuuuauauuuuuugguagagaugggauuucaccauguuggccagguuggucucgaacucuugaccucaggugauccacccgccucaaaauguugggauuacaggugugagcuaccacaccaggcagccaauucuuuuaucagaacucaaauagcaucaccucuucccucccaaaaauauuuaagugguaccccaucacuucuuacauuaagaaccauacucuuaucaugacuucaaugucuuugaagacccuggugccucucuugcuuaauuuucuaauauuucccacaucagaauuuacacucaagcauuuguaauccccuuaacaugucaugcuguuauacuccuguauuuuagcaaacauggguauuuucccuuuuuucaccugaaaaaguauugguuauaaggaauuaucucugcuaggaaaucuauuacauuauauauuucucccaguguaucuuguuuaggcuucuauagguauaauacuacauggucauuuguuuucaaaugcuaauaaagugagcucccuaaggagacaggcuaugccuuaaugaguaccuaacacaaagcuguugcuuagugucagguacuguacuaggucauuaaggaauagauagaaugagauaaacggacccuuaaacaaauuaagaaauauauagaaguaccuugggaauauguauaccuaagcuuucugaucuuucaauccuuaguacacucccacuccucuaaauuucuguaggaucuuaauauuucuacuaauuaucuucaauguuugguacacaucagucaccuaggugagauauauauacacacacagaugcccaaacucuguccuuguaaucccauaaaagacagcuauuguuuagggacaguuuaaaagugaucccaaugggcagaaaacuuagaacugcugauuuuauauuacucagcagucaccucauguccuuucccagcauuguuuuaacuuuuuucauaucacauggucucaagccaacuagauuuuauucuuauuuguauaaaugccaaugcuuagucaacuccuaugcacagaggaagcuguaacuguauuuggggucucuauuuuaagaaauaaaaauguaauaucaagggggguggaggccaggcacgguggcucacaccuauaaucccagagcuuugggaggcugaggcaggaggaucacuugaggccaagaguucaagaccaggcugggcaacacagcaagaccucaucucuacaaaaauaauaauagaaauuagcugggugugguggugcaugccuauagucuuaguuacucaggaggcccaggugggaggacugccugagcccgggaauuugaaguuaccauguaaucacaccauugcacuccagcccaggcaacagaguaagaccaugucuguuucuuuaaaaagagguggaggaggcugagugcaguggcucacgccuguaauuccagcacuuugggaggccaaggcggguggaucaugaggucaggaguucgagacuagcuuggccaacauggugaaacccugucacuacuaaaaauccaaaaauuagcugggcauggugguaggcgccuauaaucccagcuacucgggaggcugaggcaggagaauugcuugaacccaggagauagaggcugcagugagccgagaucacaccacugcacuccggccuggaugacagaguaagacuccaucucaaaaagaaaaaaaaaauuaauuagaaacaaauaaaaaagagguggaggguaggggaaguguaggguuuguauuuauugcaaauuucuuggguacuauuauaagaaccugauguccuaagagauuaaagguuaagcuuuuuuccauuuuauacagaggagaaaguaaaagaccccaaaaauuaucugauaaauggucccaugaguagauuccaaguccccugaaucuuauucuagggcucuguuauaccauacauuaguguugcugauaaugaggauuuccaaacaauccuugcugcuauggucaggaaugccaauaaacuggaaggcuuuauuuauucaauuuuuuuuuuuuuuugagauggagucucgcacugucgcccaggcuggagugcaguggugugaucucagcucacugcaacauucaacucccggguucaagcaauucuccugccucagccuccugaguagcugggaugacaggugugcaccaccacaccuggcuaauuuuuguauuuuuaguagagacaggguuucaccauguuggccagccggucucgaacuccugaccucaggugauccgccugccucagccucccaaagugcugggauuacaggcaugagccaccaugccuggccagaaccuagaaguucugguuccuagaaaaucaggucugcuacugccuuaucuucuaguggcuguucucucgguaaacagcaaaguucuuuaggcucaggcagaaaucuucucuucccacacuauaaaucuaauagaggaaaauuauccuggaauggacaggauauuuaaguuugauuuaaacccuugguuccagaauauauuuugguuuuguauaacuugagguaauaaaaaaaaaaaccuuaccuaauaauuucagcauauucuuugucuuuuccuuuacugucucuccauuuccugaacauaacugaagcaucgacauuggcuggggagaagguguugggcucauuaagcagugagauuacacuuaauaggauaguccuagaaacaggaaaaaaggaucagcuaugaauacccauauuuacaguauuuaaaaguauucugcuuuuuaagauaguacaaucagauuucaaauucucccucccuuaaaauuuuucugauacaauuaaauuuaagaccuugggggaauagagauauaaauuuuuuauugauaguuuucauaaaaggcauuuaagaaaaauaaaaaaaaauuuuuuucagcacuaagaaacaagcugcuaacuggcaggcaaagcagaggaaaucugugauucuaguauaaggguaaugcacaagugauucuaguauaaggguaaugcacaaagcauaaaaaugaacuugauagaaggcccuguuucaacuggucacauguuccaaccuacagaaagcagaugucuuagaagcuuucaaauacuguuuauuuuaaaaauuacaaauuaaauggcaugggggaaaaagcuuaaaauauuuaguuucaaggcaaucuugaugugggagcugguaaaaaugaugcuauucuauauaaccagguuuuuuuuuuuuuuuuuuuuuuuuuuuuuuuuugagauggaguuucacucuuguuccccaggcuggagugcaauggugugaucgcaaccuccacaucccagguucaagcgauucuccugccugccucagccucccgaguagcugggauuacaggcgccugccaccaugcccugcuaauuuuguauuuuuaguagagaugggguuucuccauguuggucagacuggucuugaacuccugaccucaggugauccgcccuccucaaccucccaaagugcuacgauuaaaagcaugagccacuacgcccggccguuuuuuuguuuuguuuuguuuuuugacagggucuugcucugucacccaggcuggagugcaguggugccaucucagcucacuguaaccucugccuccuggguucaaguaauucuccugucucagccuccugaguagcugggauuacaggcauuguacuaccacgccuggcuaauuuuuguauuuuuaguagggacaggguuucgccauguuggccaggcuggucaugaacuccuggccuuaagugaacugcccgccuuggccucccaaagugcugggauuacaggcaugagccaccgcaccuggcccuauauaaccaguuuuuauuguggccucuuaaccugaaaaacagugcuacauccaaauguauuuuuuccauacuuggaaggaagacagaguaaugcaggagaauggaggaaaagcaaaauccuucaaacagaagaacuagagucucugaauaauagaaaucuuuauucaaaaguauuuacuauguaccuacugugugccagaggcaccaagugagaugcuggauguacaauggugagcaaguuagaugccaucccuggucucccauggcuuacaaaucuaguggguguuacaaacggccaauuuucauccacagauaaaaauuagacauuccaaauaaucagggaauaaaguuuauguuagaaagcauaauaggggccaggugcaguggcucacaccuguaaucccagcacuuugggaggcugaggcaggcagaucaugaggucaggaguuugagaccauccuggccaacacggugaaaccccgucucuacuaaaaauacaaaaauuagccaggugugguagcaggcgccuguaaucccagcuacucgggaggcugagacaggcaagagaauugcuugggcacgggaggcggaggcugcagugagcugagaucacgccacuguacuccagcaugggcaacagagcaagacuccaucucaaaaauaaauaaauaaauaaaagcguaauaggcuccaaaacuguuccaaauuacuccuaggcuuuuucccccuaaaaauuaugugcauuaggagaaaaugggaggaaaaaugaaauuucucuaucuuuucucauugaugaaagguuagagauuguguuguuguaaaauacccuuuugcucugggccccaagccaaaaauaaagggaggaaaccaggcaauuagauguuugauuugaugaaaacuuuuccuuaaaaaggcgaagaauuucuguuacaugauuuuauacaagauuaugacaaaggcauuuucaaagaaaacauuucuaucuaauuaaaauccauugaucacacaugcuccuauuagguuaaggauaacuccuuggccuuccucccucaagagcuuucuggauuucuucaguaauuacauuaaaaagaaucgaagaagcccaggcgugguggcucacgccuguaaugccagcacuuugggaggccgaggugggcagaucacaagguaaggagaucgagaccauccuggcuaacauggugaaaccccgucucuacuccugggcucaagcaauauuccugccuuggacuccuuaaguacugggauuucaggugugagccacugcuccuagcuggaaaaacagugcuuuuaaauuuuuauuuauugauuguugagaugggguuucacucgucgcccaggcuggagugcaauggugugaucuuggcucacugcaaccuccgccucccggguucaagcgauuucccugccucagccucccaaguagcuaggauuacaggugcgcgccaccacaguuggccaaauuuuuuuguaucuuuaguagagauggguuucaccauguuggccaggguggucucaaacuccugaccuuagguuauucaccugccucagccucccaaauugugggacuacaggcgugagccaccuugcccagccagaaaaauagguuuaauugucuagaucaguacuguguacuaauaacuuucaaugacgacgacgaugaugaugaugauaauguauaaccuaugcugugcaauacaguaaccacuagccacaugcagcuacuaagcacuuugaaauguauccugcacaaaugaggaagugaauuuuaauauuuauuuauuuauuuauuuaaagacagggucucacuauguugccccggcuggaauacagaggcuauuuauaggcgugaucauagcacacuacagccucaaacuccugggcugaagugauaauccugccucauccucccaaguagcugggacuacaggugcaugccacugugccagacuaguauuuaauuuuaauucaaauguaaaaagccucauguaguuagaggcuaccacauuggacaacacagaucuagaugaauccuauuacuugaauuaagaaaaaauucccacaaguacuuucaccuaguugguuuucuuacaucuuguguauuaagaugauguguauauugggaaacaaauuuuuaaaugguaaaucauccauaucuaacaaaaugagaaauucuaauuccauguccuccuaaguuaaaaauccaggauguuuuaagaggcacugaguaauacagcagacuaauauagugguaacugucaacccaguaaguuuucuucugucugaagagcaggaucuuuuuucugucugaagagcagaaucuuucuuuuucuuuuuuguauggggaauaaucuccuucuccuaccauugugccacaccuccuauacaaacaaccuaccuaccuacagcaguagacauaagaccaagcaagugcugaaaggauuccaucccuguuguuauggcgaugcauuugaggauaugcaugugaccuaaccugggccaaucagaagccuggugggaacuauucuugauuagauggacaccugugagaauaaggaaagcugacagcauuggucuccucaggcagauggauggaugugaacuggaaaaaacuaaacugcugagauaauacuguuggaauacacaaaauugaauuugaauuuaagaacuauuucaggcggggugcgguggcucacaccuguaaccccaguacuuugggaggccgaggcaggcggaucaccugaggucgggaguucaagaccagccugaccaagcaacauggugaaaccccgucucuacuaaaaauuagccagguguaguggcacauaccuauaaucccagcuacucggaaggcugaggcaggagaaucguuugaacccgggagguggagguugcaaugagccgagaucgugccauugcacuccagccugggcaacaagagcgaaacucugucuuaaaaaaaaacaacaacaaaacaaaacaaaaaacuauuucaacugcuagcucauuuuuuuguuuaaaaaaugaguuuaaguguuuaaaauccuuauucauuuacuguauuuucucaggagaaacaagagguuggacuagcaaaauagacccugagggcccaucauccccagacucucgguuccuauaaagaauaacuguaguacccuuugcuuuccccgccccuccacaagaacacacuggugcaccacccuucucuacuccacgucuagaggaacagaucugaucuaucucaauccagcagaauacauguuuaacauuuauuacaacaaagaacagaccuagagggaauuugggauaagaaugagggccagagaguucuuagucucugugguucauuacacaauucccacugccaccauucaaggaguuagagauacucccagaaauaaaugugcuccuucugccccucuuuaugccacagcgaggcaauaagauaggucuuuucaggauagaggaucuaggccaaaagagaaaaaugcuaagaagagaaaggaaacacagaaaaaaaggacaggcaaaagcaccucacuuuacagucuugagguucauauuucagauccuuuugccugcuucaguuaucuuuggucagagguuauuuagcuaucuuguucugaauaaaaaauaaguuuguaaacaauaaaaacccucaaagaaaaugaagaccaacacaucauauauaauauauauugcagacuagccaacagcaaaucaagcugugaaguucugcagagcucauauguguuuaaaagacaaagcaaacuugggucucacccggcccccaggcuccagugcaguggcagaauuacagcucacugaagccuugaccacuugggcucaagugaucuuugcaccucagccuccugaguagcugggacuacaggugcacacuaccaugccuggcuaauuuuuuugguagagauggaaucucgucauguugcccaggcugguuuugaacuccugggcucaagcaauccaccugccuuggccucccaaguugcuaggauuaaggacaugagccacugcgccuggccuaaagaaguauuuaagggaaauuggaaauuaggauuguaugacccaaugcguaauacuccauuugcccauuuucaacaugucgauaacccuuucucuguuagcuacuaugucaccauaagcauaacuuuaacaggguugugauagcccuagcaucacaaauaagaccuggcucgagggucugccuggaaaccaagcaagaaaaguucauaauuuugaaggauuacagacuggcaccuuccccuggucccaccucccauguauauaucaucccuccagacagcaugggagaaguagaaagggcuuauuccuaaaaaccaaaaaaucuaagcuuaugccaggugugguggcucacaaguauaaucccagcacuuugggaggccgaggugggcggaucaccugagguugggaguucaagaucagcccgacuaacacggaaaaauccugucucuacuaaaaauacaaaaucagcugggcaugguggugcaugccuguaaucccaaguacuugggaggcugaggcaggagaauugcuugaacccaggagacggaguuugcagugagcugagaucgcaccauugcacuccagcugggcaacaagagcaaaacuccauuucaaaacaacaacaacaacaacaacaacagcaacaacgacgacgacgacaacaacaacaacaaaaccugaacuuacuucacgccauaaucaugggcaagcaugcauguaugcacaugugcacacacacaaacacacacgcagauugauuuagauauugaguuuuauagacccagcguaaugugaugacaguugaugugugaaguccaggucucuggagccaaaccuaaauccugcauacuguuacuaccacucuuacugacucuggguucuacccugaccuuucuaguuguccuggguccuuaaaaucucucauuuccacucuaucaaaggaugggccaguaacuacagaugacuaguuaaagcucaguccucauugcauguuucaaugugggggagggauuuaaagaggacaucaugacaaagaauaaagaagccuguuaugauagggaaaacagggcaacugaugguaaaauauaguagcuuaacggguuuacauuauuauaaaguuucucuuuaggcugcuaaagcaaccaacaaauauaacaccuccuucugugcagugcuggaucugcugcugacugauguaucccugagaaugcaagguaggaauacaacuacaguuuuuaaaugcccaaauuauguaucaucugcagagaauggaauuggcagguugagggcagugggaccccaugcacaaaaaccaaggaagcaaauaaauaaaaccacacuguuccagaauuggguuuaaaagagcuuuaggaacagcaugguuaugccuguuuccccugacugugcuuacuuuggcacccaaugcuaggggugaugucucuggcucucuguucuuaagacuagacagaaaaauauccuaccccacuucugagacagacucuuuuauaccaaacaacagccucucuugauuggguuaauaaauuugguuucacgcuuuauuuuugaaauugaaaaagaaaacauuauguaugccucuuucaacauaaagcaaauccacaccaagaccacuucaccaucccagagccuauagcagauaguaguucuggggauggugucucacagaaagcagcugugaacucuauagcaaagucugagggcuuugcuacucccacucccacccuacccuauccccaaagcucccacaucauucuagacaaaucauguauuaaggcacauuuuguuuccuccaucaggaagaggcauaaugcugugaacuucuaaucaaagacguguggcaacucccaacuccauucuugcugacaaaugccuacuccuuaaaacuuuccaauucaggaagaaacucuccccaccaccuccagccccaccaauuuaauccugggccucugggaggaggaggccuguggauguuuucuuucaaaagaaguaugcugguuuucccaagagguagcaagcuaccgagccuuuagugaacaccaguuggcugauucucugcaucccuaaaauucuuccuuuucagguuggcuaacucucacuacucaccagaucugauaauacagacugacuuagacucuugaagguaacuggagucccuuauucuucaaguuacaaaagugcuccauuugccacuuuauguuauaaauauguccauugaggugcugaacaauagucuugaguacacgugguuauggagaagaaaaccaaauacgugaauauggaaucacuuucagaugccagugagaggcagcagauaagacuccaaaacaggaugagaugaacccuaugccaucuccacugcugucuuacuacagccacccauaaacuggacauggagcccagaacccuuagacaguugcuggcccuagauaauuuagcagcagagagguacaagaaggaaaauaguugcccauuuccacuacaucuuguaucuucccucuuaauauuucagugccauaaaugaccuguuagaaaauauaacaguuuacuacuuuaaaaccucccuugucucacaaccaagugaacacagaaacaaaagggauaagcgaaaguauuccacaucugcucauuagguagugcuuuccugacuuccgcucagaguucugagcaccaccagguauuccagacaggugagguuccaaaaaguguacaaaacaucccacagcccccgaaaacaccaauaagaucaaaauguugaaggacuacccaaugauuacauagaacuaagugauaaaaagucuaagaagguaaacaauuuccaacccaaauaccuuguagagcugugugaagauguuagguguaacuccacauaacuaguuguaguugggaagcuucuaaacaaagcagcauaaaagcagggaaaacaaucuugauuugaguauggggaaugucccuaaauuguggcucagguggccuggggacucaagugugaggaaacaaaaugaugcuaguacccaaaguaacaaaggcaguuucagaugggcagauaaguauaaaaggaauccucugccuccaaaagacuggauuacaugagaaguaggccuauuuuaaaagaaaaaauguucauaauacuuuaagcugagauaaggcaaaugacaucauuugcguguaaaugcaagagaaguaaaggauaaaaagccugaauucccaugggugguggcaauacauuauccagccaagcagcauaaaaaugcaaugaggaaaaucuuguuuggggcuuuguauuugaggaaaggggaagcuuauuuucucaaauagggagaggguguaagcauuugauucaacguucaaccagcaaaaccaagaaucaccaguauuauagcuaccacuuccucuaaucuaggguuauuacucguccugaaaauccaugcaccagaaucauuauuaaaguacaacuggggauuuuuuuggaugcaauuuuuucaacaaaucauccaaaauauuuuuuaaaaacuuuuauacacauugucuaauuauaaugucaaaauaaugugcuacaauuacuucugaagacguagcacccucaaacauacucuugaguaauauagaauacauaaaacucagacuuuuuuuuuuuuugagacagcguuucacucuuguugcccaggcuggagugcaguggcacgauccuggcucaccgcaaccuccgccucccagguucaagcaauucuccugccucagccucccgaguagcugggauuacaggcaggugccaccaugcccagcuaauuuuguauuuuuaguagagacaggguuucuucauguuggucaggcuagucuugaacucccgaccucaggugaucugcccaccuuggccucccaaagugcugggauuacaggcgugagccacugcgcccggccuacaacucagaauuuuuaauacuaauuuaaaauugagucuaucgagauaauucauguauacauaauuugcuacguaggacacuuuuccccucaaaaaaagaaagcguauucucaauuacagaauaucucaaaaacagcucaaaacaauuauuuuaguucuuuucauguauuuagaacccaagauaaauuauguacuacuugaacugguuacgauacaggcaucuagcaauuaugucucccuguagcaaaaugaaauaaauaugaggaacuaagaaauguguuucucuucuaauagauagcaaaugacugcuucacauuagacccaaaaaauuccuugaaaauaauagcugcaacccaagccagccagguaauauccaccauucuaguagguuuacaugcauuauucacuuaaauucuaucaacaaccuacugagguagguauuauucuuguauagauaagagauucagaaggcggguguagugugagcaccuguaaucccaacacuuugggaggcugaggcaggggcaucacuugagcccauggguuucagaccagccugggcaacauggugagaccccaucuuuacaaaaaacuuaaaaauuaguccaggugcuuuggggcacaccuauaaucugagcauucugggaggccaaguggauugcuugagcccaguaguuugagacuggccugggaaacaaagcaaaaccccaucucucuacaaaaaaaauacaaaaucuugagcagacaccgugaugcaugccuguggucccagcuacccaagagacuaaaguggaaggauugcucaagcccgggagguugaggcugugcugagccgugaccgcgccgcuucauuccagccugggcgacagagcaagauccugucuuaaaaaaaaaaaaaaaaaaagaaauaugagaaaaaaacauucagagggaugaugguugucaaggugagguguaaaaacacauuuauuugaauuuagaaagaaaguaacauuuuuugucuuaaaaaauauauugguaagauaugcugaaaucuuuaauauaucuauuuucucaacucuuucuaaauaaauuggauggaacaagguacccaaaggaaugaguaacaaacauaaucaacagucauuugacacaucuugaagagcuucuauuacaagucaggaagcuuccaauucuucacuuuugauaaaccuggagauucuaaucaaguuauuaguuuuuguaucaguaaaaauguuuaacaaaugauugaauaaacaaauaaaggggaagaauagaucaauccaugcagaagaauucaaaauaauuuauauagauacccuggcuucaaggagguauagccacccucuccuuaguugugggcuaugcauauuccuuccaaggaguacagaaugaaaaguucaggaaagagcaacuuuacaguggagaaaagcuaaaaauauuauuucaggcaggugaugaaagguaucccaucaacagggauaagccacacugauaguaaauacuucagauaugacauaaugaaaauggcacauuacuucucuggucuuucucucccaaaccuauaacccuagacuaaucaugagaaaacacauaagaaaaaucucaacugggggacauugcacaaaauaccugaucaguaccccccaaaauugucaucaaaaacaagaaaauuuauaaucaagaguugcuuaauagcuagguaugguggcauacaccuauagucacagcuacuugggaggcugaggugaaaggcucacuugagcccaggaggucgaggcugcagugaccugugaucacaccgcugcacaccagucugggugacgggaagacacugucucaaagacaagagacagagacacagacagaaacagagagagagagagagacagagacagagagagagaggaguugcccaugaagacaugacuauuaaauauaaugugaugagcagggcacaguggcucaugccuauaaucccagcgcuuugggaggccaaguggggaggacugcuugaggccaggaguuugagaccagcugggcaacuuagugagaccccaucucuacaaaaaauuuaaauacauauauguauacacguacauauauagauauauauuuauauguaugaaauauuuuggagcaaaacaacgacagguaaaaacaaaggaaaugugaaagcguauggacuucaguuacuuauaaugaauuaacauuguuuauuaacugcaaccaaugaaugacacuaauguuaggugguaauaaagaaccagaguagaacuaggauaaguuaagaguagggauucaggcuugaaaaucuauuccuaagugaacauagggaaaugagaaucauauacauuauuguuuaguaaauacagcucuucaaaaugacgcauacauauuucuuaaagcucuagcuaaagacaaagaaacugaauauaagaaagaugauuuuuuacauguuaaaagacaauacauaauuuuauuuuacuaggagcaaagacaauaaggagauuaagaauaacuccaaaaccagauuccuccuuaccucacauucugaguaggauuccaccuuucagaaggcaguucuccacucugugggucaucuacaggcggaugaagaaucgaaaugcauacaucuccauucuacaagacacaaacauuacauucaguaaauacucaaaaagugauguacaaaaagggacaucgguucuaaaguuuccuuuauuccuagaaacuguuucuucaucaaaggagaaaacaauucugcuuuuuauguucaacaucaaagauaaauaauaauuaagcauuuuaaaaguauuuauuuugaccaaucuccaagguauauuuucuagugagaagacuuacuauuccuauagaacaauccugaugaaacaaacgaucccuauguuuacuuaggaacauuaaaauauaauauuuauuucgaccaaucuccaagguauauuuucuagugagaagacuuacuauuccuauaguacaauccugauaaaaaauugacuggggcugggcgcggugucucacgccuguaauccuagcacuugggaggccaaggcggguggaccaccugaggucaggaguuugagaccagcauggcgaaaccccaucucuaccaaaaauacaaaaauuggcugggcgcgguggcucacgccuguaaucccagcacuuugggagaccaaggugggcagaucacaaggucaggaguucgagaccagccugaacaacauggugaaaccccgucucuacuaaaaauacaaaaauuagccgggcgugguagcacuccccuguaaucccagcuacucaggaggcuggggcaggagaaucgcuugaaccugggagguggggguugcagggagccaagaucgcgccaaugcacuccauccugggcaacagagggagacuccgucucaaaaaaacaaaaacaaaagacaaaaauuagccgggcgugguggcacgcgccuguaaucccagcuacucaggaggcugaggcaggagaaucgcuugaacccgggaggcggagguugcagugagccaagauagugcuccggccugggcaacacaaugagacuccaucuuaaaaaaaaaaagacaaacauaauaaaucaagacucaauugucuuagaagcagccaaauauauaucccuuuguuuucagauauaucuguguaccuagaguacauaaaaaggaagaaaaaauaucuaaccuugcuuaauaucuacucagauagaugcuaugucaauaaccaugacuuauauaaaccaaaaauaugccucgcagcaaauguuaacauccucaagguaugguuagaaugacuucccacuauggcuauuauauuuugcuucauaaacuuaacacaacuuaauccacaaguacauuuagguuaauucauacacauauggauugcccaccaugugcaauacagaacacaauucaauagaaaagauaaaguuagguaaaauacagugacuuaucucuuggacuuagccuaacauggaagguaagauuuauuuauuuauuuaacuucuuucugucuuuagagaugggagucucacuauguuaccuaggcuguagugcagugauuaugcauaagacaaccauggugcacugcagccacuaacuccuggccucaagugauccucacaccucaguagucccauagcugggacucuagggugugcuaccacacacgacuuaagauuuauauuuuuaaaaaacuggagguauaacuauauaaagugcaaaaaucuuacauauacaacccaaauuuagacacauagaaacuauaugaauauauauguaaccauuaucaauauaaaauauuuuuaaaauaaaauuaauacaaaauauuauauucuaacacacugccuuaugguuagauaccauaaggcauguaaaaaguuacuacagauaaaagaagagagaggccaggcaugguggcucacaucuguaaucccagcacuuugggaggcugaggcaggcagagcacaaggucaagaguuuaagaccagccuggccaguaugaugaaaccccaucucuacuaaaaauacaaaaauuaacugggcgugguggcaccuguaaucgcagcuacucaggaggcugaggcaggagaaucccuugaacccgggaggcagagguuacagugagcugagaucacgccacugcacuccagccugggcggcagagcgagacuccaucucaaaacaaaaacaaaaaacaaaaagaagagagccgggcgugguggcucacgccuguaaccucagcacuuugggaagccaaggcgggcagaucaccugaggucaggaguucgagaccagccugacuaacauggagaaaacccaucucuacuaaaaauacaaaauuagccaggcgugguggugcaugccuguaauccuagcuacucgagaggcugaggcaggagaaucacuugaaccugggagguggagguuguggugaaccgagauugugccauugcacuccagcuugggcaacaagaccaaaacuccaucucaaaaaaaaaaaaaaaaagaaaaaagaaaagagaaacuugguauauuugggcagugaaugcgugggaggugggguggaagauaaaaggcuuuguuguugaggaagcuuugagaugagcuuuccuuuaauaauaacaauuuaaacaaccuaugggaaauguagaaaugaguuuuucuggccaggugcaguggcucacgccuguaaucccagcacuuugggaggccgaggcaggcagaucacuugaggucaggaguucgagaccagccugaccaauaugaugaaaccccaucucuacuaaaaauacaaaaauuagccgggcgugguggcacgcaccuguaaucccagcuacucgggaggcugagacaggagaaucacuugaacccgggaggcggagguugcggugagccgagaucacaccauuguacuccagccugggcaacaaaagcgaaacucuugucuccaaaaaaaaaaaagaguuuuucugaaucccagcacuuugggaggccgaggccagcggaucacgaggucaggagauugagaccauccuggcuaacauggugaaaccccgucucuacuaaaaauacaaaaaauuagccgggcgugguggcagacgccuguagucccagcuacucaggaggcugaggcaagagaauggcgugaacccaggaggcggagcuugcagugagcugagaucgcgccacugcacuccagccugggcaacagagcgagacuccgucucaaaaaaaaaaaaaaaaaaaaaaaaaaaaaauuaggccacagaaguaugcuacuugguucagagcguaauauauauuaaaaaaacaaacaacaaaaaaaaaacacaaaaaacacaaccuucuuaguaguggaaugaacucaacagauuugcauuucaaaaugacauauuagaaaauaggcauccaaauugacacagacaauggauuugacaaaaucuaacacucuuucaugauaaaaacaaucagaaagcuaugaauagaugggaauuaucuuaacaugauaaagggcauuuauuaaaaacccucaguugcuaggcacgguggcucacgccuguaaccccaggacuuuggaaggccaaggcgggcagaucaccaggucaggagaucaagaccauccuggcuaacacggugaaaccccgucucuacuaaaaauacaaaaaaaaaaaaaaauagccagucaugacacagcgccgguagucccagcuacucagaaggcugaggcaggagaaucgcuugaacccaggaggcggagguugcagugagccgagaucguauuacugcacuccagacugggcgacagaguaagacuccaucuaaaaaaaaaaaaccaaaaaaacccacagcuaacaucauacucaguggugacaauggugaaagacuaaaagcuuuacuccuaagaucgggagcuugacaaggaugccugcuuucaccacugcuauuuaacauuguacuggaaauuucuaaccagaguauuuagacaaggaaaagaaaaaaaggaaacugaguugaaggggagaaaagcaucuuuauacacagaugacaugauccuauauaagaaagcuacaaaagcuaauaaauucaggaaaguuauaggauacauaaucaaaacucagucacuuuuauuuuuauaaacuagcaaaaauaaccuaauaggauauuaugaaaacaauuccauugauaauugucauuuaaaagaauagaucuggccaggcgggguggcucacaccuguaaucccagcacuuuggggggccggggcuggcagaucacuugaggccaggaguucgagaccauccuggccaacauggugaaaccccgucucuacaaaaauacaaaaaauuugccagacaugguggcucaugccuguaaucccagcugcucagcagguugaggcaggagaaucgcuugaacccgggaggcagagguuacagugagcugaguacgagccacugcacuccagccuaggcaacagagcgagacuccaucucaaaaaaaaaaaaaaaaaaaaaagagagagagagagaauaaaucuagucauggaagggaaaagacuuguacguugaaaacuacaaaacggugcucaaagaaauuuuaaaagaucuuaaaaaauguagaguuacgauguuaagaugguucuauuccccaguuugaucuacagguucauucaacacaauccuuaucaaauccuaccuucccauuuuacaguuauugacaagguaauccuaaaauuuauauagcaauuuaagggacccaaagagccaaaacaauguggaaaaagcaaaaguuggaggauucacacuuccuaauuuuaaaaauuacuacaaagacaaccauguuguucaguacuggcauaaugacagacauauaaaccaauggaauauaauuuacaauugagaguccagaaauaauccaauacauugauggccaauugauuuugacaaggaugccaaguccauucaauggggaaaaaacagacucuucaauaaaugguagugggacaacuggauuucuacaaacaaaaaaaugcaacugaacuccuaccucaugucauauacaaaaauuaacugaaaauagaucaaagacuuggaaauaacugcacuucauuaaaauggaaaacuuuuaugcaucuaaaggacauuaucaagaaagugaaaaggcaaccuauagaaugggagaaaacauuugcaaaucauauaucugauaaagguuuaauauguauaauauauaaggaauuccuaaaacucaguaacaaaaagauauccauuucaauaauagggaaggccagguacaguggcucaugccuguaauuccaccacugugggaggcugagcggggaggacugcuugaggccaggaguuccagaccagccugggugacauaaagagacaaggucucacuuugucucucaggcuggagugcaguggugcaaucucagcucacugcagccucuaccucccggguucaagugauccuuccacuucagccucccaaguaccugggaccacagauaacagccagcaaaccuggacaauuuuaaaauuuuuuuuauagugauggaguugcgcuguuacucaggauuguccugacuucugagcucaagcaauccuucuaccuuggccacacaaacugcugagauuacaggugugagccaccacauguggccccccccaaaauuuuacuagucagguguaguggcacacacuuguagucccagcuacuugggagguggaugugggaggacugcuugggucuaggaguuugaggcugcagugagccaugacugggccacuccagccugggcaacagagcaagaccccauuccccaaaaauaaaugaaaaauaaaaaaugagcuaggacagacauuucuccaaagaagguauacaaauggccaauaagcacaugaaaagaugcucaacauaagccauguggguaaugcaaagcaaaaccacaaugagcuaccacuuuacacccacuuaggauagcuauauuuuguccuuuuuuuuuaaauauagagauggggaucuugcuauguugcccaggcuggucucaaacuccuagccucaagcaauccuccugccuuggccuuuaaaagugcugaaauuacagaugugagccacugcaccuagccuuuuuuaaagaaaaggaaaauaacaaguguugguaaggauguaaagaaacuggaacacacacacacugcuggugggaauguaaacaguucagcugcuaugagaaaaaauuuggcaguccauuuaaaagauggcugggcacaguggcucacaugccuguaaucccagcacuaacaggaaaauggguuuaaaaaaaaagaaaaaagaaggaagaaaaagucagcugggcacaguggcucacaccuguaaucccagcauuugggaggccaaggcaggugaaucacuugaugccaggaguucuagaucagccuggccaacauggcaaaaucccgucucuacuaaaaauacaaaaaauagcugggcgugguggugcacaccuguaaucccagcuacuugggugguugaggcacgagaauagcuuggggccaggagcagagguugcagugaacugaaauccugacugcaucccagccugggcaacagagugagacucugucucaaaaaauaaauaaauaaauaaauaaaaaguuaaacauagaauucccauuuaaccccacaauuccacuccuagguauguaacccaaagaacugaaaacagguacucaaaaacuacaugcacaugcauguucagagcagcacuauucacauauacaaaagggagaaacaauccaaauguguccaucaaaagauaaauguagaaacaaauugugguauaucuauauaaugcaauauucuucagccaugaagaggaaugaaguacugauacauacuacaagguggaugaaucuccaaaauauugugcugagugaaacaagccagacacaaaaugucacauacuauaugacgcuauuuauacuaaauaucugcaauauguaaaucuauagagacagcagaugagugguugccagagauugagggaacaugggaacggagagaaauuacuucauauguaguguauuuuaaguuggagugauggaaacgcuuuaccacuacauagagguauuaauaguuguacaacauuaugaacauacuaaauguuauugaauugauuauuuauuuacuuauuuauuuaugaaugaaggauacagucuugcucugucacccaggcuggugcaguagcaugauuauagcucacugaaacuucgaacucuugggcucaagggaucucccugcaaauuguuuacuuuaaaugguuaauuuuauguaugugaauuucaucucaauaaauucuuuuuuuuuuaauaaggaaguuauuggacucuagaauggggauucuaaaagauaaaaugaagaauuaucuagccuacaccccauccaaauccaauuaaauaaaaauuuccaggauucuuuuuaauaacuucuccacaugauucugauauauggccaaauuugggcaugucaauacuuaggaaaccuuuucccuauaucuuaaaauguuaagagaaaauggauaagaucuguaaauccaagaauuacauaaauaugcauaaaauccugcuugugacaaguuauuuacaaaccagagcucagcucugaaaaguacaaauuuaguggccuaaauacuaauauauucuaaaugaugccuaauguaccauauagauaaaccuauaaauguauaaccccauagaggaacuuauaaaaagcuccauacuguguucuacaacacacuauuaauaaaauaaucagcaauuuuuuucucugaacuuuccccucaauuuuguaaugaacccaaaacugcucuaaaaauuaaugucuauuauaaaaaauguuuagguacuaaugaacagugaaauucuauguguugccuuaucugugaagucuguaguaaagaaaguguuauaugaacucucauuguaauacaguuugugaaaaauauggugcucauuaguugucuacuuuuuaacaauaugaccagaauguaaccaguaacauauauauuaaggcucacuaaacacagugcaaaacagaaaggaaauagauugugcaguaccaucacugaugacaaauucgcaaagcagaaaggaaauagauugugcagcacaaucacugaugacaaauuccuaucaaauuuccuuaguuuuccuaguucuccauugauacuaaugaauuucacaaauaugguaaugaugaaaauauaaauauauauaugcacacacacauacauauacacaguucacugcagccucgaccuucuaggcucaagugacccucccaccucagccuuccaaguagcugggacuacaggcaugugccacuacgccuggugaacuugccucagccucccaaagugcugggauuauaggcauaagccacugugcccagccaacaacaacagaaaguuuugcagcuuuaacucaaggagaagacaauuuuaaaauaaauccacucauguaacacaacaguuauuuacaacuuuugggggcugcaguaauauaucuauacauuuauuuaauaaacugugaccaaagcgcuugucuuuugauuuauuuauuuauuuauuuuuugagacaggagucucacucuguugcccaggcuggagugcaguggugcaaucuuggcucacugcaaccucugccuccuggguucaagcgauucucaugccucagccucccaagcaacugggauuacaggugugugccaccaugcccagcuaauuuuuucuauuuuuaguagaggugggauuucacugaguuggccaggcuaguccugaacuccuggccucaagugguccgccuaccucggccucccaaaguguuaggauuacaggcguaagccaccacaccugaccacaccugucuuuuuaaaaacauaagagcugggugugguggcucacuccuguaaucccagcacuuugggaggccgaggcagguggaucacgaagucagaaguucgagaccagccuggccaagauguaaaacggcgucucuacuaaaaauacaaaaauuagccgggcaggcaccuguaaucccagcuacucagaaggcugaggcaggagaauagcuugaacccgggaggcggagguugcagugagccaagauugcaccauugcacucuagccugggugacagagcaagacuccaucucaaaaaaaaaaaacaaaaaaacacaacaacaacaaaaaacaugacauaagaaacuauuuuuggccagauggggucucuagaucucuauuaccacaaauaccaacacugguccucaaaaauuucaauucugauacuauuuccauacugcuaugaagguuaauagucacgugagaagaguuucuuaugauuccuuugacaacaucaaauuuaauuccuaaauaugauuugucacuucuucccccaaccaccccgucccugcaagacagagucuugcucugucgcccaggcuggaguacaguggcaugaucucagcucacugcaaccucugccuccuggguucaagcaauucucuugccucagccuccugaguagcugggauuacaggcaccugccacugcgccuggcuaauuuuuguauuuuuaguggagacggaguuccaccauguuggccaggcuggucucaaacuccugaccucauguucugccugccuuggccucccaaagugcugggacuacaggcgugagccaccgagcccggccuuagcucgaucucagcucacugcaaccucugccucccggguucaagccgauucuccugccuuauccugcugaguagcugggauuacaggcgcgugccaccacacccagcugauguuuguauuuuuaguaaagacgggguuucaccauguugaccaggcuggucuugaacuccucaacucagccuuccaaagugcugggauuauagggugagccacugcgcccggccuaucacuucuuuaaaaacaaaacauuugugugugaaaaauaucuacacauuuaugggauaugcaugcauuuuauuguagaaaaauucauuaugaauauggaaaaaauuuuauaucaugaucuaaugguaucucuugaaagaacuaaauagccuauguacugaaaaaaaaguggaaaggggaguguaauuaccuaccuacacuucuuuccuguagagcuuugacuccuuuauccuauuuuucuguuucuuuuuugagagguguuugggaauuagauaacugagauggaaauaguauguauauggcuuuaagagcaauuaacucucugcugggugcgguggcucacgccuguaaccccagcacuuugggaggccgaggugggaggaucacaaucaggaguuagagaccagccugaccaauauggugaaacacugucucuacuaaaaauacaaaacuuagcugggugugguggugcacaccuguagucccagcuacucaggaggcuggggcaaaagaauccuugaagggaggcagaaguugcagugagcugaaaucaugccaccacacuccagccugggugacagaacgagacuccaucucaaaaacacaaaaguaauuagcucucaauugcaagacaaaaguuugcuccuucucacuucucucuugcuaucuaaaaucuauauauacaccacguaacuguaaaggcaaaaaccuuuaauuauuagacagggacauuguuauggucugaauuuuggugucacccaugaaugggauuagcacccuuaugaaagaggcaagagagggccgggugcgguggcucacgccuguaaucccagcaccuugggaggccaaggugggcagaucaugaggccaggcaaucgagaccauccuggcuaacacggugaaacccugucucuacuaaaaauaaaaaaaaagaaagaggcaagagagaacugccuugccucuucucccauaaagaugcaacaaaacaggcuugaaaaacaagcccucaacagaccaaaugugcugguggcuuggucuuggaauucccagccuccagaauugugagcaauaaauuucuguuguuaauauauuauccagucuaagcaaauguacuaagacagacaccaaaauacugcugugcguacugaacucaguuugaacuuaggaaacaaugaauuauuucuacagacucuuuccuacaaaaggaagauaauguuguuacacagaacaguguagucacuauuguuuauuuauauuaugucaaauauuaaacaauauuuagaaagcuuauuucuaaaaagaaaacuauauaucauuucaguaccagucuguucugucugaaaaagaaaaauuaagauaucuuacauaagaaacagacuguggaaaaugacacagcugccccaaugugcucauuuauacagaaugaacuccaaauucaagacccuagagcgaguucuccauuucuugccuaaaagcaauuuaaagguggccgggcaugguggcuuacccuguaaucccagcacuuugggaggccaaggcagguggauuacuuggggucagaaguucgaggccacucuggccgacauggugaaacacugucucugcuaaaaauacaaaaauuagccagguguggucgugcacaccuguagucccagcuacccaagaagcugagacaggagaaucgcuugaacccaggagguggagguucaguuagcugaaaucgcaccacugcacuccagccugggugacagagauuccaucucaaauaacaaauaaauaaauaaaauaaaaguaauuuaaaggugauguuagcucaguuucuggagcaaagguacuuccaacauccacagggccaaaaaaaagaacugaugcaugacuaagauggcaagacucuaaagcaauuucaaugcuugggaugcugcuacgaaaaaaugagaccacugcaaaaccauauugcaaauaaaagauuacagaauuuuuuuuuguuuguuuuuuuguuuuuugaaauggacagagcuggcaggcagaaaauaaguaaagacauagcuggacucagcaacaccauucuucaaguguauauaaugagcauuauagacuacuacacucguaacugcagauuacacauuguucuugaguucacauggaacuuucaugaagauauaccacauucugggccauaaggcacauacugacaaauuuuuaaaaauagaaaucauacaaugucugcuuucagaucacaacggaauuuaacuggaaguuccuaacagaaagauaccugcaaaauccccaaaacauuuggagauuuaaaaacacacuuuuagaauaguaggccaggcgcgguggcucacgccuguaaucccggcacuuugggaggccgagguggguggaucacgaggucaggaauucaagaacagccuggccaacauggugaaaccccaucucuacuaaaaauacaaaaauuagcugggcaugguggcgcaugccuguaaucccagcuacucggaaggcugaagcaggagaacugcuugaacugggagccggaaagcagagguagcagugagcgagauugcgccacugcacuccagccugggcuacagagcgagacugucucaaaaacaaacaaacaaacaaacaaacaaacaaacaaacaaacaaaaaagcacacuuauagaauagugaagaguagccucaaaggaaaaaaacuagcgggcccucauauaucaaccugagaaacagaaugcauuauucuaguauccuuauggauuagcccaaagcuaaguacguuucaucaacaaagcuagaaaugcuucccccaggcaugugcacuugucuaguacaagaaccucaccuugaauuuauuccaaaagagccucccaaauguucagcagcaauuccuaaaaggaggccaguccaaauguaaugggauaaaucccgcucccccuaccaaaagcugaaucucucacccauaggaacaggugacccuugcugugaaguuagaggauaggcacacaaauaaauuuauauuacauuaucuacuaaauuuuuaaaugcacauguuaaagacauguguauuauaacccuagcaaugaacagcaaaagucuaaagcccaaauccuuuacuuuauccuuuauccuguagaauauacacaggauauuauaaaacuacacuaauguuaaauaauuaauccagaaacuguuaacugaagugcaaaaucauuaauauuucucuauggcuacaaaagccuaaguaucaaagugugcugagauaggcuauuuuaaaguacugauuuaaaaaaaaaaaucuucagagaaauuuaugauggaugucuccuuaccucauaaauguuggggugccacauuuuggucaagaaucugaagguagguggugaauagggguagucaauaggaaauuuaauaugcgccugaaaagaaaaaaaaugaaaugcuaauaaaugagacuauaacuuauucaucugccuaauaauucacccuacuacacgccacagaaacaaagcuccuuucauagaguaaacucuugagauuaaaguagcucagacauacuuuguuauccccagugccagggucauuaguaaguucuuacagcaccccuucaaauauuuauaaaagccuuuuuuuuuuuuuuuuuuuuaagacggagucucacucugucagcaggcuggagugcagugacgugaccucagcucacugcaaccuccaccucccagguccaagcgauucuccugccucagccucccgaguagcugggacuacaggugcacgccaccacguccggcuaauuuuuguauuuuuaguagagacgggguuucaccauguuggccaggauggucucaaucucuugaccuugugauccaccugccucggccucccaaagugcugggauuacaggcgugagccaccgugcccugccccuauaaaaggcuauuuuaagucaccaaaacucacacucacucacauacacaaacauacauaaauauaauuuuaacuugccucacaagugaaaaacaguacucuguacauuuuauuuuuauaacaaaauaaucuaauuuuagaguacacaauauggaacaacgguauuuuucuuuuuacucacauaauuuaacugucauucuaucacccagaaauaauaaaugcugacauugcugauuucccuuacaaaacguauuuuuaaaaacuucaacauacuguauuuuguauucugcuuuuuucaccuguaucacauuguaaacauuuuuuuuacaccauaaaauauucucuuuacauggaugacugacaguaucugcauuauacuccaucaaauguauaccuacaugaaccauuuuauaaaacuauuuccuuauuuugggcauuuggguuguuucucacaccuuugcuguuacaaauccugcugcagugaacguccuuugcaguauccccguauuuuauauaugaagaaauccagaaaaccugaaaaguucucucuuccacaaaagcaaugggaaaauugccaaaaauuauaagcaucauuuucagaauuccagaaaauaaccagaggcuugcaacaauucaaggaguagauauuuaaagaaaauggcugacauucaguaagaacaucaagcuacgugauuuuaacuuacccuaauccaaucuccuauacucuagcugugcagcagccuuaaaacacauucaaaguaaaaaccaaggaagcugacaggcccuggagaggauagaaugggcuggcauuucgccaaagccuuacucccagagaauugucauuaaguuuacuuuucuaaugguucccuagaaaacuccacuugcaaggcugucuacauaugauuggauuuggagcuuggccaauaugaaaacauuuucccuggcagcuuuguugaaaacaauggcaggcaacuauuuaaucuuaaagguaccugaggcaguggaaaauacaaaacagacuaaccaaaaacguuaaggaaaagcugggcugggcuaagaguuguccauuaugguucugaaaagcucugacaaauuauugugagucuauaauaccaugacaauguguagagcuaugcacaugcccagcacuaugugcaugcucaggaaagcccuaagaaggcccuaacuuuauaccucuggcuuaacuugagaauguauacaacaagaaaguaaagaguuugcaaaugccugucugaauuaaguugaagacaugcaaugacacauacgcagagccucucuacaaauuccagcuaacuaacugguucuagaaaaccaaggaaaucucuguucaaucauuaccugaccacuaagcugaguggagaauucacuggccacacauaacaauaauaucgacauuauauaauuagguaaaagaagucaacaguaauuacaacagcagcagcaauggcaacaacaaaaacccuggggaagaggagaauuggauuccugcaggugccacuguauauuauuuaaauuucuaguuuucagcaaaauauuacaagcuaugaacaaaguaugguccauacaacaggagaaaaaaaaaagaaucaauagaaacuggaaaccuaaguauucaaguuacuaggcaaagacuaaaucagcuuaucuuuaaaccuuuaaacauuucaaaggacuaaagaaaaucauggcuaaagaacuuaaaggaaagcaugagaaugguguuucacccauaaauacugaauaucaauaaugagauaaauuauuuuuaaaaauccacaaaaagugguggcucaugccuguaaucccaacacuuuggaaggcucaggcagguggaucccuugagcccagaauuucagacaagccuaggcaagguagcgagacccuacucuacaaaaaauuuaaaaaucagucggguaugguggugucuguggucccagcuacauaggaggcugaggugggaggaucacuugagcccaggagguggggcugcagugggcuaugaucauaccacugcacucagggcugggcagcagaggaagagccugucucaaaaaaaaaaaaagaaagaaaaagaaaaaauaaagggguuggggguaggagggggaagagagggggaagagagagagagagagagagagagagagagagagagauucuuaaguuguuaaguacaaaaacuguugauucuuugagacagggucuugcucugucagucacccaggcuagacagaguacacuggguuacagcucacugcaacccugacauucugggcucaaguaauucacccaccucagccaccugaguagaugggacuacaagcaugcaucuccaagcccagcuaauuuuuuuguggggcuggagguuucaucauauugcccaggcugggucucgaacuccugggcucaagcaauccccacgccucggccucccaaagugcugggauuuacagaugugagccaccacagcuggccuguucauuccuuuugaugacuaaauuuaagaaguacaaaaacugaaauuaaaaaaaaaaauuaagugcugagcaacagauuugagcagguagaaaaaauagugaauuugaagauaggucaauuuauugaccuuauucuuuuuuauuucuuuuuuuuuuuuuuuuuugagacagagucuugcucugucaccaggcuggagggcaguggugcaaucucggcucacugcaaccuccaccuccaggcucaagugauccuccugccucagccuccugaguagcugggacuacaggggcaugccaccacacccagcuaaauuuuuguauuuuuuaguagagaugggguuucaccauguuggccaggauggcguugaucucuugaccucgugaucugccugccucggccucccaaagugcugggauuacagacaugagccaccgcacucggccuuauugaucuuauucuuuuaagggggaguaguggaaaucccaauuuauagcugauucaucaggaguauaggucugccauaggcauccaaaauggaggcagucuuucuugugggacugaguccuuaaccuauagaaucugauguuaucuccagguagacagugucaacaaugaauugaauuggaggacuaagauaagagagaaacuauaaaauucuuaaaagaaaacauagguguaaaucuucauaaccuugcauucacuaaguuuuguacacgugacaccaaaaacacaaggaacaaaaguaaaaagaaaugggacacaauuaaaauuauuauuauuauuuuuuugagguggagccuugcucuguugcccaggcugaagugcaguggcaugaucucagcucacugcaacuuccacuuccuggguucaagcgauucuccugccucagccucucgaguagcugggaucacaggcaugugccaccacuccuggcuaauuuuuguauuuuuaguagagaugggguuuugccauguuggccaggauggucucaaacgcuugaccucaggugauccguccaccucagacucccaaagugcuaggauuacagguaucagccacuauccucggcacaagguuucuuuuucagaugacaaaauguauucuaaaauugauuuuggugaugguuacacaacuuugugaauaugcuagaaaccacuaaacuauauacuuuaaugaaugggugaacuguaugacauaugcauuaaaaucacaauaaagcugauuagggggaaaaaaggcuggagcccaaacacccaggucccucaaagaucuugauuucuaaaauaucauuauuuggccgguaugguggcucacgccuguaaucucagcacuuuuggagcccuaggcggguggaucacgaggucaggaguucaagaccagccuggccaagauggugaaaccccaucucuaguaaaacuaaaaauuagccaggugcaguggcaggugccuguaaucccagcuacucgggaggcugaggcaggagaauugcuugaacccgggcaggagagguugcagugagccgagaucgcaccacugcacuccagccugggcgacagaaugagacuccaucucaaaagauaaauaaaauaauauaaaauaucauuauucaauaaaaggaaccagggcccuuuggugaaacaccugauucuagaucuguggcaggaaaaauaaaagacaagccuagagcaucuuauaaugccaaaaaguaagugcuaaagaaaacaaauuggaguauuucaaaacagcauaggagccaaacugcaagagcuccuaauggccaaaacuagaauaaucgaagcuacaaaauacauaauguaauacuguuacccaaaauaugaaauaaauauaaaugaguacauacugauaaguauuacugaauggaaaaauacugguggagaagggucaaaucuuccuuacaguaguacuacaaauaaucauaauccacauucagguggugaaguugaauuccccuuuccuagagugugggcuggauuuaaugacucacuuucuaacaauaaaguauggaaagaaauaguagcucuaccguagagaaaucuggcagacauguuaaccaagugaucaagguuaacaucacuagcaguaaaucauauugguaucaugaccucccugauaugauguaguaaguaaggcacuucaucuuugugguauucuucccccaaaaucuauaaccccauucuagucaugagaaaaacaucagauaacccaaauggaggaauauucuaccaaaccugacccauccucuucaaaaauugucaaggucacaaaaaaugaggaaagacggagaaaucaucaaagacuggaggagacuaaaaagacgggacaacuaaauacagugugauauccugaacuggacucugaaauaagaugaugauauggaggcacaggagaauacagagugacugcuaaugaguauggggauucuuuuugagaugaugaaauauucuggaguuagaugguggugauggcuguacaaccaucugaauauacuaaaaaccacugaacuauauacuuuaaaagggugaauuuuaugguauaugcauuauaccuuaauuaauacauuagugcagaaacuggugaaaucuaaacuaaacuaacuggagauuaguuaauaaagcuggaguggcuaucugaauaacagagaaaguauacuuuagaacaaaaaauauuaucacagauaaagaggguaauuucauaaggggaucaauucacaaagaagacauaauauuaacugugugugcacugguaacaacagagcuuuagaacacaaaaugauguaacuaaaaacuuuugccaccaaauggaaaaauagaaaaaugcauaauuacaguugaagauaucaucacuucucucucaacagucuaaagcagcaguccccaacccuuuuggcaccagggacugauuucauugaagacaauuuuuccauggacaagagggcggaggagugggaaggguagugagguggguguuucgggaugaaacuguuccaccucaagucaucaggcauuagucagauucucauaaggaacacucaaccuagaucccucacaugcccaguucacaacaggguucgcacuccuugagaaucuaaugccugagcugaucugacuggaggcugagcucaccuccugcugugcggccuacuuccuaacaggccacagaguuguaccagaucaguaucggguaggcaccccugguuuaaaguacaaggagacaaaaacucaguaaggauauagaagacaauaugccacugaacaacagcagcauacaaauuauuuuuguggacacauagaacacgcaccaagacauaccauauucuggaacguacaacaucuaucuacaaaguuuaaagaaaugacauaauacauagcauauucuuuggccacaaugaauuaagcuagaaauucugauuuucuaaauucaaagauauuuaguaaauccccaaacauuuggaaauuacguaacuguacaaaucacaguauaaagaggaagccacaaaguuacuuagaaaauuguuuaauugaacaugaaaaaaaugacaaugaaaaucuguaacauacaccuaaagcaauacucaaauagaaauuuuuagaauugccuacacuggaaaaaauguaggucucauuucaauaauauaagcuucuacuuaagaaaugagaaaaauacaaaauuaggccaagugcaguggcucacaccuauaauuccagcacuuagggaggccgaggcggguggauuccuugagcgcaggaguuggagggcagccugagcaacaugguaagaccucaucuuuacaaaaaauacaaaaaguugccagccaugauggugcaccccugaggucccagcuacuugggaggcugagguagaaggaucacuacuuaaguuugggagguugaggcugcagugaaucauaaccuugccacugcacuccagccugggugacagagugagaccuugucucaaaaaaacaaaaccaaacaaacaaacaaaauaaagaggaaaggacagacuaugaaauuaaacuagaagcaagcagaagaaagagaacugacauaaaagcagaaaucaauuaaacaaaacaucgucucaaaaaaaaaaaaaaaaaaaaaaagucuugugaccaggcgccguggcuugugccuguaauuccagcacuuugggaggccuaggugggcagguugcuugaguucaagacuagucugggcaaauggugaaaccccaucucuacaaaaaauacaaaaauucgccaagcaugguggacgugccuguaaucccagcuacucaggaggcugaggugggaaaaucaccugagcccaggaggucgagucugcaguaagcugugaucacgccacugcacuccagccugggugacagagcaagacccugucucagaaaaaagucuuguuaagauuacuuaggguacuaagagaaaucuuugcagugcugcaugaaaauuuauguagaauagaugauaugcaccaauauaauaaaagguagcacagauagcaguaaagaacacugacucaagaagccaggacuaucuggguuugaauccugacucuacaacucagcuguuaucuuaagcgacccuuacuuaauuuauauugaucgacugauugauugacugauuaagacaggguuaugcugucacccaggcuagaguacaguggcacaaauauggaucacugccagccuugaccucgcaggcucaagcgauccugccccagccuccugagcagcugagaccacaggccaugacaccaugcccagcuaaauuuuugauuuuuuguaaagauuucaccacuuugcccaggcuggucucaaacuucugggcucaagcaauccucccgcuuuggccuccuaaaaugcuggguacucuguguaguccuaauuaggggaaaggagucaggcuagugggaccgagggaaaagcaauaaaagaaagcagauaagccacaagucagccuuucuucaucguccaggacacauaaguccuccuguguaaauaacucacaaucuuccugugcccaacuaucaccacacaccugcaaguuagcucacugcaaccuuggcauuuucaguacuccacaaagcccucuucagcauacagcauaaacacuauccuauaaaaucucuaccaagccuuuguuucucugcaguuggcuucucucuggcaggcugcuggcaucccucgcaauguauuuuccuauguucucuaauaaaucugccuuuuuuuuguaaauuugagacggggucucacucugucaaccaggcuggagugcaguggugcaaucuuggcucauagcaaccuccaucuccgagauucaagcgauccucccaucucagucuccagaguaacugggacuacagacgugcaccaccaggccuggcuaauuuuucauuuaauuuuuguagggacaggguuucaccauguuuccaagacuggucucgaacuccugggcucaaugauccuccugccucagccucucuaaaugcugggauuacaggcgugagccacugcaccuggccugccuuccuuuacuuacaacugccucaguaaauuacuuuacucaguaaguuuggaccugggccacugguccaaacagccaucguucuccuggacagauuacagaugugagccgcugcguauugcucaauuacuuaauuuauaucucaguuuccucaccaguaaaaaggggauaauaguacuuauuuaaugcguuuguaugaggauuaaaugagguaaugcuugaacaauguuuagaacugugccugacaaauaaaagauauaaaaauauaaauagguggaugggugcaguggcucacgccuguaaucuuagcacuuugggaggcugaggugggcggaucaccugaggucaugaguucaagaccagccuggccaacauggugaaaccccaucacuuacuaaaaauacaaaaauuagcugggcgugauggcaguugccuguaaugccagcuauucaggaggcugaggaaagacggagggagagugggagagagagagagagagagagagagacagacagacagacagacagacagagaggggcaaaaaucaugaaggcuguuuuauauauugcuaauuuucacuguuuuaccucuuuuaccuacuugcccuuagauuauaauacuaccagcuuuagauaagacaacuggaaagauuaauaccaaccuuaagaccuugaugauuauggaauuaguuuucuuagagccuuaccaaaccuaauuauauuccacuuaaaucuuaauaaauauugguuaguaguauuaaugggguuucuguauuuucucuaagcaucuaauauuuugaauuauucuugaacuuucagcuuuuugaccauuaucuacuauauaaucuuuuaaaaauacuaccuucaucacgcuuguaaucccagcacuuugggaggcugaggcgggcggaucacgaggucaggagauugagaccauccuggcuaacaaggaguaaccccaucucuacuaaaaacagaaaaaauuagccgggcaugggugccgggcaccaguagucccagcuacucgggaggcugaggcaggagaauggcaugaaccugggaggcggagcuugcagugagccgagaucgcgccacugcacucuagccugggcaacagagugagacuccgucucaaaaaaaaaaaaaaaaaaauucaaucauaaguaguuuuaaugugacccuuuugacuuuauucuagaaguaguuuuuuuuuuuaagauggaguuucgcucuguuguccagcucacugcaaccuccacuucccaaauucaagcuguucucuugccucagccucuggaguagcugggauuacaggcaugugccaacaugccuggcuaauuuuuguuauuuuuaguacacuugggguuucaccauguuggucaggcuggucucgaacucuuauuuauuuuauuuguuuuuuagauggagucucgcuauugcccaggcuggagugcaguggcacgaucucggcucacugcaagcuccgccucccgaguucaugccauucuccugccucagccuccugaguagcugggacuagaggcgcccuccaccaugcccggcuacauuuuuuguauuuuuaguagagacgggguuucaccauguuagccaggauggucucgaucuccugaccucgugauccgcccaccucggccucucaaagugcugggauuacaggcgugagccaccgcccccggccuuaugauugauuuuuuuaaagcaucaugccuaaaguaugcuuacauuaccacuagaagagguaacauugguuggugugcuucugguaaggcuauuuaaauuguacuaagaacuccuucagcggaguuuacaauccucaacuauucagcugaaguuaacauucagggggaauauccugcuguaaugcuucccugagcaauuauacaauuuuaucucuaucucuauuacuuuacuuauuuuucagaaccuuauuaacuguuuauuuacuuauuuauuuuugagauggagucuugcucugucgcccaggcuagagugcauuggcgcaaucuuggcucacugcaaccuccgccucccggguucaagcaauucuccuguuucagucucucgaguagcuacaggcgcaugccaccacaccuggcuaauuuuuguauuuuuaguagagacaggguuucaccauguuggucaggcuggucucgaacuccugaccucaggugauccaccugccuuggccucccaaagugcugggauuacaggugugagucaccaugcccagcccuuauuaaaaauuuaaacauacuauuucacauguauauggugaccuauaguuaccuauguauuaccucauacacauauuuaauacuccuacuucagccaacuugucacugaaauuucuucccuuuuugaaauuuuaugaaauaagauauaacuugcuauuaacauaugaauauaagaucucauaccauuucaguuauauucacagaacaauauaaugauuuuaaaagaagaagggaagguacuagaaucaguagcccuguguuguagcccuggcaugauucuugacuauuuaauuuacauuuuucuaucuuuuauuugucaggcacaauucuaagcauugucuuugcuaggccucugaccuuaggucaacucauuuaaaucucuggauuucaaguuccuuuuuauguaaaauggcaaaaaacacugacccuagggaguuaucaugaggaucauauacaaauuuuaagagaaacuucaaaaauggaucccaagacacaauuauuuuuuaauuuuuagagacagggucucacuauguugcccaaacucaagaccucaagugauuuucccaccucagccuacugaguagcugggacuacagggguguggcaccacgacuggcuccaagauaaucuuaaaucaucaaaucaaagguuaaaucauuaucauuguauugaggagcauuaauaaauauuaaaguauuuuccacaagaaguaaaagggaaaauaaaguucaauauauuagaaaauuugcucuuacccauuauagaucuuaguaauuucaggguaugauuugaacaaacuaaauuuaugagaacaagggaaauguaaacauugacuggauauuaaggaauuaugagcuuuuauaguugugauaauaguauuacaguuaggucucaaaaauacauguuauuuaguuggugcuguaguaauuuucauuuaaaguuuuuuaaaaaguaaaacaaaacuuggccaggagcaguggcucacgccuguaaucccagcacuuugggaggucgaggcagguggaucacaaggucaggaguucgagaccagccuggccaauuaaaaaaaaaaaaagguaaaacaaaacauauuuuaaaaauacauuuugaggccggguacaguggcucaugccuauaaucccagcaccuugcgaggcugaggcgggaggaucaacuugagcccaggaguucaaaacuagccucagcaacauagcgagacccccaacucuacaaaaaaauuauuuaaaauuagcuagccaugguggugugcacuuguaguccuggcuacucaagaggcugaggugggaagauugcuugaacccaggcugcagugagcuaugauccugacauugcaccccaguaugggagacaagucgagacccugucucaaaacaaacaaacaaacaaaaaacuauucugaaauuuucacaaaugaaaugaaaaguagaaauuaauuacaaaauaaaauggaggagggggcggguaggauaaauaauaauaauauauauacauauauaaaaacaaugugugcauauauauuucuucauaugcauuauguauauauuuaaaaagacugaaaagacacauuccuaaccauuaacaaugaucagcucaggaacagagggcaacggaggaagaauggggcauuuaaagaacuuuguaacuucuuuaugacugauauaauaaacauguuauuauuuuuauaaacugaaaaaagaagauuuuucacuugugaaucuucuauacaauggucuaugccuacuuugcacugaaaauugacaucuggaaugauacacucaauuaaguuugaaaauauaaaaacuaaguuaaggcugggcacggugguucaugccuguaaucccagcacuuugggagcccgaggcaggcagaucacuugaagucaggaguucaacaccagccuggccaacauggugaaaccccaucucuacuaaaaauacaaaaauuagccgggcauggcagcgggcaccuguaaucccagcuacuugggcggcugagacaggagaauugcuugaacucgggaagcagagguuacagugagcggagaucgugccacugcacuccagccugggugacagaacgaaauuccauccaaaaaaaaaaaaaaaauuuaggccaggcacaguggcugguucaugccugaaacccuagcacuuugggaggccaaggcaggcggaucgcuugagcccagaaguucaaguucagccuggacaacauggugaaaccccgucuccacacacaccguaauuuuuuuaacuuagccaggcaugauggcuugagccuaugaccacucaggaugcucagguggcaguauccgcuugagccugggaggucaaguaugcagugagccaugaugguaccacugcauuccagccugugugacagagcgagaccuggccccuccccaaaaaaguuuuaauauaaauuacaggauauuuuucauucgaaauuguguacauaugaaaucuaugaguuauaacugaacuuccuuaagaaguuugauagccuuagggagucuuauguuuaggucacauauggaauuaucaucuuuacuuugcaguuauacagugcauauacauaagcacugguucuuucugcaguaaccuuuuauucaaguuaucaauaaacuuuugcuuaaucaugcuaucuguuaaacuguaaaaauaauaacuuaguaauaguucauuauaucuagaagucacaguuggcuguccagcccuaaaugaccuaggagacauuuuaccauugcugugcuaaggggugggggaaaaaaacagcagcacaaaauuaaagagaaaaaugacuuucauuuaccuacagguccauuuaauuaaguuaaaguaguaucuaugauauuagaucuuuuuuuuuuuuuuuuuuuuuuuaagacggagucuugcucugucgcucaggcagcagugcaguggcgugaucucugcugacugcaaccuccaccucccaggcucaagcaauucuccugucucacccacccaaguagcugggauuacaggugccugccaccacauccagcuaauuuuuguauuuuuaguagagaugagguuucaccauguuggccaggcugcucucaaacuccugaccccaagugauccaucugccucagccuccuaaagugcugggauuacaggugagagccacagagcccggccugauaugaaaucuuaaccauuuauuucugaaaccguuaagcaaguguacuaaagcguuaucugcuaaccaaauucauacacacaccaaaucuuuuuuuuuuuuuuugaaauggaguuucgcucuuguugcccaggcuggagugcaguggugcggucuuggcucacugcaaccuccaccucccagguucaagcgauucuccugccucagccuccugaguaucuggaauuacaggcaugugccaccaugcccugcuaaucuuguauuuuuaguagagacgggguuucuccauguuggucagguuggucuugaccuucugaccucaggugauuugcccgccuuggccucccaaagugccgggauuacaggcgugagccaccaugccuggugccucgauuuuuaaauauugaaguuuaccauuuaaaaaaauuaucaucuguaacuuccucucaauuuugcuguuaaccuaaaaacugcucugaaagagggucuuuuucuucuuuugaaacaaggucucacucugucaccaagaccagugccauggcaugaucacagcucacugcagccucaaucuucugggcucaagugaaucuccugccucagccucccaaauagcuggaacuacagguauacaccaccacgccuggauaacuuuuuuuuuuuuuugguagagauaguuccccauguuccccaggcuggucucgaacuccuggacucaagagaucccccugccucagucucccauggugccucaugcuuguaaucccagcuugagccaccaugcccagcuaaaaaaauagucuuuaauuaaaaaaaaauuauucaugagguaaaguuuuaaauuugaccuauauaucagcugucucaagaaauacaggaaauaggccgggugcaguggcucacaccuguaaugccagcacuuugggaggcugaggcaggcggaucacgaggucaggaaauggagaccauccuggcuaacauggugaaaacacgucucuacuaaaaaaauacaaaaaauuagccaugcaugguggcacacaccuguagucccagcuacucaggaggcugaggcuggagaauugcucgaacccaggagguggagguugcggugagccaagaucacgccacuguacuccagccugggcgacagagcgagacuccgucucaaaaaaaauaaauacggaaaugaaucugagacgucacucaauagaagcaauuguuacagaaguuaauuacaaucuugagaggcucuuuuucgggcaacuccuuacaucuuuuuugacuaauacgcaaacucauaagaacaaguacuuccucuaguccaucgcaaauagaauuaaaaauaaauaaauaaaaagaacaaguaccuccaaaauacauuucuguaccauuaccacauauguucucccuaaaaugccugaaccacucacaagcauauccuauuuaaauuaauuuuuaaaguuucaacucacccugacaauggacuaaguguacccucaaugaaaucaccgaacucaucagacaccuauuuuuaguuauacaaacacuauuuauguaaauauuuucacuuauucaauuucucaacauauuguuaacugaaaaccaaacauguuaccauguaccaauaugggagguaggaaauaaacauauuuagaacacuaugccugaauggcuauguuuuaauuaaaagacaggcaugcaaauaaaugauuacaaauuaagugccucaaaugaaaucucuacuaguugcuuaaagagcacagugaaauaaaugccuaauucuggcugagacauucagguaaaauuuacaaagggguacuacuugagccaaguauugaggccaaggugaaagggaccuuacaggcaaagggaaaaauaaugcagaaaggcuuacacaugugagcaaagacagaggcaguuggaauaaacacaaaacguauuuuugagacacacaggaaguauagucaaugagacucuguaauugauuuaauauugggauugaggagaaagaaaaauucaaggacaacucucaguuuucuauauugaggaaauaagugaacaaugacagauccaaguagugauaaauaauacucauuaagugcuuacuauaugucagccauugagcuaacuguaucacuucacucaguugugaaauuaacaguuaagaaaauauagacauaaaugcauaugaccuauuuauugaggaguagauaauuuuccagucaucuaugacuaccaaaaagcauuuucccauuuaucauuuugucuucuugaaccacuuuauuuccugggguucuccaauuucacugucuccuaaugcucuaacuuuucuacucacucguucucauacuucuuggcuccucccaagauccucuuuuuaauuuaauguacccucaucauaacuuuccuugguuuccuauucuccccaaacauaguacauuauaaaaauaaaagccgggcaugguaacucacgccuguaaucucaccauuuugggaggccgaggugggcagaucaccugaggucaggaguucgagaccagccuggccaacuuggugaaaccccaucucuacuaaaaauacaaaaauuagcugggaaugguggcaugagccuguaauuccagcuacugaggagucugaggcaggagaaucgcuugaacccaggaggcagagguggcaaugagccgagagugugccacugcacuccagccuaggugacaaagcgagauucgaucucaaaaaaauaaaaauaaggcugggcacaguggcucaugccuguaaucucagcacuuuggaaggccaaggcggguggaucacgaggucaggacuucaagaccagacugaccaauauagugaaaccuagucucuacuaaaaauacaaaaauuagcugggugugguagcacauuccuguaaucccagcuacucaggagacugaggcaggagaaucgcuugaacccaggaggcggauguuucggugagccgagaucgcgccauugcacuccagccugggcaacaagagcgaaacuccaucucaaaaaaauaaaaaaacaaaaacaaaacaaaaaauaauuuaaaaauaaaaaauaucuaggcaaagauguacccuaaaaugcauaagcaaaaagucauuaaaaaacauuaugucccggccaggcacgguggcucacaccuguaaucccagcacuuugggaggcugaggugggcagaucaccugaggucaggaguuccagacgagccuggccaacauggugaaaaccccgucucuacuaaauauacaaaauuagccgggugugguggugggcaccuguaauuccagcuacuagggaggcugaaacaggagaaucacuugaacccgggaggccucagagauugcagugagcugagacugcaccauuacacuccagccugggcaacaagagcgaaacucugucucaaaauaaauaaauaaauaaauaaauaaauaaauaaauaaaacauuguauauguaacuauguaaaaccaaguauaaacugacuuggagcaaaauuuagguaacccccaaugugcaguauuaaauaaguuuuguuauccuacuaauuauuuucagauggaauuucagcaaugacaaaaaaaauuacauguuuuuguuuguuuugagacagggucucuugcccuggcgggaguacaguggcacaaucugggcucacugcagccucgaccucccgggcucaagcaauccuccuaccucagccucccaagcagcuaggacuagaggccugcaccaccacacccaacuaguuuuuuucauuuuuaguagagacaggauucugccauauugcccaggcuggucuugagcucccaagcucaagcaauccacccaccccagucucccaaagugcugagauuauaggcgugagccaccaugccuggccaaaaaacaauuacauaugaauaaugaaauauaucccaauuauuccugcuaccuauuuauuaacauacuauuaaguaggugaaaaaguuuccuaguccuaaauacaauuguacuugguaauagcucagcugauggcaaauguagugguuacuguuguauuuggauuugugccuggauuuagugugaaaugaggauauucccacugcugaguuuuucugcuacgucaucagaucacaucugccauaggauauguuuccaacauaacaucagcaaaagcaaucaagacauauuuuuuggggggaggguagagcagguuuucauuuuuccaaaaauugcaccaagguaaagcaaagcucuagcugaggcgggaguguuguguaggcauuagcagugcugcccuuguuaugcaauccuuggacagcagcgcaaccccaagaaaagggugguuaaaacaugcuuucuuauuaacuugcucaaagugucaaaagucugccaacuacaaaucuuuaaaauguucaauaauaguaugugggaaaaaaaaguguguguacacacacacauccccccuaguaaggcuauauaaugugcugcagguuuuaaggucaaacugacagaaaggcugggauccuggcuaagccccacccuuaaguuuguccuaagugaaaacagcugacccuauuuuucagcccaaauguugccuuuuuggccugccccgccccuauccugugcccauaaaaagacuucagcuggcagagcaacacaagcggcugagugucaaggauacaagcagcugagcauaggaaaaauucggcuaucuucagacagugcggcuucggagaggggccugccagagacagcccagcuucagggaaagaucaccuucccauccccuuuccagccucccuuuccgcugagagccacccacugcucaauaaagucuucugcauucaucaccuuucaaacaguucgugugagcugauucuuccuggacaccgaacaagaacagggugcugagaggacaggggccaccauccugacugacccuccacugagguggcuggcacuuggcaggcccugucuugcucuguuacccaggcuggaguaucguggcacgaucucagcucacuguagccucuaccucccagguucaagcaauucuccugccucagccucccaaguagcugggaguacaggcgcauaccaccaugcccagcuaauuuuggauucaggaggcugaggaaggagaauggcguguacccaggaagcagagcuugcagugagcaaaagacuugaacaggcauuucacaaaagaggauaucuaaaugccaguaaauaaauucaguuaauaugguguucaacaucauuagucaucaaggaaaugcaaauuaaaagcaaaauaccuaaaaugaaaaagacuagcaaagaugcaaaacuaccauaacucucauauagcgcuuauaggaaugcagaacagguacaaccagcuuagaaaacuggcaaucuuacuacaccuguacauauauguagccuaagguucaaaaaguccacuccuuaauaaauauuuucaccaaaauacaaaaacugaaauguucauaaauaggaauauacauacagacaaaaucugaaacuacccaaaugacccucaauaggagaauggaugaaguggaagagucauuuauagauuacuaccuagcaugagaacaaaugaucuacaacuacacauaauguggguaaaucacaucaacauauaugacaaagaagccugacacaaaagagauucaaaaaauaaaaaaaauuauggccgggcacggugguucacgcuuguaaucccagcacuuuuggaggccgaggcgggcagaucacaaggucagcagauugagacugaaauggugaauuuuauguuauauauacuuuaccaccaaaaaaaccaggaauauuuaggacauuggaggggacaaaaguuuuaaaauaggacacaaaaaguaauauccauaaaagaaaacauugauaauucugauuuuauuaaaaccaagaacuucuguuucaucgaaaaaaucauuaaaacagggaacaagcaagccacagaguggaagaaguuauucacaauacauguauguggauucacauacacaauccaacaaaugauuuaauaugcacaguauauaaagaacuccuaugaauaaagaguaugacucuauuaugaaauucaagaauaagcaaaauuaauucauacuguuagaaauuaggauagggauuauccugggagaugggaagaugguucuguaagagaacacaagaaagggcuucuuguaguacuggcaauuuucuuuuuucaugaucugaagacuagauauacagaugccccagugugugaaaauccaccaacugcuauauuuaugacacauacaacuuucuaccuucacauguuuugaucaaauuaaaaauguuggcugggugcggugacucacgccuguaaucccaguacuuugggaagccuaggcggguggaucgccugaagucaggaguucgagaucagccugaccaacaaggugaaacuccgucucuacuaaaaauacaaaaauuagccaggcgugguggcaggcaccuguagucccagcuacucgggaggcugagacaggagaacugcuugaaccugggagguggagguugcagugagcugagaucaugccacugcacuccagccugggugagggagcaagacucugucucaaaaaaaaaaaaaaguuaauuacauuucaguuaaguaugauaaccauguguauuuaaagagauuuuauacucugucagaguucagggaugaauuacugauaagcacauuagaaaacuaaaugugagccgggcaccagugacucacgccuguaaucucagcacuuugggaggcugagguggguggaucaccugaggucaggaguucgagacuagccuggccaacauggugaagccccaucuguacuaaaaauucaaaaauuagccgagugugguggugggcacccguaauccuagcuacucaggaggcugaggcaggacaaucacuagaaccugggacguggaaguuacagugagccgacaucacuccacugcacucuagccugggcaacaagagugagacuccaucucaaaaaaaaaaaaacaaaaaaaaacacacaaaaaaacuaaauguggagggaugaagaggaauuccagcaaaaacaaaaaacaaaacacuacacuacaugugaaagaaaagguaauaaugguguaugacaugguucaaccggaacuauuauuuacauaguuauauuaauguaaacacugaaaauuagucuaaauuaaaacuauaacuacuggaaauauggagagcuaaugaauacguuuaugggaugggguguuacaguaaugagagaaauccucaucuuccacaguagaaguaugauaguuaacaacaaacuagaaauuuuaaaaaugaaaaacggcauuuaaaauauuuagaaggccaggcgugguggcucacgccuguaaucccagcacuuugggaggccaaggcaggcagaucacgaggucaggagaucaagacaagccuggccaauauggugaaaccccgucucuacuaaaaaauacaaaaauuagccgggcaugguggugcacucccagcuacucgggaggcugaggcaggagaaucgcugaacccaggagguggagguugcggugagugagccgagaucgcaccacugcacuccagccugggcaacagagcaagacucugucuuaaaaaaauagauagauagauagauagagagagagacagagagacagacagaaaggaaguaaguugggcacaguggcucacacugcaaucccagcacuuugggaggucaaggugggaggaucacuugaacccaggaguucaagaccagccugggcaacaugucaagaccccaucucuacaaaaacauuuuaaaaguuggcugggcgugguggcucacgccuguaaucccagcacuuugggaggccaaggugggcagaucaccugaggucaggaguucaagaccagccagccaacacagcgaaacccuaucucuacuaaaaauacaaaaauuagucgggugugguggcacacgccuguaaucccaguuacuugggaggcugaggcgggagaauugcuugaacccaggaggcggagguugcagugagccaagaucacgccauuguacuccagccugggcaacaagagugaaacucugucucaaaaaaaaaaaaaaaaaaaauuaaaaguuagcugagauugguggcaggccugcagucccagcuacucaggaggcuucagcgggagaauaguuugagcccaggaauucguggcagcaguggacuaugacugcaacaccacacuccacccugggcgacaaagcaagacaccaucucuuaaaaaguaaauuaagaauauuuagaaaugugggaguaauuccagaagaguugaaaagguucaaaguauguuauuacuuucauaacaacuuuuuaaauaguugauucaauuguuaauaacaauagaauuauuuagcauuuugggcucucagaguuucuauuauuauuaccauguguuacauauauauaacucaugaaugguuuguuauggcuaaucuaagaaaugggauccuugacagccaggauaagacauccuggguaacugaucuucugaacacaggagcucaaagcuacauggccugucugcuuuccaccacaaggaaagacauucuagugcuaagaaguuuuuccuuuccguuuuuuucugcccuuauugaugaaguaucuuuaacaccucauauacuuacauauaugaacaucagcagauaaaauuaguaaucaggccagacaugguggcuccuaccuguaaucccagcacuuuaggaggcugaggcaaaaggacugcuugcuugagaccaggaguucaaagccagccuggccaacauggugaaaccccaucuuuacuaaaaacacaaaaauuaaacggggccauggugguacaugcccguaaucccagcuacucagcaggcugaggcaugagaauagcuugaaccuaggaggcagagguugcagugagccaugaugaaaucccaucucuacuaaaaauacaaaaauuggccaggcguggugguacaugccaguaguuccagcuacucaggaggcugaggcaggagaauccauugaauccgagaggcggaggaugcagugaaccgagaucaugccacugcacuccagcagagugaaugacacaacgagauucuaucucaaaaaacaaacaaaacccaauaaaauuagccaucaguuuugccccauauuagaauguccuuaauauaaguuuaaaaugauaauaauuccaaaacauacaaaauaaacaucaauuauauucuuucuaaauuuuucacgaaaaacacuaaaucuaccaugcacuuuuuuuuuuuuuguuuuuuggagauggaguuucucucugucccccaggcugaaguacacuggcaacgcaaucuugaucucggcucacugcaaccucugccucccggguucaggcgauucuccugccugagccucccaaauagcugggauuacaggcacgcaccaccacgcccugcuuauuuuuguauuuuuaguagagaugggguuucaccauguugaccaggcugggaccucaggugaugaaucugcccugggcuccaaaagugcugggauuacaggugugagccaccacgcccggcuuaccauguacccauguacuuucuuucuuuucuucuucuuuuuuuuuuuuuuuugagggagucucgcucuguugcacaggcugcaggagugcaguggcacgauuuuggcucacugcaaccucugccucccggguucaagggauucuccugccucagccuccugaguagcugggauuacaggugcgugccaccaugccuggcuaauuuuuuguauuuuuaguagagaugugguuucaccauguuagccaggauggucucaaucuccugaccucaugaucugcccaccuaggccucccaaagcagaugugagccaccaugcugguauacuuucuuuaggcaugacaccaaagauuaaaaaccuuaaagaaaguaauagaugaauuuuauaaaauaaaaguuaaacaauucuauauaacaaaacauacuguuuauauguuaaaggcaaaaccacaaaaugggggaaauguuuaaaauuuuuuucaaagcguuauaugaguguuucuaaaucaagacauaaagacaaacccuucuacaguaaaacaggcaaaggacacaagccaaaaagaagaaacauacucuacuacuuaccagacuauucauagauuuuuugaggauucugagaagcuuagcuagaaaaccacuccuauaagcaaagugugucagcaacuuuuaaaaaauauaggauagcauuuuuuugugcauacuagugggaaaaaaugagagcacacggcauguaauucagccaaagagagaaauauaugucaaacaucaagcuuauugacaagaaaagaaaugagcaguuugccuauauacuaucuuuggcaguucugucuaauuuagccagcaggaaaagacacucccaaauucuugggcaggcggcuaacauaacgaaagaaguucuggauaugagguguguaugacaaccgaaugggguuaaacuaccagauaugaaggagcaaaagucuagguuauaaugauggcaaaggcaaaagagaauaaggaagacaucgaaaucacuaacuuuugguuguuuaucauaccaaaugauaagcaauaaaguuuuauuaccaacuaugaaaguggaucaacaggccgggcacgguggcucaugccuguaauuccagcacuuugggaggccgaggcaggugaaucaugaggucaggcguucgagaucagccuggccaacauagugaaacccugucucuacuaaaaauaaaaaaaacuagucaggcaugguggcaggcgccuauaaucccagcuacaugggaggcugaggcaggagaaucacuugaaccuggaaggcagagguugcacugagccaagaucgugccacugcacuccagcccgggcgacagugugagacuccgucuuaaaaaaaaaaaaaaaaaaaaaaaagaaaguggaucaacaaaugguaucucuggggacagucauuuggaaaagaaacaacagacugaaaagauuuaaaacacuuucaucaauccauauuuuacuccaucaaaaaacauucaaguuuaccuuaaauauguuacugcuuuugaaaaaguacacaaaauaaacccuuuaaaauuaaaauugcagaagacugucagauacuguuguuucccauuaucuaauuaaugaagacuagcuuguucaaacuuuuuuuuuugagacagggucucacucugucgccuaggcuagagugcaguggcaugaucucagcucacugcaaccuccaccuacugcaaccuccaccucccagguucaagagauucgugugccucagccucauaaguagcugggauuauaggcuaugcguggcuaacuuuuguauuuuuguauuuucuauuuuuuguagagaugggguuuguagagaugucggccaggcuagucucaaacuccugaccucgggcaaucugcccgccucggccucccaaagugcugugauuagaggcaugagccaccaaccccggccugcuuuuuaaaacuuaacacaagguuggccaggcgcaguggcucacgccuguaaucccagcacuuugggaggccgaggcgggcggaucaugaggucaggagaucgagaccauccuggcuaacacagugaaacccccuaucuacuaaaaaaauagaaaaaauuggccgggcgugguggcgggcgccuguagucccagguacucuggaggcugaggcaggagaauggcgugaacccaggaggcggagcuugcagugagccgagaucgcgccacugcacuccagccugggggacagagcgagacuccgucucaaaaaaaaaaacaaaaaacaaacaaacaaacaaaaaaaaacuuaacacaggguuaacgauuguggggaggggguggggaggguggggugucucagucugucaccuagucuggaguacaguggcaugaucauaguucacugcagccuuaaacuccugggcucaagagaucaucccaccucagccuuccaaguagcuagggcuacaggccaccacacccacaauauuuauuuaauuuuuuuguagagaugggaucucacuauguugcccaggcuggcuucaaacuccuauacucaagugaucuuccugccucagccucccaaaauuggugggauuacaggugugaaccaacaugccaggccuugaguuaacucauauucuauuuuaccacaccaccccuagaaagaagaaaauucaaacaaauaaaacaaauaaagucaaacaaaaaaugaaaaucugaugucauacaaccaugaaucugugaaaauucugauuucaagcacacaagaauucaaagaaugaacaaaggaaaagguauugacagcaauguuuuuacacagccaaagagugguagggcguaguaacaggucacuaccacaggaugcuggagucucuuccaaaaauguaucugccacuuauaaccuaauuaaugacagaaaaugucaggggaaagcaacuaggaaucagaggaaaggggaugguaauaaaaacauaaacuuacacaaaaggcuaaaaugucaggaggaaaagaggcuuguguaucaauauuuugccugucaggaagguuuucuucccaaucaaaagaacuuccuuuuacauaauuacuugagaaacgugcccuccuaaaaugcuauuuuuuuaaaaaaaaaaaaagggcaggcaagguggcucacaccuguaaucucagcacauugggaggccaaggcaggagaacugcuugaggccaggaguucaagaccaauccgggcaacacagggagaccuugucuuuauaaaaauuuuaaaaauuagcuggacauggugguucaugccuguggucucagcuacuugggaaggugagguagaaagauugcuugagcccaggagguugaagcuguagugagcccugauugcaccacugccacugcacuccagccuggucauagagagagauccugucucucucucucucucucucucucacacacacacacacacacacacacacacacacacacacaaaaggcuuagauaaccacaaggacuguauguuaaacauuaaaccuacauuuaaauaaccaaaucauauuuucuugaauccaaaauuauucugaaaaacaaaacaaagaaauuuaaagucucaaggcuccuaacgucacaacaaugcuucuguaaaaauuuucagcuauuuaggggggaaauacuaguucuaguaaguuuuccaaaauaaagauguaaugaaaaauaguaucucagaguccaucccagucuuaagauuuuaauacucuacauaaaccauucuuguaggcauuuugaaaauaugaccuacuauguuaaaacagggauauucucaaggaucuaaaacuaucaggcagguuagggauuccaaacuaaacuugggcaaugagccuaagcaaauuucaauauaaacuaugcuucccagcuuagcuuaguuuucauaaauuucugaauaugucagcuuugagcagauaucagaguauuuuuaaucuaucaaagauaaaauacacagaguauaguaacaauuacauuuugaaaacaaaaauuuuauaaagguuuaaugauuucaaaguauaugcauuacugcucagaaaccacaauucauagcauauauuuuuuaauauuaaaaugaacucuuccggccggacaugguggcucaugucuguaaucccagcacuuuggguggccaagguggguggaucaugaggucaggaguucaagaccagccuggccaacauggugaaacccugucucuacuaaaaauacaaaaauuagccgggugugguggcaggcaccuguaaucccagcuacuugggaggcugaggcaggagaacugcuugaacccaggggagcagaaguugcagugagcugagauugcgccacugcacuccacccugggcaacagagugaggcuccaucucaaacaaaacaaaacaaaacaaaacaaaacaaacuccuccauaaacugaaauguaaagagaauacacuauuaccuggcauaguccuagaguagaaugcaaugauuuagcacugacucuaauuaaaauauuuaauauuggccuggcaacggugacucaugccuguaaucccagaacccugggaggcugggguggguggagugcuugagcucuaucaggaguucaagaccagccugggcaacauggcaaaacccuaucucuagcaaaauacaaaaagccaggugugguggugcaucccagcuacuuaguggguugagacaggaagacugcuugagccugggaggucguagcuguggcuagccaagaucaugccacugcauuccagcauggcugacaaagugagacaccgucugaggaaaaaaaaaauuaacaucuauacucuauuauagauuacaaauauucaaagaaccaagugcuuaacaaaauacacuuauuguucucuaccuuccuauuuucuuuaauuucugaucagaauguaaagacgggacagaaggugucuccugucucuccugagacaguagaguauggaguacuaucuuuugauaauggcaagcuaccuuucggaaucuaacuuacucuuccugagaagauucuaggguacuucaggauacaacaaaagagaauuguuauuuacaucauccaguaauguacuauauagagauaugugaaagugaguaaguauuuuaccuucaggaguggguaaauuagcuuuuauuauaugcgauuauucugugaggugggggaaaaaacucuccauuaggagaaacuggugccucauaaaguuagcaucuuggccuuacaguaauaaggacuuucuaacuuauuguaauaaaugaaagaacauauucccauagggcuuuagccauuauuaaggaacaacuuccaucuuaagaagcuuagcugaaaaaagaaauagggggaaaaaaggacaaaugaacaauaaacucucaaagaacuauaggcaaaacaguucacaugccguucaacaaucugucaauuucuauauacuuaaaagcauaaagguuaaccaugccagucuaaucagccacucuuucacacacacagcuacauuauucuacaguaacguuauuaaccuacagauaacuaaauaugacuuucaaguauaguuuaucauaguaacacuuucuaauuuaaaauuuaaaagucaacacuuggucacgguggcucacgccuguaaucccagcacuuuggaaggccaagguggguggaucaccugaggucagaaguuccagaccagccuggccaacauggugaaaccccaucaacuaaaaauauaaaacuagccaggugugguggcgcacaccuguaauuccagcuacuugggaaguugaggcaggagaacagccugaaccugggagguggagguuguagugagcugagauagugccaccgcacuccagccugggcaacagagugagacuccaucucaaaauaaauaaauaaauaaaagucaacacuaauuucaguuuaacauuagaaugaacauaaguacucaucucuacugucuucugaaacccuacuaaagugacaguaaggggaauaaaaaaaaaagcauauaaacucauaaggggccaggcaggguggcucaugccugcaaucccagcacuuugggaggcucagacgggcggaucaccugaggucaagaguuagagaccagccugccaacacagcaaaauccagucucuacuaacaauacaaaaauuagccuggccugguggcacgcgccuguaaucccagcuacucgggaggcuaaggcaggagaaucacuugaacccaggagguggagguugcagugagccgagauugagccacugcacuccagccugggugacagaaugagacucugucucaaaaaaaaaaaaaaaaaaaaaaaaaagugaaaggaaggaaggaaggacggacagacggauggauggauggaaggacggacagacggauggauggauggaaggacggaaggacagaaguaaagggguuuuacaguucuaauagaaaaucuggaauuacagaugagaaugacaaaggaaacaacauaaaauggaaagaaaaaaaaaaagaaaacuucaggaaaaacaaaagauuuuccaagaaagguaauguaaucauacacaacugagaagagucaacauaguauuuauauauaguuaaaauaacauaaacacuugauauugcuaucacuauaaugggaaagauaaaggaagggaaaauggugguaaagguaaggcugagugguaugaaagagcuaaacucauguuccacaauaguaaaucaauagaaaaugcuaaaaauuuaaaaaucauuaacuagcaauaugagcacacuauuuagaaaucuagugguaaguaauguaccagaaaacaaacaagacuagagagaggaaaugugggagggaauagguaaagcaagaaacuacuguuucacaucauaagccuaguauuaauaguuuuuuaauuuuuaaaauuacauauacauacaguauuacauugauacaaguaaauaaaaaacuucagaaaauaaugcuuugcugaggacugaccgggaguaggagggcuacguggggaagggugaaaaaaagcauuuacauuuuguccuugguucucacccauuuaugcuuugggaaaaucauucccugucccuugcuugccaaguguguacacgguaaaaccaggacaggguaagagcccugcuaguauaagguuuuguuugguuuuuugaggcagguucuaucacccaggcuggaguacaguggcacaaucucggcucacagcagcuucaaccucccaggcucaagcaauccucccaccucagccucccaagcagcuagggcugcaggcacaugccaccaugcccagcuauuuuuuguuuugccauguugcccaggcugauuucgaacuccugggcucaagugauccgcccaccuuggccucccaaagugcugggauuacaggcaugaggcaccuugccuagcuguaagguuucaaugaaaacagaugcaggcugacuggccauccucagcauccacuguuccagccuuuccucuuacaaguuuccuggcugguagauuauaauuuuaaaagaaggucuccuuccacuacugucuaggaguuucaaaguacaacuguguccaguguuguuacaugguaaaaugacagcaaucaggaaugaucaaugcugauuuuguguugccuggggaucacccuccucucagaagcagacaagaacuugaaucgaacuuggauuuccauuauuuccccaauauacauaaccaaacagaguagcugaaaaccccaggaaaaacaaacucaugaaccaaaauaauuaaucacucaaagaguacauacaacuguaucaaagauggacaaaaaccagauaaaauauaccauucugaauuccuaaguuucuuaaacauauuaucaugcuuauuuuaaguucuugguccaucuguuccaaaauccaacaauguuaucuacaaaacacaaaaaaugagagaaaaauaucacaggaaaaaaauaaacugaaggaaagcugaagaaacaaucugauaaaaugaaauucaagacaaaaaaaugccaugaggggcaguauguacugcuaaaaggaauaauaaaacaagaagauacaaccauaacaaacaagccugcauguuugugaccuagaaauuacaguaacaaaauaugucaaguaacaaaugagagaaugcagagaaaaauauaugaauuaacuaucauggccaggaauguuaauaugaauuaacuaucaugcccaucauugauggugauaaucuuagcacuuugggaggcuacgguggguggaucacuugagcccaggaguucaagaccaaccuggacaacauagugaaacugcuucuacaaaaaauaaaaaaauguggaggugggugccugccuguagucccagcuacccaggaggcuaaggcgggaggaucaccugagccugggaggucaaagcugcagugggcugugaucaugccacugcacuccagucugggugacagagugagacccugucuuggaaaaaaaaaaaaaaaaauugcacuugcagauuuuaauacucccuucucagaaacuaaucauguagaaaaaaauaaaaguacugaagaucuaaacaauauaauuaacaauucugggcugggcacaguggcucacaccuguaaucccagcaccuugggaggccgaagcaggcggaucacguaaagucaggaguucaagaccaaacuggccaacaugguaaaaccccgucucuacaaaaaaaauacaaaaacuagccgggcaugguggcgggcaccuguaaccacagcuacuugggaggcugaggcaggagaaucgcuugaauccaggaggcggaaguugcagugagcugagauuguaccauugcacuccagccuggacgacaagagugaaacgccgucucgaaaaaaaaaaaaauucucaacaauuagacaauauauagaacucuguacacagcaaagauaaagaaggaagucuuuucaaguacacguuuacagccauaaagcaagccucaauaaaauccaaauaaccaguaucacagagaucacauuaacuaugauauaaugaaauuagauauuaauaucaaaaguagaguuuuguuaaaaaaccaauauauuuagaaacuaaaacauacuaagugacucguguuaaaaagaaaaauaaaggaaacuaagaaacuuugucaaaacacuacauuuugugggacacaguuaaaacaauucauaaaaaaguuacaccauuaggggacgggugcaguggcucaugccuguaaucccagcacuuugggaggccgaggugcuaggauggcuugagcccaagagcuugagaccagccugagaaacacagcaagaucuggacuccacaaaauauuuuuuuuuaauuaucuaggugugguggcacgugccaauauucccagcugggugacagagagagacccugucucaaaaaaaaaaaaaaaaaaaaaauuggaaggaaguaacaaaaauaagguugcuugcacagaccaaugacaacaugggccauaaaacugaggacugugauuaaucaucugcgucugacaucuagaaagaauuaagauguuuguggauggauaaauaaaucagcagaaauuugaaaaugguaagaauauguaauagaauuaaaauagaaaagauaggcugggcacgguggcucacaccuguaaucucagcacuuugggaggccaaggcgggcggaucaccugaggcugggaguucgagaccagccugaccaacaaggagaaaccccgucucuacuaaaacuacaaaauuagccgggcaugguggugcaugccauaaucccagcuauucaggaggcugaggcagaacugcuugaacccgggaggcagagguugcaguuagccaaggucgcaccacugcacuccagccuaggcaacaagagcaaaacuccaucucaaaaaaaaaaaaaaaaaagagagagaaaagguaaagccagguaagucuugcuuuagaagagagaaucuuuuuuuuuuuuuuugagacagagggagagagaauauuuuuacauacucagaaccaaguacagauaguaggccuuaaauaaauacuugaaacaaauuucugaagugcuggaaaauaguuccuacacaaaucauccacaugguuucucuuacugcuaaaacaguugggccuuccaucuuaacugcuuuuuuuuccuuuguuaaaaauuaauuacaauuuucauuuauuuauuugagacagagucuugcucuguugccuaggcuggagugcagcagugcaaucucagcucacugcaaccuccgccuccuggguucaagcaauucucaugccucagucacccaaguagcugggauuacaggugugcgccacuguauucagcuaauucuuguacuuuuaguagagacaggguuacaccauauuggccagacuggucuugaacuccugaccucaagugauccaccugccucggccucccaaagugccugagccacugcacccggccccauacuuguuaauaugaagaaaacuuaagauaaaauuaaaaucaucaauagaacaguaaacgcaguuaccuaccauucaguauggcccucacagaggcaaagcaaggccuagaagaagaaaauaggccaccugucuuagaaagcaaggaagcaaagaaugggucuuucucauucacagcauucuccucgcccaaucucccaggauugugccaaagaacuuggcaucaacuaaccauaccugaaauugcugccaauguguggaagucuuagccagauuuguccccauuuauauuuauacucaaguggacaacugucaccagguggcagcaaaccacagcuaggaccaggucagauuuggaucaugcagcuggauuccuguaacuccgggccagcuagaaauaacacuagugugaucaaauuuuguuucugagauggggucugcucuaucacacaggcuggaaugcaguggugcaaucauagcucacugcacccucaaccucgcggacucaagcgauccuccugccucaaccucccaaguggcugggacuauaggcacaugccaccccaccugguuaauguuuuuuauuuuuuguagagacagggucucacuauguugccuaggcugaugucgaacuccuggucucagcaguccucacccucacccucccaaagugcugggauuacaggccugagccacugcacccggccuaauuaaauauguugaaccccaccuaucucauuacgguggagucuuacuaccaaucagauaauuauccugacccuucuagauaugacuuucucgauguagauaauauuuuaauacuuuuauauaguuauauauuaaaauaauacuauuuaugccaauguaauaugcaugcauguaaaacacacuuuaugugaauguauaccauuacuacccauuuaaugaaauaggagaugaguccauugagauauaaauaaaugaauaaauuagaaguucaauagcaauaggauguuuauguaguuucaaagcaccuccucacaaaauacucaugaauuacaaggaaaaaguaacuugauaguggagaagcuuggcaaacaucuucuaagugacccaaguggacaucaccagaaaugagacaaaucaaaaucauguaccaccuaaaaagaauauaaagaacauagggaaaauuuacccaaauugaaggagauuccacaaaguaagugaccuguacugccgaaacuauaaaggucaugaaagucuaggacaugacuaaggaacaauuacaggcugaaagagacuacacaaacaggauaacuaaaagcaaauacuuggcucugaaccagauccuucugcuaugaagaacauuauuauaacugacaaaacuaaaugggggcugagaauuauuaacuucauaauuguugauaauaauuauaaugauguggaaugcacuugucuguaggaaauacacuuuaaaauauucagaggaauggugaaacuaucagagguuggcaacucacccucaaaugguucaggaaaauaguucuuugaauuuguaaguuugugguuguuuaaaaauuuuuauuuuaauuguuuuuaaaaagagugccuaccaaaggauacgaacaaacauacuacaauguuugccuaaggauucagaggggaauagaagugggaauggaaguaaaaagaaauuaauacacauaugcauaccaacaagcaagaaaaggccuggaaggccaaaauguuuaagaaguauuaaugagaaguaugauuaugaacugaacucuagaacaauaaccaaaaaauuugguuuaaguaaauauuggccuaagugacugcaucugggggcagggcucaccugaaguguggcuuuaugcuggagguaaccauaggaaguaaacaaaagacucacuuucucuccauuuuuauaagagcugaaagggguugcuagugaauaauggggaagaguagggaacugauuguuccuuauuguaagucuuacaccacauguuacucuuaaaacuauauaugugaacuauuuuuauaaauaaacaauuaaauguaaaaaaggaacaaaacaaguuugaaaucaguaauaugaaggcaaaaaggaaucccgauuggcaggauuuguaggggcaggcaaauuuaagagguuaagauuaagccagaagucgggaagcuagauaugcaagucaguuaucagccauaaggacacagaugaaacuugguauugcagagggcaucaaaccaugaguuugguaggcucgucuguucagcugauuuaucagggaauaguagaucuaguaucauggaaugaagaaugguuacaggugacugagaaaugaagcaacuaauggcagccucacgcccagucucugcagcgauccucuuugcaguugcugccacuuuaaacacauccacagaaucugggcaucccuaacuccuaagagaaauucugacuugauuuuuagagcucuagauccucagccucaauccaauccuuaauggucuaauuacuggacgccaagcugaauaccacugugugcucuaauuccaaaauucuuguucugauagcauauuuaguuucugcuugccaugccccacguacuucucucaaggcuguacucugucacagacuccagcccagugcguuucucugguccucuuaccaaacaacugccugacaaauuucuguguaaauauccaagugucaccugcuuuggaggcaggaaaaaauauagauauaggcagacaaacuuguauaggcugcagaaccaggaauguaaacuaaucacugaaaccuuggacaacucccugugaaccuuaguuuccuauacauauagaauugggucagugguacuugucucauuggguugguguaagaaauacaaagagggggucugguucuguugcccaggcuggagcgcaguaguaagaucuuggcuuggcucacugcaaccuccaccucuugggcucaagucacccucccaugucagccuccuaggcagcuggaacuagcagcacaugccaccacaccgccugacuuuuuuuuuuuuuuuuuaaguagagaugagguuucaccauguuguccaggcuggucuugaacuccugagcucaagcacccugccugccucagccucccaaagugcugggauuacaggcguccauccauacucuugauucuuaaaacaacccuaugaggcaguuauuaucaacaaaccuguauuacaaauaaggaaaaugaauacaaagaauuuaagaaacuuacacagggucacacagcuaaguaacuaaugguuguuugauauuacuuacauaucucuuuauauauaccuauauauaacagauauuucuuuaaauauucgguauacauauauauguuuguguauauacacaccuacacacacaaaaagauaaggauauuucccuacucagcacagagcagugcacauauuaaucacucaauaaacaggaguuuauuuauuuauuuuuuugagacgaaguuuugcucuuguugcccaggcuggagugcaauggcgagaucucggcucaccgcaaccuccgccucccagguucaagagauucuccugucucagccucccgaguagcugggauuacaggcaugugccaccacgcccggcuaauuuuuguauuuuugguagaaacaagguuucuccauguuggucaggcuggucucgaacucccaaccucaggugauccgcccuccuuggccucccaaaguacugggauuacaggcgugagccacggcacccggccuaaacaggaguuauuauuaucuuuguaguucucugauaaauuaaacaacuuucucauuuuaagauuagacucggcgggugugguagcucaugcauguaaucccagcacuuugggaggccaaggugguuggaucaccugaggucaagagcucgagaccagccuggucaaccuggugaaaccugucucuacuaaaaauacaaaaaucugccaggcgugguggcaggcaccuauaacaaccucagcuauucgggaggcuaaggcaggagaauugcuagaaccugggaggcagagguugcagcgagccgagaucacgccauugcacuccagcccaggcuacaacagcaagacuccauuuaaaaaaaaaaaaaagauuuuauagcuguauggugucagagcuagaggacagaauucaaucuucuguagucuuuugaaacugaggugauauacuaagucuuuugaaaacuguaacccagccccaaccuaaaucaauccuugacugauuugaggugaacagccccacauccuaucuaccuagcaaaggaaagagggagaaagauaucaucuuagucuccaggauuauuuuguaugcaaagucuguauacaauuuaaaaaauuaagaaguauggaaagagggagaaugacugauaagaggagaaaaaaguacagaaacaaauccacagaugauucagauauuggagcuggcaaacguggacuuuaaaaugacuaugauuaguauauuaaaagaaaauagaagaaaaaauugcacaaaaugaauuuaugaaaugacuuuuuggaaugaauuuuaacagaauacuggaaacuauuuuaaaaauuuaaaccugaaauacaguaccuagaaucuguaacucauuggauagacaguauaaaacagaauuaguuaacuuaaauucaggucaacaggccaggcgcaguggcuccugcauguaaucccagcacuuugggagucagaggcggguggaucaccugaggucaggaguuugagaacagccugaccaacauggugaaacccugucucuacuaaaaauacaaaaaaaacuagccgagugugguggcacaugccuguaaucccagcuacuugggaggcugcaguagcagaauggauuaaacacaggaggcagaguugcagugagccaagaucacgucauugcacuccagccugggcaacaagagcaaaacuccgucucaaaaaaaaaaaaaaaaaaaaaauuucaggucaaauccaaacugaagcacagaaaacaagggcaaaaaggacagaacacaguguuggagacacacagaacauagucaaaaauucuacuauacguagguuaaugaagaagagagagagaaugaagcagcaauauuugaaaagauaauggcuaugaauuuucuaaaacuaaugaaagauaaagaagcucagugaaccaaaggcaggaaagaaaaccacacccaugcacaucaaaguuuaacuguugaaaacaaacacaaagaguaaauauuaaaagcagccaaaagaaaaaagacauuacuuuaaaugcagcaauaauagcauuacuaaaagaaauuaagcaagccagggccgggcgcaguggcacacgccucuaaucccagcacuuugggaggcugaagcaggagaucacuugaggccagaguucaagaccagccuggccaacaugcugaaaccccaccuccacuaaaaauacaaaaauuagccgggcaugguggcgcaugccuguaaucccagcuacucgggaggcagagaaggaaaaucgccugaauucggguggcagggguugcagugagccaagaucaugccacugcacuucagacugggcaacagagugauacucugucucaaauaaauaaauaaagccagaaaacaauaaaaugaaaacuucauaguacugaaagggggaaaaaaacccagccuauaauuuuauauccagaaaaaaaaaaaccuucaaaaaaaaaaaaagcaaaauaaagauguuuucaggcaaauaaaaacugagacggguuguugacagcagaucugcacuauaaaaauuauuaaaaguucacuaagcugaaggaaaaucucucagauaaaaguaccacuucaggaagaaaugagaaacacuguuaaggaaaauaugugguuaaaaucaaaagaauaauauuugugacacauaaaaacuauauaaaacucaauaaauaaaguuuuauuggaaaacaaccauacucauucauuuauaacuuaucuguggcugcuuuaaugcuacaauggcagaguuuagcaguugcaagagaccauaugugguguucucaucacuucacacugcugcaugauauacuacaaaauuacagugauauaguagcuauauuugacaacguuuugagagccacacauaaugcuguacugggauauuuuauuuuuuauugucauugcuuaacccaucauauuaaaaccaaaaaagagagagagagagaaaaguggacuugaaaugucauacuuuuaggcgcaaggaauguuuugucaaauuagaugacaaagcauugucuuuauuaugcaaugacaauguaacuauccuaaaaaaaauacacuauucauagacauuaccaaauuacacucaucacacaacaguaccuaacucacgggaaaauaguagcaaaaaauuagaauauuuuauuuuauuuuugagauggaguuucgcuguuaccuaggcuagagugcaguggugcaaucuuggcucagagcaaccucugcuuccuggguucaagugauuccccugccugagccucccaagaaguugggauuacaggcucgugccaccacaccuggcuaauuuuuguauuuuuuuuuuuuuuugagacggagucuugcugucacccaggcuggagggcaguggcgugaucuuggcucaccgcaagcuccaccucccgaguucacgccauuuuccugccucagccucccgaguagcuggaacuacagguacccgccaccuugccuaauuuuuuguauuuucaguagagacgggguuucaccauggucuugaucuccugaccucgugauccgcccaccucggccucccaaagugcuggaauuacaggcgugagccaccgcgcccagccaauuuuuguauuuuuaguagagacagaguuucgccauguuggccaggcuggucucgaacuccugaccucagaugaucugcccgacucagccucccaaagugcugggauuacaggcgugagcuacuguacccggccuagaaaauucuaaaugaaguaucuuaucacaguagaauuucuucauaaaauaaugaaaauaaaacagcaacuaaauuagguggauggcucauuuguuagccuaucaagaaccacuuacuaaugauuaguucauuaaaucauguuugauuauaccagucaaagaaauguauccaggccaagcugggugcgguggcucacgccuauaaucccagcacuuugggaggccgaggugggcagaucacgaggucaggagaucaagaucauucuggcuaacacagugaaaccccgucucuacuaaaaaaauagaaaaaaugagccgggugugguggcgggcgccuguagucacagcuacucgggaggcugaggcaggagaauggcgugaacccgggaggcggagcuugcagugagccaagaucgugccacugaacuccagccugggugacagagcaagacuccgucuaaaaaaaaaaaaaaagauugugccacugcacuccagccugggcaacaagagugaaacuccgucucaaaaacaaaaaagaaaaaaaggaauguguccagaggaaauaagauuauuagcuuuuuggugagaacaguugcucagcaagcugaggauacuguaagcaacaucaacaguugauuaaaaaccaaggcaaugaaggcagggcuugguggcucacaccuauaaucucagcacuuuggaaggucgaggcaggcggaucauuugaggucaggaguucaagaccagccugaccaacauggugaaaccccgucucuacuaacaauacaaaaaaauuauccaggcgugguggcacacgccuguaaucccagcuacuccggagggugaggcaagagaaucgcuugaacccgggagguggaaguugcagugagccaagaucacaccacuacacuccagccugggccacagagcaagacugucucagaaaaagaaaaaaaaaggcaaaugauuuugagugguuuuccuuggcucuagaggacucaacauauguuacugauacagcucaguuguuuauuugagcagucaauacagacuucgaagugacugaauaauuagccucucuaaugaauguuuggaacaacaccaccaagaauauuuucaaacuugaauaaacacuaauucaguucaaccuuaaauggaaucugcuaaagaaacauuacaacugaugguaaaaaaaaaaaaaaaaaaaaaaaauagaugugggacagcuaggcgugguggcucacgccuguaaucccagcacuuugggaggcugagucgggcggaucaucugaagucaggaguucgagaccagccugaccaacauggugaagaccugucucuacugaaaauacaaaaucagcugggcaugguggcgcacaccuguaaucccagcuacuggggaggcugaggcagaagaaucgcuugaacccgggaggcgaagguugcagucagcggagaucgcgccacugcacuccagccugggcgacaagagugaaacucucucaaaaauacuuauauauauguguguguggaacagaaaaaggcuuauuaauuggacaaauuaauaaaacuuaugaaaauauaaaauguaauaaaguguuucaagcuuaugguuacucacuguauuauucaucagcagguacugauggcagugauguuuuaacugcaauuuuuugagcuugggaucaagacaaauuuuucugaagaaguaaccucaacuaucauuauagaauacuaaauggccuuggaaaucagcuuuuuuacugcaagguugauaauaccucuuaauagauuuuuaaacuaaaauuauaugacaaauagcacuuauguacaaaacuuaugcagugguaaaacccaaaauauuuggaugaaaacaaagguugucugaauuauaaguaaugucaaacaucucuauaaacuuccugucuuaaacaaaaguuaaaacaagaaguaggcugggcgcaguggcucacgccuguaaucccagcacucugagaggccaaggcagaucauuugaggucaggaguucaagaucagccuggacaacauggugaaaccccaucucuaccaaaaauacuaaaauuagccaggugugguggcgcgagccuauaaucccagcuacuaggggggcugaggcaggaggaucgcucaaacccaggaggcagagguugcagugagcugagaucaugccacuucccucuagccugggagacauagccagacuccaucucaaaaaaaaaaacaaaaaaguuaaaacaagaaguaaaaccuccauuuccagacaaauuugcuaugaauguauuuuccuuuuuuucuacuugcugcauuacuacuaaugaaguaaguugagugauuuuuuuuuuaaaaagaggucugcuugccugggcaugguggcucacaccuguaaucccagcacuuugcaagcccaaggugggcaaaccaccugagguuaggaguucgagaccagccuggccaacauggugaaaccccaucucuacuaaaaauacaaaaauuagcugggcgggauggcgcaugucuguaaucccagcuauuugggaggcugaggcagaagaaucgcuucacccccaggagguggagguugcagugagccaagaucgugccacugcacuccagccugggcgacagagcaagacucugucuuaaaaaaaaaaaaaaaaaaaaaaaguggucuguuuuuuuuuuuuuguaaacacggucucacaacugucacucaggcugccaugcaguagcacgaucacagccugggcucaagccauccucccaccucagccuuccaaguagcuggaacuacaggcaugugucauggcauguggcuagaauauauuuccugagcucaaauugcagcuucagcaguguuuuucagaccuucagccaaguacaaaaggaaauuuauauacaucaaaauccaguuaacugugcaauuguagcgcuuccacguacucuuuaauuggaagugauuaaucuacacuacaauggcaugcuaaaaagcaaauaucaagagaagaaucuaacagaauucuauauacucccucccaagcaauaaauaucacaaugaaaaucauaugcccauguacuaguaucugcauuuagcaguaccaaucuguaugaagacauuuucaaagaggaaaucucauucgagaucaacaugagcaauccauuuuaaugaaaacaauaaccuuauuaagugaugcaauuauccaucccuccaaaauuaauucaauucuuaaugagaccugcauuaccaaaaaaaaaauuucaauuauuuuuauuugaauuuugucaauacaaauugguggaaauuuaucuucucucuuguaauauaaaucugucaccccaggcuggagugcagugccauaaggcucacugcagccgcaaccucccaggcucaggugauccuccuaccucagccuuccgcguaucugggacuacaggugugcaccaccaugcccagcuaauuuuuuuuuauuuuuguggaaacaaggucucacuaugucacucaggcugguggagaauuccugggcucaagugauccucugaccucggccuuccaaagugcugggauuacaaguaugagccacuuugcccacccuaaauauaguaucuuuaauuuugccuccgggccugcaaaaauuaaaacaucugcuaccuggccuuuuacagaaaaagaaugccagccacugaacuauauaauuacuuacagaauaaaaacaaauuaagguugaaagagaauauugcauguaaugaauaaucugacaagauagauauaauacagauaugaugaugucggggggugaugaggacagcauacaugaaacaauuuaugcaacuauucucagcaaucacauugguuaugguauuauuaguauugcuauucugagacuacuguguaauauacgagaaaacaagcgaguaauuaauaaugaggauauucuaguucauuauucccuauccuugagaaccagaauuuuuaacauggaaaaauauacaccgauguauuauaauacagaagugguuaaguuuuauaaaaaagcauguguacagauauacacauauacauauauaucacccauaacucuguccuagaaacaaugacaacucacagcagcaauaaucucuaagguccauauuaggcgcccuaaauaccucugccacuaaaaccagggcuuguugaagaaauaauagguuauaaaucugggguagaaacuguaaaagauaagccugcaacaccuggucauaccagauagcaaagaugcuacgaaaacuacaagaaguagaccaagucauucaggagucaacuugaagaagcuccaacuggccaaagacauaaggcugggcgcaguggcucacgcccguaaucccagcacuuugggaggccgaggcagguggaacaccugaggucaggaguucgagaccagccuggccaacauggugaaacuccgucucuacuaauaauccaaaaauuagccaggcaugguggcacacgccuguaaucccagcuacucgggaggcugaaucagaauagcuugaacccgggaggcagagguugcagugagccgagaucgcaccacugcacaccagccugggggauaaagcaagacuucgucucaaaaaaaaaaaaaucaggcgugguggcaggugcuuauaauuccagcuacucgagagguugaggcaggagaauugcuugaacccggggggcagagguugcagugaguugcgauggccccacuucacuccagccugggugaaagagugaaacuccaucucaaaaaaauuaauuaauuaaauuaaauuaaauagcugguucucuuagagaauaauagggaacuaagucacuauuuugaaaaaagaauaaauaaaggcaaagaaucaaguauauauccuaccuuuccuauauaacugugccacuggauaacugaacagcagguaagcagaagcaucucuuaauaaaaguauuccaacaaaaaauuuuaaaaaaacccacacaauuagaaugucacuauuuuuaaaccauugauaaauuaauggaucugggcacugagcccaacaacugcggacaugauuuaaaaaaaagagaaaaccagacuucugccuccccaugaaagaacacaacacugccuacaguauugcuaaagagaccgaaccagagucugaccaagucucugaguucaguaaccaauuugcaaaauauacaaggaaugaagaaagaugcaacaugaguguacaaucaguaaaauucaaacuuugguuaacucucccuggguucuucaacauaaaaacuaaggaaaaaaaagggauagaggcauaaacugugguuuaaaagacaucauaacacuaaauaaaauauaaugucuaagaauguacacggugauaaaacuauaaaagaaaaggaaaugacugagagagagugaaguagugguuauuuuucuuuuuugggaggugaguuacaacugaaauggaacacauggauggcuccuggauggcugaaaaguucuguuucuugaacuggggauauggauauucgccuuauuuuuuaaaaaaagaaaaaggggaaaaagcacuaucuguauguuugugaaagagacguuuucugcuaauuuuacauacaaauauuaaaagcaacuuagaaaacauaccuacuuaguucauucaagcugcuauaccaaaagucauaaacuggguggcuuauaaacaacagaauuuuuuuuuuuuaagagucagggucucacucugucacccagauuggaguacaauggcacaaucauagcucacugcagccucaaacuucugugcucaagcaauccuccaaccucagccucccaaguagcuaagauuacagguagaccaccacacuuggcuaacuuauuagauuuuuuuguagagacagaaucuugcuauguugcccaggcuggucuuaaacuccugaucucaagcaaucuucccaccucagccucccaaagugcuaggauuauaggcaugagccaccacuccuagcuuaaacaacaguaauuuauuucucacaguucuggagacugggaagaccaagacaccaacaaaucuggagucuaguaagggcccauucuucauauacgaugccuucuugcugcauucucaaguagugaaaaggacuagcuagcucucuggggccucugucauaagaacacuaaucucaggcccagcacgguggcucacaccuguacucccagcacuuuggaaggcugaggcggguggaucaccugaggucaggaguucgagaccagccuggccaucauggcgaaacuccgucucuacuaaaaauacaaaaauuagccaggugugguggcaggagccuguuaucucagcuaccugggaggcugaggcaggagaauugcucgaaccugggaggcagagggugcagugagcagagacccugccauugcaguccagucugggcaacaagagugaaacuccgucucaaaacaaaaacaaaaacacaaacacuaauuucauucaugaagccagagcccucacgacguaaucaccucccaaaagccagaccuccuuauacuaucacauuggggauuauguuucaacauaugucuuuuggggauacacauucagaccacagcaacuuuuuuuuuuuuuuuuugagacagugccucgcucuguugccuagguuggaguacagugccucgaucucagcucacugcaaccuccaucucccagguucaagcaauucuccugccuuauccucccgaguagcugggauuacaggugcgcuccaccaugcucggcuaguuuuuguauuuuuaguauagaccagguuucuccauguuggccagcuggucucgaacucuucaucucaggugauccacccaccucggccucccaaagugcugggauuacaggcgugaaccaccacgacuggccagaccacagcaacuauguaaaacaauaauacuguugcuuuagagguuuauaagaaaauauaccaucaauagggcaaaggacaagaaggagguaaagagcuaaauguacgguucuugcauuuccugggaaguaauaaaaccaacuaacauaaacuaaacuguaguaaauuaagaauccauaauccaccugucucagccucccgaaguucugggaucacaggcgugagccaccaugcccagccaagauauacacauuuuauuguauguacauacaccucaauuuaaaaaaaaacuauuaagcagauuaacauuagcaaacaucucaggaaaguuuaccaugaaacacuuaaaauacaacucaacgugaagaaaacaguccaugcaggaaaaguaaaauguauuaaaaauguauauauauauguacauacauauauauaaacauuauauacguauacacaguaggcccuccauaucccuggguucuaccaacaguggaucaaaaauauucaagcgaaaaaaaaacaagaaaaaaaaaacaguaaaaaaagcaauaaaaaauaauacaaacuaaaaaauacagcuagacugccacugcacuccagccugggcaacagagcaaaacuccaucucaaaaaaauaaauuaaaaaaauaaagcauaugggagaaugugcacagguuaaauguaaauacuauaucauuuuauauaagggacuugaccauucaagauuuugguaucaguggggguccuuggaacucccccuauggauacugaaggacaacuguaaauaauggcuuauauaugagacauauaauuacacauacauaaaacuauguauacuucuauauaagcuauauauauuuaccuauauaucuguauauacaugaugucuucagggaguuaauaggagaaacgacaaccaugaucaagacaucaaaaccaagacaucaaaaacagaauguuggcuaagcccaguggaucacaccugcaaucuuaacacuguaggaggaaugcuugagcccagaguuugagaccagccugggcaacauauugagacacugucucuauuaaaaaacaagaacaggccaggugugguggcucuguaauccuagcacaaugagaggcuaaggcagguagaucaauugagcucaggaguucaagaacagccugggcaacacagcaaaacccaucucuacuaaaaauauaaaaauuagcugggugugguagcaggugccuacagucucagcuacuuaggaggcugaggugggagaaucucuugagcccaggaggcagagguugcaguaagcuauguucgcaccacugcacuccagcuuaggcagcagagcaagagcagacccugucucaaaaaaaaaaaaaaaaaagaagcagcagcugccuaaacugaaaauaagaggcugggcacaguggcucauaccuguaaucacagcacugugcauggucggggcugagauaagaauaucgcuugagcccaggaggcugaggcugcagugagccuugaucgcaccccugcacuccagccuaagccacaaagcaagauucugucucaaaaacaaauaaaggaaaaaaaagagaaaaagauauguuaauuagaagaauuaauucagacuguucuauauccagauaaugggugcuccccaaaaaacaugaggaaaaacauagaggagaaaauaucuugaaauaauucaagaaaauuucccaaugcugaaaaacaugaguuuaaaaguaccuacagcaaugugaaauuuaagaaaucagggacacacagaguccugcaaacuuccagaagaaaaaacucuucacauaccaugcacaggauuuagaacauucuugaauuucaaacaucaucuuuggaacuaagaacccaauacaguaauguccucgaaauucuaaagcuacaggauuuccaaucuagaauucuauacccagccaaguaauuucaaguauaaaguuagaauaaagcuucaaaaaauuuaccugcuaggcacacuuccucaagaauauauauauauauauuuuuuuuuuuugagauaagagucuugcucuguugcccaggcuggaguacaguggcaugaucuuggcucacugcauccucugccucccagguugaagugauucuccugccucugccucccgaguagcugggacuacaggcaugugccaccaugucuggcuaauuuuuuguauuuuuaguagagauggggcuuugccauguuggccaggaugcucucaaacuccugaccucaaaugaucugcgugccucugccucccaaaguacugggaucauaggcaugagccaccaagcccagcaaaauauucuaaaauugacuguggugaugauugcacaauucugacuaaaaaccacugaauuacagucauauguugccuaaugacaggaauauguucugagaaaugcaucauuaggcaauuucaucauugugugaacaucauacagcaugcuuacacaaaaaugguauacuuguaccuagaugguauaggcuccuacacaucuaggcuauaugguauagccuauugcuccuaggcuucaaaccuguacagcauguuacuauacugaauauuguaggugaguagcugggauuauaggcgccucccaccacgcccagcuaauuuuucuauauuuuuaguagagacaggguuucaccaugcuggccgggcuggucucaaacuccugaccucaggugauccaucugccucgcccucccgaaagugcugggauaacaggcgugagccacugugcccagcccacaauucuuauacuauacaaacuuuuaacuuuuugaccuuugaaacaacacuuagcuucuuagcuuaaaacgaaaucacacuauacagcuguacaaaaauaacucauaucuuuacuuucuucuacaagccuuuuuuagagaaagggucucacuccguugcccaggcuggagugcaguagugcaaucauagcucacuguaaccuugaauucccaggcucaaaugauccucccaccucagccuccugaguaguugggacuacaggugcgugccaccaggccuggcuguuuuguuuuuuuuuuuguagaaacgggaucucccuaugucacccaggcuggucuugaacucgugggcucaagugauccacacaccucagccucccaaagugcucagauuacagguguaagccacugugccuggccaacucugucucaaaaacaaacaaaaauuguaaggacauauaaaguuuccugcgacaucuuuuguauuaaggaaaaggcugaaacaacuuaaguguccagcaauagaaaugaaguacagcauauacacuacacggcauuuaaaaacuacacuuaggccgggcucaguggcucaagccuauaaucucagcacuuugggaggcugaggcagguggaucaccucaggucaccagcugaagaccagccugaccaauaugaugaaaccuuguaucuacuaaaaauacaaaaauuacccaggcaugguggugggugccuguagucccaacuacucgggaggcugagacaagagaaucacuugaaccuggagacagagguugcagugagccaagaucaugccauuaaacuccagccuaggcaacagaaagagauugggucucaaaaaaaaaaaaaaaaaaaaccuacacuuagacaugcauguucucucaugaaaagauagcuaaaacauauucauauuaaguuucaaaacauauuacaaaccaguuuauguaauauguucccaacaugcauaucuggaaggacaaaaaggaaauacucauuacucugggaaaugugauuguggguaauuucucucuuuuucuauuuguuuaucaauauuuucuuuucuuuucuuuucuuuuguuuuuuuuuuuccugagacagaguuucggucuuguugcccaggcuggagugcaacggcacgaucucggcuuacugcaaccuccaccucccgggaacaagggauucuccugccucagccucccgaguagcugggauuacaggcaugugucaccacauccggcuaauuuuguauuuuuaguagagaugggguuucuccacguuggccaggcuggucucgaacuccugaccucaggugauccaccugcuucagccucccaaagugcugggauuacaggugugagccaccgugcgaggucuauauuuucuaauuuuuauauaaugaauagguuuuauaaauauaauuaaauaguagcuauuuaacagcuaauaucgugacaaggucauggaagaugguggacuaaggagcuccaggaaggcugggcguguggcucacgccuguaaucccaacacuuugggaggccaaggugggcagaucaccuaaggucaggagugcgagaccagccugaccaacacggugaaacccgucucuacuaaaaauacaaaaaaucagcugggugaggugguuugugccuauaauuccagcuacucuacagcuacuugggaggcugaggcaggagagucacuugaacccgggagacggagguugcagugagccgagacugagccaucacacuccagccugggcaacagagcgagacucugucuccaaaaaaaaaaaaagaaaaaaaaaaagaagcuccaagaauccgucacuacaccuaaacaaccacugagcugguaggaauugucuaaaguaacuacugugggacucuagagucuaccaaacauuuacagcauccaaaagagaacggcaugauucacaauaacccaaaggugggaacaacccaagcauccaucaacagaugaauuauacaaacaacggaauguuauucagccauuaaaagggaugaaauucagagacaugcuacaacauggaugaaucuugagauaauuauacuaagugaaauaaaacagacacuaaaggacaaauauuuuaugacuccacuucuacaaggugcccagaauaaacaaauucauaaagacagaaaggagaauugagauuaccagagaaugaaggcaagggggaaaaauuaguuacuauuuaacagcuucaaaguuucaguguggaaugaagaaaaaguuuagaaaauaggucaugaugcugguuacacuucacagugaauauacuuaaugucacugaacuguacucuuaaaaaugguuaaaaugguaauuauaugauucaccacaaucaaaauaaaaugcuaugucguaaaauguaacugagaagugacagauggaguuuaaauccuucuuuucauauaaucuuccauuacuuagaacauuuuuuauuguuaaguaaugcugaagcucuuacaagaaacgaccauaucagccgggcacagugguucaugucuguaaucccagcacuuugggaggccgaggcagguggaucaccugaggucaggggaccaaccuggccaacauggugaaaccacgucucugcuaaaaacacaaaaauuagucgggcgcgguggcucacgccuguaaugccagcacuuugggaggccaaggcaggcggaucacgaggucaggagaucaagaccauccuggcuaacacggugaaaccccgucuguacuaaaaauaaaaaaaaauuagccaggcacgguggcauguguuuguaaucccagcuacucgggaggcugaggcaggagaaucacuugaacccaggaggcggagguuucacugagcugagaucgugccacugcacuccagccugggcaauacagcaaaauccuuucucaaaaaagaaaaaccucauaauuuucaaauuaguagaauccaaauuagugaggacucauuguaccacacaaauaauaacucugaguccucagagccauuuuccucauauuuuaagaaaaaagaguaacuucauuuucuucucacauagacaaauuugguauaaaaacugcccugcuguggucaucuuuuucuuuaaaaaacugaaugugacuauacauuuaucaaaauucauagaacuauguaacuaaaaagauuaauuuuaauguauaaauuauaccuccauaaaccugacuacuuaaaacuauaauagaauuuaauuaaaguuuugauucugagagcauuaaaaaaaaccuugaaaaaauuuaauuaaaguucaaccaaagaguauuaaauaauuucuuucuuucuuucuuuuuuuuuuuuuuagacggagucucacucuuguugcccaggcuggagugcaguggcacaaucucggcucucaccgcaaccuccgccucccagguugacgucauucuccugccucagccucccaaguagcuggaacuacaggugcuggccgcgaagcgcagcuaauuuuuuuguauuuuuaguacagacgggguuucaccguguuagccaggauggucucgaucuccugaccuugugauccgcccaccucagccuaccaaagugcugggauuacaggcaugagccacagcgcccggccgaaaaaauuugauuaaaguucaaccaaaggguauuaaauaauuucuuuucuuuucuuuuuuuuuuugagauagauuuucgcucuuguugcccaggcuggagugcaauggcgcaaucucagcucacugcaaccucugcuucccggguucaagcgauucuccugccucagccucugaaguagcugggauuacaggcacgcaccaccacgccugccuaauuuuguauuuuuaguagagacgggguuucuccauauuggucaggcuggucucgaacucccaaccucaggugauccgcccaccucggccucccaaagugcugggauuacaggcaugaggcacugcacccggccuaaauaauuuauuagugauugcuaucguugauucaaugaaucaagcuuaagaauaccugggucacaggucgggcgcgguggcacacgccaguaaucccagcacuuugggaggcugaagcaggcagaucaccugaguucgggaguuugagaccagccugaucaacauggaaaaaccccaucucuacuaaaaauacaaaaaauuaaccgggcguguuggcaggcaccuauagucccaacuacuagggaggcugaggcaggagaauggcaugaaccugggaagcgaaacuugcagugagccaagaccgcgccucugcacuucagccugggcgacauagugagacuccgucucaaaaacaaacaaauaaaauaaaauaaauaaaauaagaguucgagaccugccuggccaacauggugaaaccccaucucuacuaaaaauacaaaaauuagccagguguggugaugcaugccuauaaucccagcuacuccagaggcugaggcaagagaacagcuugaacuugggagguggagguugcagugagccgagauggcgccacugcacuccagccugggaggcagagcaagacucugucucaaacaaacaaacaaaaaguauuaagucauaagaaggaaaauauucuuuugaauaacaaaacucuuuuguuuugccuuauugcauauaucagguaugauuacaaguaaacuuaaaaaucuguuuuuuaagauuuaagccacuguuucuuuuuucuuuguagagaugggggucucacuacguugcucggccagucuugaacuccugggcucaagagauccaccagccucaaccucccaaagugcuaggauuacaggugugaggcacaacacccagccaccagucuguuucugugaagaacuacuacauauuuuccaaguuuuuauaacuuuaccuauucuuuuuuuuuuuuuuuuuuuuuuugcuaguucagugaaacagagggaaugaagaagaaacuaagcaaucuguaacugguugugaucaauagguuguaaauaccacugcacucggaccagccuacucuacucauucuuaauauuaucuuauaaauggaaccacaguuauuucaacaagguagaaauuauucaauguuuaaaacccaaauuacuauguuugcuacuaaaugagccaauaugaauuauuuuaugggacuuaucccucaaauuaaauaccagcugcccaugcaacaaauaagcaaagcagauaucucuuuuuuuuuuuuuuccuuugagagggauucuugcugugucccccaggcuggauugcaguggccgaucuuggcucacugcaaccucugccucccggguucaagagauucuccugccucagccucccaaguggcugggaugagaggcgcacaacaccacgacaggcuaauuuuuguauuuucaguagagacggggguuucacgauguuggucaggcuggucucgaacuccugaccucaggugaucugcccaccucgaccucccaaagugcugggauuacaggcaugagccaacgcguccaaucagcaaagcagauaucuaaagaauuaugaggccgggcgcaguggcucaugccuguaaucccagcacuuugggaggccgaggcgggcagaucacaugaggucaggaguucgagaccagccuggccaacauggugaaaccccgucucuaccaaaauacaaaaauuagcugggcaugguggcaugcgccuguagucccagcgacucgggaggcugaggcaugagaauuguuugaauccaagagguggaaggugcagugagcugaggucacgcaacugcacuccagcaugggugacagggcaagacucugucucaaaaaaaaaaaaaaaaauuaugaaacuuggaaauccaaaugcagaauaaauuaaccaauuaaaacuacugcacugauuaggcugggcgcgguggcucacgccuguaauccuagcacuuugggaggccgaggagggcggaucaccagaggucgggaguucgagaccagcuugaccaacguggagaaacccugucucuacuaaaaguacaaaauuagccgggcgugguggcacaugccuauaguccuugcuacucgggaggcugaggcaggagaaucacuugaaaacccaggaggcggagguugcggugagccgagauugugccacugcacuccagucugggcaacuagagcgaaacuguuuaaaaaaaaaaaaaaaaaaaaaacgauugcacuaaucuaaagaugcuguaauagagguuaaaaaauagcacucacuagacucaaaugaggaaacugaaaagaauguuucccuaagcuuagguuuccucuaugaugcuuaaauauacuuggaaaauaucaaggcauuauuauuuuaaaagcauaaaccaauauuguauugagaaauuuaacuuucucuaucaucucucacuuucagagguacuauaucaucauuucucaucccaaaaucaacuuuuuauaaaaacagauuuugcggguacccaugcaguuuuguuacauggauguuuugcauagaggugaagucuaggcauucaguguacccaucauccaaagaguauacauuguacccauuagguaaucucucaucacuuaagcugccuccauucuuccaccuuucugaguacccaaugucuccaaaaccaaauucuuagacuuauauuuuucucaauauuggcaccauucccacccuccccuuaauguuaaaguugcuauuaaagaaaucaauuugcuaauaaaaagccuuucugaaauaugauuuaucauucucuuauucaaguaguccagaauuuuuuaaagauccauuuuuuuccuguggauucaacagacaaaaggccaggcgcgguggcucacaacuauaaucccagcacugugggaagccaaggugggcagaucacuugagguaaauucaaucccagccuggccaacacagugaaacccugucucuacuaaaaauacaaaaaucaggccgggcaugguggcucacacuuguaaucccagaacuuugggaggcugaggcaggcagaucaccugaggucaggaauucgagacgagucuggccaacagggugaaaccccaucucuacugaaaauacaaaaaaguauccaggcauggcagcgugcgccuauaaucccagcuacucaggaggcugagacagaauaaucacuugaacccgggaggcagaggcugcagugagccaaaaucaugccaucgcacucuagccagggcaacaagagcaaaacuccaucucaaaaaaaaaaaaacuacaaaaauuagcugggcaugguggcacaugccuguaaucccagcuacucgggaggcugagccaggagaauugcuuaaaccagggaggcggagauugcagugagccgagcucgcaccacugcacuccaggcuggggaacagagcgagacuugaucucaaauauaaauaaauaaauaacaaaaauuagcccggugguggcacaugccuguagucccagcuacuuggaggcuaaggcagcagaacugauugaacccaggaggcggagguugcagugagccaagaucacuccacugcacuccagcguggacgacagugagacugucugcaaaaaaaaaaaaaaaaguuuuaagagacaaaaacugaagucaucaaaauuuuaaaacaguuccuuguaaaacacuccauaaguuugauuuuaauuuuuuuuuuuuuuuugagaaauagucuugcucuauugcccaggcuggugugcaauggugggaucucggcucacugcaaccuccaccucccagguucaagcgauucuucugccucagccucccgaguagcugggauuauaggcgcgugcuaccacaaccagcuaauuuuguauuuucaguagagauaggguuucaccauguuggucaggcuggucuugaacuccugaccucaggugagccgccagccucagccucccaaaguccugggacuacagugagccucugugcccagccuaauuuaauuuuuaauuuuauuaauuuauuuuauuuguauuuauuuuuuuuuugagagggagucuugcuaugucgcccaggcuggauugcaguggcauaaucugggcucacugcaaccuccgccucccggguucaagcaauucacccgccucagccucuugaguagcugagauuacaggcaugugccaccaugcccagcuaauuuuuguauuuuuaguagagacgggguuucaccauguuggucaggcuggucuugaacuccugaucucacguaaucugcccaccucagccucccaaagugcugggauuacaggcaugggucaccacgccgagccugauuuaauuuuuaauuuaauuuuauuaauuaauuaauuuuuuuuuuuagauggaauuucacucuuguugcccaggcuggagugcaauggcgcaaucucagcuuacugcaaauuccaccucccgcauucaaacaauucuccugccugagccucccaaguagcugggauuucaggcgugcgccaccacaccaggcuaauuuuuguauuuuuaguugagacagcguuucgccauguugaccaggcuggugccgaacuccuaaucucaagugauucgcccgcuuuggcaucccaaagugcugggauuacaggcgugagccacggugcccagccuauuuauuuuuaauuuaacuuauuuauuuuugagacugagucuugcucuguuacccagcuagaguacaauggcaugcucauggcucacugaagccucgaccucccaggcucaagugauccucccaccucaacucaaccuucuaaguagcugggaccaaagacacaaacugccaugcuugacuaauuuuuuuuuauucgaacagcgucaaaaaauaauaauaauaauaagacaauaaccaaaaccuuuuuauuuuuuuuugaggcagagucucacugucgcccaggcuggagcgcaguggcgcgaucucggcucacugcagccuccgcuuccuggguucaagcgauuggccuggguucaagagauucuccugcuucagccucucggauagcugggacuacagguucacgacaucaugccuggcuaauuuuuggauuuucaguagaugugggguuucaccacgcuguccaggcuggucucgaacuuccgagcucaggugaucugcccaccucugccucccaaagugcuggguaaaaauuauaaucgugagccacugcacccacccaauaaccaaaacauuuuuauauguauuuguuacuaaaucaaauaaagguguuuaaaguggacuauucacuuuucuuuuuuuuuggagggggcggcaggggacagagucucacucuguugcccagacuggagugcaauggcgugaucucagcucacugcaaccucuccgccucuggauucaagccauucuccugccucagccucccggguagcuggaacuacaggcacgugccaccaugcccugcuaauuuuuuguaguuuuaguagagacgggguuugaccguguuagccagaauggucucaaucuccuggccucgugauccgccugccucggccucccaaagugcugggguuacaggcgugagccaccacuccuagccacuuugcaucuuaaauacauauuccaacaccugaauuuuccaauuaucauguggaagaucauuuaaguaacaucaaaccuuggugaugugaacuaaauuuaccucuucaacuuaguaucuaucauuccauucacuucagagucaacuaauuuugagguacauaagcauaaucucugaauaacaauuucuugcugaauaaaguugauauuaacacaaucaaagagguuaaauuuuacucaggaaucucuguaggauuuuuuuuuuuuuuuuugagacagagucccauucuguugcucaggcuggagugcaguggcacaagauuuuggcucaccgcaaaccugcaccuccuggguucaagcgauucuccugccucagccucccaaguagcugggacuacaggcgcaugccaccacacccggcuacuuuuuguauuuuuaguagagaugggguuucaccauauuggcuaugcuggucuugaacuccugaccucaagugaucugcccaccuccgccucccaaaagugcugggauuacaggugugagcaggcaugagccacugcauccaaccaacucagauaucucuguagucguaugugaagcaguucaaaagaaguucagaaacauaaaagaauuaaaccuuuucaauauaaucuuuaagcaagauggaaaucuguaguccuaaacucugaauuuauaccuuuuccucacuguuauuuuuccauaacuagauuaucagagguagccuaauuugcuggauggucuccuuucucucacgugucuccaacugaccauuaaguuggaaagauggaacagaacauuuuaucauuauguugaaaaauggucuaacuagccuuaaagcuuuaaaagcuuugcuuuuggacaggugugguggcucaugccuguaaucccagcacuuugggaggccgagguggguggauuaccugaggucaggaguuugagaccacccugaccaacauggugaaaccccaucucuacuaaaaauacaaaaauuagucuggcaugguggcacacgccuguagccccagcuacucgggaagcugaggaggagaauugcuuggacccaggagauggaggcugcagugagccaagauuguaccacugcacuccagcuuggguaacagagacucugucucaaaaaaaaaaaaaaaaaaagcuuugcuuuuaugaagaucauucuuuuuguuuuuguuguuugccucccaaagugcugggauuacaggcgaccgccuggccgaucauucuuaaaagcucuaagguuaucauuguccuaauacuuucacuuacuaucuuuaaggaagugacuuuuccuacaauuugcuuuuccuuuaaugaguccucaauaaaaauuuuuccugacacaaaaggugaaaaaaggagaaucaacgcagaguauuaauuaggaccuaaauccuucaauccaggaagaaauaauccuuauuuuagcaaaucuaugacauugaaacugguauuuaaaaaaaaauuuaccaaaagauuucaaugaaauggucucucacaacuagguuauaaguaccacuuggcugauggcaauuacaagacuucauggauuccaagaauuuuuuuuuuuuuuuuuuuugagacagagcuucacucuguugcccaggcuggaguacacuggcaugaucuaggcucacugcagccuccaccucuuggguucaagcaauucuccugccucagccucccaaguagcugggacugcaggugcggaccaucacacccgcuaauuuuuuuuuuuuuuuugagacagagccucgcucucucgcccaggcuagagagcagugccucgauaucaguucacugcaagcuccgccucccggguucacgccauucuccugccucagccucccaaguagcugggacuacaugugccuaccaccaugccuggcuaauuuuuuuguauuuuuuuaguagagaugggguuucaccacguuagccaggaugaucuccaucuccugaccucgugauccgcccgccucggccucccaaagugcuaggauuacaggcaugagcuaccgcgcccggcccacaccagcuaauuuguguauuuuuaguggagaccggguuucaccauguuggccaggcuggucuugaacuccugacaucaggugauccacccgccucggccucccaaaguccugggauuacaggaaugagccaccacaccuggccaucuaagaaauuucuuaaucaaaaagaaguuaaaagguagaaaaauaugcaucuuguaaucaacuaaacaggauaaaagcauauucuaugaaaaacuaaggcaucauauuugguuugaaaaauguucugagaaacaacaaaaagugaaacuucauuuaguuuccaaaacccuuagaccuuaacuguguuuccauuuauaacguuaccuuaguucacccaguacucaagacaacuucaucuuccagaaagagacagcuaaaugcccuaagagguaguuucaaaguuaacugagagaaaugggggaauaaaagagcauucguuuuauaauuuuaaaggagcuguuuaaaauugucuuuaaguugccuauccaaauaccuuacaagaggauucuuagcucaucggcaguaaacccucugaaaaagauacauaaaauuaguuuacguguacccauuuucucugagaaaauucuucaauuucucaaaagaaucccugucucaaaaaggcaaacaaucauuuuccuaaaaaaauuuuuucagccaggcgcgguggcucaugccuguaaucccagcacuuugggaggccaaggcggguagaucaucugaggucaggaguuugagaccagccuggacaacauggugaaaccccguuuccacuaaaaauacaaaaauuaaccgggcgugcuggcacgcaccuguaaucccagcuacuugggaggcuaaggcaggagaacugcuugaacccgggaggcagagguugcagugagccaagaucgcgccacugcacuucagccugcgcaacagagcaagacuccaucuaggaaaaaaaaaaauuuuuuuucaacuauauuuuaccaauuaaagagucauaaaauaggcugggugcaaugguucagaccuauaaucgcagugcuuugggaggcugaggcgggaggauuacuugagcccaggaguucaagacaagccuggacaacauagcgagacucugucucuaaaauaauaauaauaggcugggcacacuggcucacaucuguaaucccagcacuuugggaggccaaggugggcagaucacuugaggccaggaguucaagaccagccuggccaacauggcaaaaccccaucucuacuaaaaauuacaaaaauuagccaggcaugguggugcacgccuguaaucccagcuacuugggaggcugaggcacgagaacugcuugaacacaggagguaaagguugcagugagccgaaaucacaccacugcaguccagccugagcaacagagcgagacucagcuaaaaaaaaaaaaaaaaaauuaauaagaagaagaaaaagaaaaaaaagaaauaaaauaucuaaaugacauugccagaucuaggcuaagucugguuuguuuuuuuagggggaagagggaaggcagaaaauagauucauucauugcaaaacaaaugaagcauaggaaauaaugcauauucucuuauuaaaaaaaaaauuauuuggcugggugugguagcucacaucuguaacaccagcacuuugggaggccaaggugggaggauuguuugaagccaggaguucgagaccagccuggccuaugagacccuuucugcauaaacaauuuuuuuuuuaaauuaaaacgagugugguaugcaccugcagucccagcuacucaggagggugaggcaagaggaucccuugagcccaaguguuucaggcugcagugagcuaugaucacaccacugcacuccagccugggcaacaaagugagacccuaucucuuaaaaaaaaaaaaaaaagguuuugaagaguuucuuuaauguaagucaguguaggccaggugugguggcucaggccuguaaucccagcacuuugggaggcugaggugagcgggaucaccugaggucaggaguuugagaccagccuaaccaacauggagaaaccucgucucuaccaaaaauacagaauuagcugggcaugguggcgcaugccuguaaucccagcuacucaggaggcugaggcagaagaaucgcuugaacccaggaggcggagguugcagugagccgagaucgcuccacugcacuccagccugggcaauaagagcaaaacucagucucaaaaaaaaaaaauauauauauauauaugucaguguugagucuaauaaagauguuccuaauaaggaaaacuuuaaguauacaacaaauacuuucuaaauuaucagacuggaguuuucuaaaaauggaacacaucuauauuucauuaccucaaucaaauuauuuaauaaaaucaaaacuauaaaagguuggccaggagugguggcucaggccucuaauuaggauuacauuuugggaggcugagaugggcagaucacuuaaggucagggguucaagaccagccuggccaacauggugaaacccugucucuacuaaaaauacaaaaagaauuagccagguuucauggcgcacgccgguaaucccagcuacucgggaggcugaggcaagagaaucgcuugaacccaggaggcagagguugcagugagcugagaucgugccacugcacuccagccuggcaaaagagugagacuccaucucaaaaaaaaaaaaaauuuuuuuuuguuaugcauaucauaaaagaggcacucuuucuggcucuagacucacugcuauaaugcuuuagauaaauaaugcaaaaguuccaaggagguucaguacuaaagcacccacacuaagcuacaauccuuagcaggaguuauuugaaaagauaguuccagccgggcaugguggcugacgccuguaaaaccagcacuuuggguggcugagaaaggaggauccuuugaacccaggaguuugagaccagccuggacaaaauagugagacccuaccucacuuaacaauacugaagaaaaaaaaauuagccgggcguagucaugccuguagucccagcuacucagggggcugaggugggaggacugcuugagccuaggauguggaagcugcagugagccaugaucacaccacuguaccccaaacuaagugacagagaaagacccugaaaaaguuccuuucaaaagaaagggggugaacuuguuaaaagucuucauuagcuacugacuugauccacaauuuauuuuucuaguaacaauaaaauuccgacuugcuuagguagcaaaauaagaaacuacacaaaaagauaguaaggccaaaaaagauuguauaguauucagaauggacagaagaaacuaucuuugcccauccuacaucuauauggcccaaaacuaagaaucacguggauuggcgauauuaaauaagcgaaagcaggaugaauaaaaaaauucugugaaauacaggucucacaaaucuccaaugcagauccuguggguaagagacaagagccaacuauuucagggugaaaaagaucaguuagaaaccuauuaauauauaaaaguuaaaggaauuacaguaugaaaaauguaaagaaugacuggcagucccacugccuucacgaaugacuaugccaaaaagggaaaagaguuuaacuugaaaauaaauuauacuaaauguucaaggacuaacauuuaauaagggagaagagugauaugguagggaaagcuuugugccaacuuucaacugcagcuguagugaaauacacuaaaagccuugucuuaagacaaaagcaguaaaauaaaaacaaugguuuuaaacauauccccagugucaacugcucaugaccauaaauuugccuuuuucuaaugaacaacuaaugggauaaaaggccauauaagggaaaaaguagucgaaaauacaaucgaacaaacuucucacacaagacuaaaccauaaaaccuguuuacaaauuuucauacaugucagaauuaaagguaaaaacacucaaagcuuaagaaaucuaacaucacaaagcacgagauuaaaucauucuuuuaaacaaggacugaaguucagaagcauuuaauuuaaaucaguguauuaacacaaggaauccuuccauacuuccuauuucagagaggguucuccacacuccuuucccagacuuaugcacaaauauuacaacuugcaacccauuauuuucucucauguacaaguuuuguuuuguuuuguuuuguuugcucuuguuuuuaacuuuauuggagugagauuauucuaacuaguacccauuuauuuauuuuaaauaucgguuguaccaaacaaugacacuuuuuggaaaucaaacuuuauuccacuaacauuagccagcagauuuugcuaaacaauguuuugucagaaaaggcaucauggccgggcgcaguggcucacgccuguaaucccagcacuuugggaggcagaggcggguugaucacagggucuggaguucgagaccggccuggccaauauggugaaaccccaucucuacuaaaaauacaaaaauuagcugggcgugguggcgugcgccuguagucccagcagcuugggaggcugaggcaggagaauagcuugaaucugggaggcggagguugcagugaggcgagaucgcgccacugcacuccagccagggugacagagcgagacuccgucucaaaaaaaaaaaagaaagguaucacauacauucaauuuuguacaacuaauuuuuccaguaugcauaaaaauuuauauuugacaacagagaauaugcuucaucauaaacacagcaauaucuuuuccacuuuguuacuaauaaguugcauguuuucuuaguaauuuuaaauaccuccaucugaaaaguauaggguaggcugaccacaaaagaugaagccuaacaguugguagggguaccgcacuuacauaauauucuaaaaacgugcuuuuccuagguacucagugacuauauacaguagugaauauuaaacauuccuguaucaaucccauuuccuacaaaguugaccuaauuucaagcauaaaacugagguuuccaccuuuagaaggguagaaaacaagaguuaaguaauuggguaguccuaaaaauacacaucacaacuacaugacuaagauacucauuuaaaacuugugccaagauaaccccucccuuccaaacuaaaauugacucacuggccuauuuuacuuaauuuugaaaauaaaaaaauaaaacuaaauggauuccuaagcacucauuuccucucucugcccccaucauuuaaaauauucagacuuucaaucugugauuccucccugcaaaaacacucaaguaaaaacaaaacaaaacaaacacucauuaucuccaaguuaacuaccuuggaguuaaaaaaaaaucauuagauucuggaaugauaaccacuguucuaagaccauauaaaacaacagaaacaaugucuguggucgcuaaggaaccauacaucccacccagagaaacgaucucgccucagaugauacuugucaucugugagaccaccccuuuagcuagaguuaaccacuugagcagguuucaauuuugucucugaaaguaggaagcuaucagucucccuacaugacucguuccacccuuuguggauacuucuaccuguagaaaaaaagguuggcaaacuugguggcauggugaggacaaagggcauuuugaaagaaccagugacugagguaagcagagaaugugaacggaaagaggguuaaaguucccccaaauggauaaugacaagacgacgcgggcacccuuuuuuuuuuuuuuuuuuuuuuuaccaccccuagggucccauucuucaccaccacccauuggaaugcaaaguuggcacuaccacuacccaagaugcccaacaaauccucaaaaugucagggcacucggcagcuucugaaaugacaagcuggugccccucccccaccccacccccacccccaccccccaaaaaagaaaaguccaauccagucggugcaggucacccugcccucuggggcaguuccagccugcgcagggagggguuccgaccggagaacgaaaaagcacagauagaccaccgcucuuuccacccacccucagcgggggaaacaaaggcggccuccuccgcccguagacacuacccuaaccagagaggcucuccgauuucccggugcagccugcccucccgcccccgcccgagcccccgcccccaugacaaagaaaaggcacucggcgagcaaggccuuccugccuccagggaugggggagggggcugcacgggugagaagcccccuccacucgcccgugcucauacuccuggucccaggaacugcagaaagcggcggggagccggaggccucggccgcggaagcaggguccgggaggagggugaggguaccuugaaguagccgccuucguagaggguguugggggguccgaagauggccaccucccaguuguagaggucggacucguccaccagggugauccggaagcccuccaccgguuccuccugcagggauuucagcucgagcaucagggccuucugcgagcuggucaucugcugcugggccaucgcggcggcggcggcggcggcggcgccgggcccgggccccaguccucacgcaccggccgggccggaccaggccccuccccuccgcucgcccuccggccgggcagcaccgggccccggucuucacacacccggcgggccagaccaggccccacacggcccgugggcccgcccgggguccuccucacacacgacgcaggccgggccgggcccuucuccucacacucgggccgggcgagaggagaggucgagggaguuaggagaauucgcuacgggucccggucccgggccucccccccccggagggggccucaacuuggggggggggagaggagguggaagcggaggaaggcggcggagggccggcgauggugaagggagggggccgggccggcccgggaacgccgcgcucgcucgcccucucguucucuucgggggccgcaggggccggagggcgcgcggggcaggagaggguggggggagagcggcgugcgggggucucgcggcgguggcggcgggggcugcgcggggggaggggcgacggcggaggaggaggagagcgagagcgccucgcgcc

SEQ ID NO: 191363 - RNA, 127257 nt, Homo sapiens
gugacgcgaggucacgugacggguugggcagccugugccgccgccgccgcuuuguaagaggcacauuggcagguaacgagcggcggcggcggcagcgggucuuggguccuccgagagcagcagcgguaauugccauccucucccucuccuucccucuuccagggcccugagcgcugcagcgugugcuuucuaauucuggguucagcucgucugaaaccccaccgccugcagacugccccggcgcccacccgugaggaccgggccgagcuucacucgccagguccacggucccucuacguccaggcccgggcucccuccuuccucuuccccucacguugcccugugcuucuuccuacuuucccccguccaggucggcugggccccacccagccccaggggugccuccccuccccccuuucggguuucugcccuggagggugugguuuucucucccaccucggugccugccaguagacuggagcuuccccgccacgcugucggucccaucucaucaccuuuccgcuuucacgcccguagcuagucuugggacuggcccuguuauagccccaacuuaugcgcucucuaaccuuuccuggcuuacccggagucacaguucaguucuacuucuuuucaauucuguagggcauuggucucaauugggacucaguuuuccuccacacccgccguuccuguagucugguuauaucacaguucauuauuuaauguagguuuuugagcgcuuuguaaacggcaaagcucucucuguuaauaauacauacucaaaauguuauucuuucauuggugcauuacaacucaguuguuugccucugaaucacuuucccacucggcuuuuccacauuuuccccugaguuuuuagucuaauuaguugcccacgcaucucaacugucaccacucuggucucuaaugcuugcucgcuuuagggguugaucccaucauuauuacuguuauuuccuguuugauguaauccagucauuuacuaccacuucuauuggauauuguuuuuaccucacauucaaggaagguauaugguuugccaguauuuaggcuuauugucuuucuacagcaccaguguauccuaacaguugagagauuuuaaaaaauuacuauuaauuuuagagauauggucuccauauguugcccaggcuggccuccagcuccuggguuuaagcgauucuuucaccucagccuccugaguaucugggauuacagugugcaccacggugcucagcuaguugaggguuuuuucaggucuccauaagguauccaaagauuaucuuuuauuugaagggcauauaauuucuugggugaacccaguucuuauauuccucuuccguugugacagcacuuuuuucaacaagggguaugcgacuaguuauugcauuccucacuuuucacugugaauuguguauccguuuuagugccaguuugugaaagguggaaggaaguugaacaugauaccuaagcucucccguauccuacauugguguguuccccuuuuaccucaggaaagggaauguauuccacucccuggagaugauaguuuccuucaauacacucaccuguggagccccuucgcuaggguuguccuuccauugcuuugaaggcuucucuuaucauuaggcagaagugauuaguuucccaaacugcccuuuugcuugcugccagcauacuccugauuuuccuacuuauggcuaguugauacgugugacgagagauuuucccacagcgcugauuucccccauuugcuucccuguugccucucacccucaauaauuaugaaaccuuucagagaaggaagguuuuuguugugauugaaauaugcccgaaagugguggcaugggagagaaugaggccaugggaaaggguugugguaauugccucucuugccuguuuccugcugcucugguuuccucuguccucccuuuaaaugugggcuggaucagcaguagucacauggaguugccuuuagaacuauauuggaacaacaauaacaccucugcuucccuuuccugguuacuagugcagucuauguagugaucaccaggagugucucucuuaguauuagccugagugacuuuuauuguauggggagaaauggugugauggugugagaacauguagacuaauagguuuauuucaauauguacuuguauugugaugggaacuggucccgguaucuacccucuuaaguauaaaauauguguagaaaguacaaaccuuucuugaagguuuggaguggucugaagugaagccuucuuuuuuuuuuuuuuuuuuuuuuuuuuuuugagauggagucuuguucugucgcccaggcuggagugcaguggccugaucucggcucacugcaagcuccgccucccggguucacgccauucuccuggcucagccucccgaguagcuggcacuacaggcacccaccaccacgcccggcuaauuuuuuguauuuuucaguagagaugggguuucacuguguuagccgggauggucuugaucuccugaccccgugauccgccugccucccaaagugcugggauugcaggcgugagccaccccgcccggcaugaagccuuuacuucuaaaauguuagcuuugaauuguugauuucccaguccucuuuuuuuuuuuuuuaaaugaugauuuauuguuaagauuuccuuuguuaauaagacacuuugugggguuggggggugggggugguuaaguauauuagcaaggguuaaugccugcucuaaagaagcagucugcaggcauuuacagauuguaaaguucucugcccuuaagcacaucugucuuuauuuuuccuugugagaaaccuguaugucagcaaauacccguucauucuuaguuguuauuuugaguaaauggagcucuuaguuguuauuuugaguaaauggagcguucuuaaaagcuaaguguuaugguacccaugguguugacugguaaguuaguagaucucugauagauuuuagaagcagccguuuuuuccaaagaguggagauacaaccugaaggaaggcaaagagagggaggacauguagggaauaucaccauguaaucuuugugguagauuuugaaguaauuuugccccaacuaucaaguauuuaggaauaggauccuuuuuuuacuaacucaaagaaucaaauuuaucagauuaguuuuuacaauuuuaauguaaaccacuuaugcugauauuuccugcugaguuuacuugacauuuuuuaaguuucucaaagaugcuccuuaaaaauuuucuuuugugacugggcacuguggcucaugucuguaaucccagcacuuugggaggcggaggcgggcgggucacgaggucgggaguucgagacuaaccuaaccaacauggugaaaccccgucucuacuaaaaauacaaaaaugagccuggugugguggcgcgugccuguagucccagcugcuccagaggcugaggcgguagaauugcuugaaccugggagguggagguugcugugagccaugugccauuggacuucauccagccuggauggagcaagacuccgucucaaaaaaaaauuuuuuuuuuaauuuuuauuuuuuucuacccuuuuuuuuuuuugaagacagucucacuguugcccaaauuggagugcaguggugcaaucucggcucacuucaagcuccgccuucuggguucaugccauuuuccugccucagccucccgaguaccugggacuacuggcgccugccgccacgcccggcuaauuuuuuguauuuuuauuagagacgggguuucacaguguuagccagauggucuugaucuccuaaccucgugauccgcccgccucggccucccaaagugcugggauuacaggggugagccacggcgcccagccuuuuuuuacccguuuguaaacaauguuugauaaguuuccauuuuuugauaacuaauuuucaugcuggacauagcauaauugaauuggaauccaguuaacuauuuggauuugaaguaugaaauagggcucacauuaaggaguagaguagguguuuuauuuaagacuagguaauacucuucauuuauuuauuuauuuauuuacagauggagucucgcucugucacccagguuggagugcagugguacgaucuucgcccacugcaaccucugcccaccggguucaagugaugcuccugccucagccuccugaguagcugggguuacaggcgccugccaacacacuuggcuaauuuuuguaauuuuaguagagaugggauuucaccauguuggccauauuggucuuggaacuccugaccucaggugauccaccugccuuggccucccaaagugcugggauuacuugcgugagccaccacaccuggcuucuucuuuuauuuuuauuuucuugagacagucuuucucugucgcccaggcuggagugcuguggugccuuggcucacuguaaccucugccucccuggcuuaagugauucuugugccucaacuucccaagcagcugggacuacaggcaugcaucaccacgcccagcuaauuuuuuuuuuuuuucgagacagagucuugcucucuugcccaggcuggagugcaguggcgcuaucucggcucacugcaaacuccgccucccagguucacgccauucuccugccucagccucccgaguagcugggacuacaggcgugugcugucaagccuggcuaauuuuuuguauuuuuaguagagacaagguuucaccguguuagccaggauggucuugaucuccugaccucgugugugaucugcccgccucggccucccaaagugcugggauuacaggcgugagucaccgcgcccggcuaauuuuuuuuuuuuuuuuuuuuuuugagguggaguuucauucugucacccaggccagagugcaguggugugaucucuguucacugcaaucuccgccuacuggguucaagcgauuagccugccaccgugcucugauaauuuucguauuuuuuguagagacaggauuuugucauuuuggccaugcugguuuugaacuccugaccucaggugauccaccugcuucggccucccaaagugcugagauuacaguuguggaccacugugccuggccuuuuuuuucccccugaaacauggaguauauguuuaaaaaaaaaaaaaguuggagccuggcuccauggcuccugcguguaauuccaacgcuuugggaggcugagguggaaggauuucuugagcaggaguucgagaccagcgugggcaauauagugagacccugucucuauaaaaaaaauguaaaaauuaacugggcaugauugcauguacccagagucccaucuacuugugaggcugaggugggaggauugcuugaggccacagugagcuaugauugugccauugcacuccagcuugggugacagagugagacccuaucuccauaaauaauaggaucauacuuugcauacuugcugauuuuuauugaaaaauacagcauaguuugggugugguggcucaugccuguaaucccagcacuuugggaggccgaggcaggugaaucacuugagcccaggaguuggagagcagcuuagacaacguggcaaaacccugucuuuacuaaaaauacaaaaauuagcugggcauggugugcuuguagucccagcuacucaggaggcugagguuggaggauugcuuaagccugggugguugagacugcagugggcugugauugugccacugcacuucagccugggugacagacccugucucagaagaaaaacccaaaaaacagcauacauaccguagaugauauaugaggcauaaaaacauguagaguugucauuguauaacguagaaggugguuggggguaaacacauauguagaguuguuuuuuuuggagacagggucuugcuuugucgcccaggauggagugucuuggcaugaucauggcucacugcagccucuaucucccaggauuaaggcauccucccaccucagccuccugaguagcuuggaccacagggaugcaucaccaugcucagcuaauuuuucuuuuuguagagaggagucuugcuauguugcccaggcuggucucuuaggcuaaagugauccuccugccuuggccuacuaaagugcugagauuacaggugugagcuuaaugccuggccccauauguaaaauuaaaaaaaaaaaguaaaaugaacaaccaagaaauaggacauuacugcuaccuggaagucuccuguguaugccagcucccaaggcauuucuuuucgcuuuccuugagguaaccauuacccuacauuauagguuuacuauuccuuuguguuguuguuuuaaaauagagacaaggucuagcuauguugcccaggguggucuugaacuccuggacucaagugauccuccugcuuggccucccagaguccugggauuauagguaugagucacucugcagguucuacuguuccuuuuuuuuuuuuuuuuuuugagacggagucuugcacuaucgccugggcugaaguguaguggcccgaucucagcucacugcaaccuccaccucccaaguucaagcgaaucuccagccuccaucucccgaguagcucggauuauaggugcccgccaccacgccuggcuaauuuuuuguauuuuugguagagaugggguuucacuguguuggccaggcuggucucaaacuccugaccucaugauccgcccaccugagcucccaaagugcugggauuacaggcaugagccaccaccccagccuacuguuacuuuuuuacaauaauuuuaccuuauauguauauccguaagcaacauaugguuuaauagugcccauuuucagucuuauucucaauguaagaauuguaugauucuucugaugcuugauucuuucacucuuacaugcuugagauuuauccauguugauuucuuuuuuuugagauagggucucagucuguugcucaggcuggagugcaguggcucgauccuggcucacugcaacauucaccucccggguucaagcgauucuccuuccucagccucccaaauagcugggacuacaggugcccgccaccaugccuggcuaauuuuuguauuuuuugguagagacgggguuuccuuguguuagccaggcuggucucgaacuccugaccucaggugaucugccugcuucggccucccaaaguucugguauuacaggcaugagccacugcacccagcccccauguagauuucuuuuuucuuuguuuuguuuuauaagacggagucuugcucuuuugcccaggcuggaaugccaguggcacgaucucggcuucucagcucacugcagccucugccuccuugguucaagcaauucuccugccucggccucccgaguagcugggauuacagacaccugccaccaugcucagcuaauuuuuguauucuuaguagagacgggguuucaccauguuggccaggcuggucauggacucuuguuuguuuuuuuuuuuuuuuuugagauggaguuugcucuuguugcccaggcuagagugcaauggugcgaucuuggcucacugcaaccucugccuccuggguucaagcaauucuccugccucagccucccaaguagcugggauuacaggcaggcaccaccaugccuggcuaauuuuuuuuuuuuuuuuugcauuuuuaguagagcuguggguucacuauguugggcaggcuggucucgaacuccugaccuccagcgaucugcccaccucggccucccaaagugccgggauuacagguguuagccaucgugcccggcccguugauuucuuauaguaguaugagguuacauuguaaggaugugccauauguugucuauuucauuguugauggauauuugucucauuuccaguuuuuugagauuaccaauuuuacuuguccucauguggacauuugccacccugcccacaacaaacaaaguccauuuucucaagacuacauaacugagaguggaauuuuugguuuguauguaggguauguguaacuuuuacuaaguaaugcuaaaguguuuuccacauguugcacaguuguucucaggcuugucagcugaaccacagaacacagaaaguugaguuacuauuuucucaaaucugucaaggaugguacauaaugaauuucauucuaggugucuggaaaaaguucagcuuauacacagaguggaugcccuaagaauugggaauucauucucaaagacugagugguuuaagaguucuacauccuugccaacauuuuauguugccuuuuuaguuuuagccaauuguagugggauguucuagauauaucuuucaugaacgccacauagcuggauuuugcuuuguuaaguuagcaacuugcuaacuucuuuuuaauuaauuagaguguaucgcuauguuggcugggcuggucgugaacuccugggcucaagugaucuucccaccucacccgcacaaagugcugggauuguaggagugagccaucagcuaaccucuuuaacuagagcauggagaccauucauaucuguuguaauuacagauauuuuggauauaugucugccauuauauuuagucuucuaguuggcuggccuguguguuuguuuucugucccuuuuuuuuuuuuuuuuuuuuuuuugagacagagucucauucugucacccaggcuggagugcaauggcgugggcucggcucacugcaaccuccgccucccgaguuuaagggauucuucugccccagccucccuaguagcugggacuacaggcacgugccaccacaccuggcuaauuuuuuuuuuuuuuugagacggagucuagcccuugucgcccaggcuagugugcaauggcgugaucuuggcucaacgcaaccuccgccuccuggguucaagugauucuccugccucagccucccaaguagcugggauuacaggcaugugccaccaugcccccggcuaauuuuguacuuuuaguagagucgggguuucuccauguucaucaggcuggucuugaacucccgaccucaggugaucgcccgccucggccucccaaagugcugggauuacagacgugagccaccgugugcggcuuguauuuuuuuuuuuuuuuuuuuuuuuuuaguauuuauugaucauucuuggguguuucucgcagagggggauuuggcagggucauaggacaauaguggagggaaggucagcagauaaacaagugaacaagggucucugguuuuccuaggcagaggucccugcggccuucugcaguguuugugucccuggguacuugagauuagggaguggugaugacucuuaacugccuucaagcaucuguuuaacaaagcacaucuugcaccgcccuuuauccauuuaacccugaguggacacagcacauguuucagagagcacgggguuggggguaagguuauagauuaacagcaucccaaggcagaagaauuuuucuuaguacagaacaaaauggagucuccuaugucuacuucuuucuacacaaacacagcaacaaucugauuucucuaucuuuuccccacauuucccccuuuucuauucgacaaaaccgccaucgucaucauggcccguucucaaugagcaguuggguacaccucccagaugagguggcggccgggcagaggggcuccucacuucccagaagggguggccgggcagaggcgccccccccaccucucggacggggcggcggccaggcggaggcgccccccaacuccccaacggggcggcuggccgggcgggggcugccccccaccucccucccggaaggggcggcuggcugggcggaggcugccccccaccucccagacgggccggcugccgggcggagacgcuccucacuucccagacgggguggcugccgggcggaggggcuccucacuucccagacggggcggcugcugggcggaggggcuccucacuucucagacgggucggccgggcagagacgcuccucaacucccagacggggucgcggucgggcagaggcgcuccucacaucccagaugggguggcggggcagaggcgcuccccacaucccagacgggguggcggggcagaggcgcuccccacaucucagacgaugggcggccgggcagagacgcuccucacuuccuagacgggauggcggccaggaagaggcgcuccucacuucccagucugggcagcagggcagaggggcuccucacaucccagacgaugggcggccaggcagagaugcuccucacuucccagacgggguggcggccgggcagaggcuacaaucucggcacuuugggaggccaaggcaggcgggugggagguggagguuguagugagccgagaucacgccacugcacuccagccugggcaacauugagcacugaguuaaugagacacugucugcaaucccggcaccucaggaggccuaggcuggcagaucacucgcgguuagcagcuggagaccagcccggccaacacagcgaaaccccgucuccaccaaaaaaauacgaaaaccagucagguguggcggcgcgcgccugcaaucgcaggcacuuggcaggccgaggcaggagaaucaggcagggagguugcagugagccgagauggcggcaguacaguccagcuuuggcuuggcaucagagggagaccguggggagaggggaggcuuguauuuuuaauagagacagaguuucacuguguuggccaggcuggucuugaacuccugaccucaugaucuucccaccucagccucucaaagugcugggauuacaggcaggagccaccgcgcccgaccuuuuuuuuuuuuuuuuuuuuuuuuucccaggcuggagugcaguggugcaauccuagcucauugcagccuugaacuccccgugcucagaugauccaccuuagccucuuggguaccugggacuacagauuugugccaccgugccuagcuaauuuuuuuuuuuuuuuuuuuuuuguagagacaggguuucaucauauugcacaggcuggucuucaacuucuggguucaagugcucaccucagccucccaaaguguugggauuauaggcgugagcagcugcuguaggcccacaaaauguauuuuuauagccucuuucccauccagucgggguuucuguauuuacauauugucacugaaguauuuuuauagccucuuuucccauccagucaggguuuguguauuuacauauugugacugaaguacacuacugaaugauaauccuuuucucagaugauuauuuucucaauuauuuaucagauauaauugccagucaggucaucugauaagcaagaaauaacuacugcuguuacuuaguucagguaauuuucaucaaugcuaaguaaauugcuaauuuauuguaggauaaaauguaacuuuuuggggcuuuuggaaagucuaaaaauauguauuccaugacugcuaugccaacccuaaguuuugaaacacugaugaaaguuuccuuugauuugugggagugaggcaacaauuacauuaguaaaaacuuaagguaguauaugggcugggcgcaguggcucucuccuguaaucccagcucuuugggagaccaaggcaaguggaucacuugaggucagguguuugagaccagccuggccaacauggugaaacccuaccucuaccaaaaaauacaaaaauuagcugugugugggcugggcgcgguggcucacgccuguaaucccagcacuuuggggggccgaggcgggcggaucacgaggucaggagaucgagaccauccuggcuaaaacggugaaaccccgucucuauuaaaaauacaaaaaauuagccaggcaugguggcacgccucuguaaucucagcuaauccggaggccgaggcaggagaaucgcuugaucccagaagucggagguugcagcgagccgagauugugccacugcacuccagcccgggugauagagcgagacucucucaaaaaaaaaaaaaaaaaaaaaaaaaauagcugggugugguggcacaugccuauagucccaccuacuugggaggcugaggcgggagaauugcuggaacccuggaggggaggcagaggucagugagguaccugagaucgcaccacugugcuccagccugggcagacagaaugagaccuugucucaaaaaaaaaaaaaaaaaaaagagaaaaacuuaagguaguauauucucuguuauuucugugaaugcuaaguuuacauuacugcagauuaggccugaaugaugguucucccugcgcaaaugguauaugcuacucuauagguguucacuugaacgaauauuuauugcugccaguugucaacaauguuagaugcuagaauacagaugaauaauguagguuccugaucuucaguugcuuacauguuggugagcagacacacacaguuuaaauguguguauaggauuccaggguacugcugccugugacagagaaaagcauuguugaauugagcuugaguauuuggcaaggauuccuugagcuggggaggcugagccuuaguuuucuuagauucuuccuauagaaucaaguaucaaggcugggcacgguggcucacgccuguaaucccagcacuuugggaggccgagacgggcagaucaccugaggucgggaguuugagaccauccugaccaacauggagaaaccccaucucuauuaaauuauaaaaaauuauccgggcauggcggugggugccuguaaccccagcuacuugggaggcugaggaggaggagaaucguuugaaccugggaggcggagguugcagugagccaagaucaugccauuguacuccagccugggcaacaagagugaaacuccgucucaaaaaaaaaaaaagaaaaaaguaucaaauuccugaaguuacaauuaaauuguuaaaacacuuuaaauguuguauucagaguuuaguuuuauuagaauuugcuguuauuuugcuuuguucuauuuuguuugagacagggucuuacucugucacucaggaaugcagugaugcgaucaggcucacugcagccuuaaccuaccugggcucaagcgauuucccccacucaaaaaaaaaaagagagaaugugcaguauguccuugaguaaacaugccuguggaacgugaaggcaaaaaggcagggacgauuuaggagaauaccaaggcugguuugaccaaguguagggauuggaaggaauaaacaguuugcauuuuauugaggaguugaugguuugugaacagaaguugacaguuuuuguugauaguguuuguuuguuucuuucuuuauuuuugagauggagucucgcuuuauaucccagguuggaguacaguagcacgaucucgacucacugcaacuucugccucccagguucaagugauucuugugccucagccuccucugaguaguuggaauuacaggcacgugccaccacaaaccuggcuaaucuuuauauauauauauuuuuuuuuuuuuuuagauggagucucgcucugucacccagacuggagugcaguggcgcgaucucggcucacugcaaccuccaccucccagguucaagcuguucucccaccucagccucccaaguagcugggauuacaggcacccgccaucaugcccggcuaauuuuuguacuuuuguagagaugggguuccaccauguuggccaggcuggucuugaacuccugaccucaggugauccgcccgccucggccucccaaagugcugggauuacaggcgugagccaccgcgccuagccguaugaaauguuuugaaugacagagacagaugaaagaaugagaacagaagaaagauuugacaauuaggagaccaguggugaccuagggaguagcauuuuuccuacuguuagagugauagggugauggaaaccagaauacagaagguuaaggagauguuuagugaggaaauggaggcagugaauguauucauuuugugaaauacaguuuauguaguuguugcuuacaagauagaacaugaaguuucaggagugcuuggaagguaauuuuucugagccuuuguuuuugagaguaauccggauguagagaacaguugagcgauucguuuuuuuuuuguuuguuuguuuguuuugagauugagucucgcuguuucccaggcuggagugcaguggcgugaucuugacucacugcaaccuccgccucccagguugaagcaauucuccucccucagccucuccaguagcugggacuauaggcucaugccacuacaccuggcuaauuuuuguauuuuuaguagaaacaggguuucaccauguuagccaggauggucuugaucuccugaccuccugauccgcccgccugugccucccaaagugcugggauuacaggcgugagccacugugcccagccaguugagugguucuuuagacauauaaggaugugggguauuucucauuaguguaguguuuucuuuauuaaggaauuuuguauuuggauuaaaacuggaccagauacuuauguggcagguguguuaauguuuaaauggauggcaugacuuuguuuugauagauacauucuuuagguaacagacauuuuuaagaaaguugcuuuuggcaugagugauuaaguaauaaggaugucaguaaaauaaaagcaauauacuuuuacuaaaaaaagaaaaaccaggacuugauauccuggauucaugaggaaaguugaagaacuauaaugaaaaacuucugaaguauuaaaucaguauuuauauuuuaggcuuguaauaaaaccuagagaugauguaacugucucaaaaugacuuaauagguauguugaacuuuuauaaaucacuugugaaauaaauugugaauuugugacauuugagugccaaauguugaaaugguuccugcagagaugugaauaaugagaacuauuauuuuaggucaucuggucuucauuaagaauugauuugaagccgggcguggugggucaugccuuuaauccuaggacuuugggaggcugaggcagguggaucaccugaggucaggaguucaagaacagcuuggccaacaugacgaaaccccgucucuacuaaaaaugcaaaaauuagccaggcaugguggugggugccuguaaucccagcuacuugggaggcugagacaggagaauugcuugaaccugggaggcagagguugcagugagcugagaucaugccauugcacuccagccugggcaacagagugaaacucuguuuaaaaaaaaaaaaaaagaauugauuugaugcuugacuguagucgcagcugcuugggagguugaggugggagaaucucuugagcgcaggaggcagagguugcagggaaccgagauugcaccacugcgcuucagccugggcgaaagagucagacccugucucaggagaaaaaaaaaaaguauacaauuaaguuauugacuauaguuacccuauugugcuaucaaauagugggucuuauuauuuuuguacucaauaaccaucccuaccucccccaagucccccacuacccuuccuagccucugauacuccauccuucuacugucugugauuaugaguucaauuguuuugauuuuuaguucccacaacuaagugagaacaugugauguuugucuuucuguuucuggguuauuucacuuaacauaaugaucuccgguucuauccacguuguuucaaaugacaggaucucauucuuuuuuauggcuaaguaguacucuguuguguauaaguaccauguuuuaucuauucaccuguugauagacacuuagguuacuuccaaaucuuagcuauuguaaacagugcugcaacaaacaggaaugcagauauuucuucaauauacugauuucccuuauuuuggguauauacccagcagugagauugcuggaucauaugguagcucaauuuuuaguuuuuuccagaaccuccaaauuguuuuccauaguaguuguacuguguguugaguacugucaugguuuuucuguucuugaaaauaagaagcaagaguuaaacauuguggcuuagaguaucaagaagcaaagauguugauuuuuuuuuuuuuuuuuuugaagacagggucuugcucuguugcccaggccagaguacaguggcggcucacugcaaccucugccuccuagguucaagugauucucgugccccagccucuggacuagcugagauuacaggugcgugcaaccacgcccagcuaauuuuuguauuguuuguaaagauaggguuuugacauguuggccaggcugaucucaaacuccggaccucaagugauccgccugccucggccucccaaagugcuggaauuacaggcaugagccaccacacccagccuaagaaacaaagauucuuaaucucugugacugguuguggucaucaugacuguaguagaagaaaaauuguuuuauugaacuuguaucccuaagaaagcugagguagguuagccuauauuuugauaucuuccuuccuucugacuggccaaagggggaaggugguuuuccuccuuuauccccuuuccugugaagccuugggacagaguaacuagugggaaguuaaucuuacuuugguggaugcagagcuggagacucagggcagagggagugugaguguauaaagacagaaauaugccugagucuuuaucacagaccaagguuauugugcuguugguauuaaaucuaugaguuaauuuguucuuacuuucauccuuucaagagaggauagauggggauuccugcagcugaacaugguuggcgagagagccguguuuagcuacguuuagggauagaauuugacauggaugaggauguuaaguuggcaacuuauuagcacuuuuuaaauuuuuuggugcuauagggucaugcuauguugcccaggcugaucauagcucacuguagccucgaaauccugggaucaagcaauccucccgccucagccucccaaggaggugggaccacaggcaugcgccaccauaccuggcuaauuuuuaaauguauuuuuuaguagagaugaggaggucuugcuauguuacccaggcuggucucaaacuccugggcucaagaaguccucccuccuuggcuucccaagguguugagauuacgggcaugaaccaccacaccuggccuauuagcacuuuuuguuaauacauaggaaauagauccucuuuuuuucuuucuuuuuuuuuuuuuugguuugggacagggucuugcuguguugcccaggccagagugcaguggugugaucucagcucagugaagccucagccucauacauucaaaaauuagccgggcauggugguacauaccugugaucccagcuacugggaggcucaggcaggauaaucgcuugaauuuacuuaggaaagcaaguuaaggccgggcgugguggcucaugccuguaaucccagcacuuugggaggccgaggcggguggaucaccugaggucaggaguuugagaccagccuggccaacaugucgaaaccugucucuacuaaaaauacaaaaauuagccaggugugguggugggcaucuguaaucccagcuacucaggaggccaaggcaggagaauagcuugaaccugggaguagagguugcaguaagccaagauuacagacacaugccaccacgccuggcuaaauuuguauuuucaguagagacgggguuuugccauguuggccaagcuggccuuuuuuuuuuuuuuuugagacugaguuuugcucuuguagcacaggcuggagugcaguagugcgaucucaacucacugcaaccuccgcuuccuggguucaagcgauuccucugccucagccucccgaguaguaggauuacagguccgugccaccaugcccggcuaaguuuuguauguuuaguagagagaggguuuuaccauuuggccaggcuggucucaaacuccugacucccaccuugccaggcuagucuugaaacccugaccucaggugauccgccugccuuggccucccaaaaugcugggauuauaggcaggagcuacagugccuagcccuuauuuuauuuuuauuuuuaguuuaauuuuuuugagaugagucuugcucugucgcccagguuggagugcaguggugcgaucuuggcucacugcaagcuccgccuccuggguucaugccauucuccugccucagccuucuggguuguugggacuacaggcgccugccacuaugcccagcuaauuuuuuaaaaauacuuuuaguagagacgggguuucaccauguuagucaggauggucucgaucaccugaccuugugauccaugcgcccgggccucccaaagugcugggauuacaggcgugagccaccgugccuggccccuuauuuuauuuuugaaacagggucucacucaucucuugggcacuguacuaggagugcacuggcgugaucacggcauacugcagccuugaccucccaggcucaagugauccucccauuucagccuucugaguagcugggaccacaggugugcucugucauaccgggccaguuuuuuuguuuguuuguuuguuuuugagauggaaucuggcucugucgcccaggcuggagugcaguggcgcgaucucggcucacugcaaccuccgccuuccggguucacgccauucuccugccucagccucccaaguagcugggacuacaggugcccgccaccacgccuggcuaauuuuguuuuuguauuuuuaguagagaugggguaucaccguguuagccaggguggucucgaucuccugaccccgugaucugcccgccucagccucccaaagugcugggauuacaggcgugagccaccgcgcccggcucaccuggcugauuuuuaaacuuuuuuauagagacggguucucucuauguugcccaggcuggucuugaacuccuggccccacacugcucuccugccacagccucucaaaguguugggauuacaggcgugagccaccgugccuggccuauguauguauuucuuucuuuuuuuuuuuuucgagauggagucuugcucugucacccaggcuggagugcaguggcgcaaucucagcucacugcaaccucugccucucggguucaagcaguucucuugccucagccucccgaguagcugggauuacaggugcccccaccacagcggccuaauuuuuguauuuuuaguagagauggguuuucaccauguuggccaggcugaucucgaacuccugaucucaugauccaccugccuuggccucccaaagugcuggguuuacaggugugagccaccgugccuggccgcauuucuuccuucuucuucuuuuuauuuuuuuaaauagagacaaggucuugcuaugcugcccaggcuggucucgaacuccugagcccaagugguccucccaccauggccucccaaaguauugggauuacaggugugaaccacugggccuggccuauguauacauuuucuuuuuuuuuuuugagaaguuuugcucuuguuguccaggcuggagugccguggcauaaucuuggcucauugcaaccuccgccuccuggguucaagcaauucuccugccucagccucccgaguagcugggauuauagguacccgccaccacauccagcuaauuuuuuauauuuuuaguagagacaagguuucaccauguuggccaggcuggucucaaacucuugaccuucuggugauccacccuccucagccucccaaagugcuggauuacaggucugagccacuacgccuggcccuauguacacauuuuuaggugaacguguuuucaguucucuugggugcauacccaggaguaggauugcuuggucuuuaucauaacuguuuaauuucuuuaggaacuguuaagaguuuuuuuuauuuuuuaggagauguggucuuacucuauugcccagucuggagugcggugacaugaucauagcacacugcagccuugaucuccuaagcucaaggauuccuaccaccucaaccuccugaaugggugggauuccaggugugcgccaccaagcguggcuaauuaaaaaaaaauuuauuguauagacgaggacuugccacgccgcccagguuugcucaccuccugcugugcggcccaguuccuaauuaccccagucugcagccugggaguuggggauuggggaucccugcuuuauaguauaggcuuuuuugcuuuuuuuuuuccuuuuuguaggagagagagaacuguuauaaguaguggugaagacugguuaugaauaauuacaugcuuuucaagagauuccagggugaagaguccugguuaccugcugggcaaaagacaagguuuaaggcuggucgcaguggcucgugucuguaaucccagcacuuuaagagccugagguaggcggaucacuuaaggucaggaguuugagaccagccuggccaacauggugaaccccaucucuaccaaaaauacaaaaaauuagccgggcgugguggcgggugccuguaaucccagcuacuugggaggcugaggcaggcuaaucgcuugaacccaagaggcagagguugcagugagccaguguugcgccacugcacuccagccugggugacaacagugaaacuccaucucaaaauaaauaaauaaauaaauaaauaaauaaauaagacaggguuuacagcugaauuagcaggauaggaauaggacagaugugugcaaacagcuaugggcaauuaauucccuucguggccuuagguaaccugaaagagaauugugacgauaucaaauaaauuuugauguccuauaguguuugaguucaccagcacucauccuuuccaugggcagguuauauccauggaacagcagauaacuuugugauucuucugucagcgaaguguggguguaggggaguucaaccuuguccaucagcugcuagaggccugacccugcccuuaacagcugcagagaauaaaaguaucagcuuguucagcuccuggcaugcaggguacaagcaguugagcugcauggaauuggaucucauaguugaguuucuuggcacccuagauaccuuguucucuccucgauuacggguguagacuuuguguugguggcuguucugggccuccuaauuuaguugagauucuuuucuuuucuuuuuuuuuuuuuugagauggagucucgcucugucgcccagccuggagugcaguggugcaaucucggcucacugcaagcucuugccucccagguucacaccauucuccugccucagucuccugaguagcuggggcuacagguacccgccaccacccccggcuaauuuuuuuuuuguauuuuuaguagagaugggguuucgccguguuagccaggauggucucgaucucuugaccucaugacucgccugccuuggccucccagagugcugggauuacaggcgugagccaccgugccuggccuauuuuuuucuuuuuuaaauaauagaaauggggucucacuguguugcccaggcugguuuuaaacuccugggcucaggcgauccucccccucuuggccucccagacuguuggaguuacaggcaugagccacuaugccaggccagauucuuuuguuuauuuuuuaauaaauaaauucaaguggauucuccugccucagccucccgauuugcugggauuacaggcaugcgccaccacaccuggcuuauuuuuuguauuuuuaguaggguaggguuucacuauguuggccaggcucaucucaaacuccugaccucaaguaauccucccgccucagccucccaaagugccgggauuacaggugugagccaccguaccuggccuuggccucagauucuuaaucugagcuuugucuucugcagguaugaauaaaugaauuuccucugcagagaagguugagaauauugacuguuuucuuaguagaaaaugcgggaacacagauuagaaauuaaacaaaaauaauaguaguggucacagaaauauaccaguauagaacauauggguaucugaaaggcugagaagcuaggugagaucugaucuagaccagaucuuugucaucaggcacaagcuuugcaggugaugccaacaauaguuaugcuguuguauagaagaagaagcugaauugggaacuauuauuuaucugugacugaacaguuagccuuacaacauagcauaauaguuaagugcacacacuguagagccaaauguccuggguuugaauacugccuucaccacuuacuagcugugauucucuguguaucuuaguuuccucucuguaaaaugggaguaaaguaauguguacucuagaguguuggaaagauuagugacuuaauacuguacauauaaagugcuuagaauggugucuggcacauagugaaugguaugugcuuucugcuaguauugucauuaccauugguuuuagauuuugggaaugaguggacauauauagaugaaggaccugagacccauccuugccaguuugagauagacccugcaccacuggucucaugacucagugaacagcaucucuggacauucuugaugaagacuugcuucuuuaacauaaauuguguauccuguuuuuaguaguugaacccuuagcccauuauguaauucaugucaucugaauuauauuugguuugaaaaaaacauuaguuuuucuguuccugaaacguaaauuuauuugauguaguagcugagauacuuugcacaagugugucaacauccugguuuuagaacuaucuuccaaucaaugcuuugugaugcugucuuaaauacaugcaguguaaguauguaguuugggauuuaauuaacuguucaaacuuuuauuaaaugucuguugaaaucuucccucuucucaguauguugucagcaaguguucuguaacuuuucagaaugauaaaauguguccuugcuuuucguuuaggguauauacaugguuuuuagaaaaguuuuuacccgaccguguuuuuuguaugccuuaaaguuagaugaauuugugcuuauguaagcuuuaacagaaauguuggugguuguuaagucaaccauuuucaguuaagucuaaacugagaucacuugaaaaugcggcuguuucacugagguaucuuaucuucagaaagguccuugaaaaaaacagcaguuaaaccgggcaugguagcucaggccuguaauccuaguucuuugggaggccaaggugggaggaucaccugagcccaggaguuugagaccagccuaggcaaauaugggaagaucguaugucuaugaaaaagaaaacaaaaacggaaacaaaacuuuuuaggcaguuaaaacuuuuuuccaaaacuauuccuuucauagagaauaucuuuguaguuuuaucagguugguuuauucggccggagacuuucuuuccucauuacauuuagacaauuuuuucacuuuaaucguuaauaggaagcuuuauauuauauuuugcugauuuuguuucuaaagaaguuaaaaauguagcagcaguucuuuaccuguguuaaaaucuaucacaucuuuaauucacuuugaggugagauaaauacggguuucaaaauuugguuggauagauugaaguaagccuggugcuuccugccccucaagaacuugagauagguauguuugaguuucuacuggauuauuuuuagaaucuuuugcucuugucuguuucuauucugagaauucucuuggaaccuguuccaguguaguagaacucuugggaguggaaagugauagaugauggaacacaaguguacacugaauuccuauggucuggcaacuggguacuuguuguagaagcauuccuauuuacuacacacagcuccauuucccagaaaaggaggacauagaaguuccuccuaacaguauguuaguugaagguguugauuuuuacggucuaguuuccaugucucagucauuuuuacaguucaguggugguaacaauuuuuaagggucuugaagaauauuuugguaacuuacgcuuuuaccuugauuuaauggauucacaauuaucagaaguuuuuuuuuuuuggggagacagagucuuguucugucgccccgauuggaguguaguggcaugaucucgguucacugcaaccuccgccucucggguucaagugauucuccugccuuagccucccaaauagcugggauuacaggcucacgccaccacacccagcuaauuuuuguaguuuuaguagagacaggguuucgccauguuugccaggcuggucuggaacuccugaccgcaagugauccacccgccucagccucccaaagugcugagaugacaggcauuagccaccgcgccuggcuuuaucagaaguuuuauguaaaauuaauacgggaaaauuugucuguugaaucaugcauccuguuaaaguuauuuucugacccguuuuuccagaagauuucagucacaucccccauccccugugauuguugugcgaaaccuguuucaucucuggaaauuuuuuugcuggacaucuuuaauauuaagacuuuuuaugaauagggaauuagguauuauaacauuucagugauaguguggagaggcacaacugacagaagacaaguuaaucugaauuuauuuaagcaugcauucuuggauguccugaggcccuuacaauuauuuuuauuuuucaaagaauguauuugcuauuuuuuuuuuuuuugagacagaguuuugcuguuguuucccaggcuggagugcaauggcgcaauuuuggcucaccgcaaccucuuccucccggguucaagcgauucuccugccucagccuccugaguagcugggauuaugggcaugugcccccacgcccggcuaauuuuguauuuuuaguagagauggucgggcuggucuugaacucccgaccucaggugauccagccggcucggccucccaaaaugcugggauuacaggcgugugccaccgcgcccauccuuguauuugcuauuuuuauuuuuauuuuuuuuugagacagagucuugcucugucacccggacuggagugcaauggcgccaucucggcucccugcagacuccgccucccagguucaagcgauucuccugcgucagccuccuggguagcugggacuacaggugcgugccaccaugcccggcuaauuuuuuguauuuuuaguagagaugggguuucaccuuauuagccaggauggccucgaucuccugaccucgugauccgccugccuuggccuccaaagugcugggauuacaggcgugagcuacugcacccggccuguauuugcuauuuuuaagcuagaagucuuuguaguaacaauuuaugaauauauaacccagagcaguaaaccuuaauuaagagaaaaacuuuuuccaaacaauaaaguaagccauguaguuuuuauguuucacaaagcaacuauucugguuuagccaugcaaccgggucauuauuuauaggcuaauuacguauucauuguggaauauuaagaauugaugauuggaaggagauauagucuuaauguugauacugugaacauggaccaguaaaauuuuaauaguuugcguuauaacaaagaguuaugguuuucuuccuugacaagugaggauucauguacauuauaucaaaauguuugguuauaguagugaggcuauaaagauuaagucauuuuucuguaaaucaaaaaauuaauguacauugaauauggguuaaguauauuucuucuguacaugcagauuuuuaucaccagauggcacuccuguauggagaaagucucauuuuguuauuucaccuagauuauuuucuuucuuuuuuuuuuuuuuugagacagucuugcucuguuucccuggaguggaguggugcgaucucagcucacugcaaccucugccuccuggguucaagcgauucuucugccucagccucccgaguagcugggacuacaggcgcgugccaccaugccuggcuaauuuuuuguauuuuugguagagacaggguuucacuguauuagccaggauggucaccaucuccugaccucgugauccgccugccucggccucccaaagugcugggauuacaggcgugagccacugcacccagccgauuauuuucauaaauggggucacugagaauaaacagugagaaaaagaucagauaauccaaucaacagaacuggaaaucuaugaguaaacuacucacuucuuaaaaagguuuugugguaggaauacuacucaacaaguuagcuuuugauuagaugcuuaauucuguuuuauucuuuucuuaaaauguauuuauuuaaggagauagguggcugggcaugauggcucacaccuguaaucccagcacuuuggaggcugaggcugguggaucacuugaggucaggaguucaagaccagccuggccaacauggugaaaccccaucucuacuaaaaauacaaaaaaaaucggcugggcacgguggcacauaccuauagucccagcuacuugggaggcugaggugggagaaucacuugaaccuggaaggcagaaguugcugggccgagaucgugccacugcacuccagccugggcaacaaagccagacugugucuuaaaaaaaaaaaaaaaaaaaaaaggggucuugcuguguugccuagccuggauuugaacuguggguuaagugaucuuccugccucagccuccugaauagcugggacuuacaggugcaugccaccuugcccagcuuggaugcuucacuuuagauacuuaagauggaauugcagaguauuagugcugaaggugauuuuuuuauuuuuauuuuuuuagauggugucucgcucuuguugcccagguuggagugcaguggugcaaucucagcucacugcaaccuccuccuccuggcuucaagcgauucuccugccucagccuccuaaguaguugggauuacagaggugcgccaccaugcccggcuaauuuuugaauuuuuaauacagguaggguuucaccacguuggccaggcuggucuugaacuccugucaucaggugaucugucugccuuggcuucccaaaguguugggauuacaggugugagccacggugccuggccugaaggugauuuuaaaaauaauccaauggggccgggcacaguggcucaugucuguaauugcagcacuuugggagguugaggcgguuggaucacccgaggucuggaguucgaaaccagccugaccaacaaguugagaccccaucucuacuaaaaauacaaaaauuagucgggcgugguggcaggcgucuguagucccagcugcuugggaggcugagacaggagaaucgccugaacccgggagacggagguugcagugagcugagaucacaucacugcacuccagccugggugauggagcgagccuccgucucaaaaaaaaaaaaaaaaaaaucaaauggauucuuucucaaauacagauaugccuuacauuuguuuaaaugcaucacaguuuuaaaacaguguguucguaugcauuuauucauaucugagagaaugcuuuaaaaauaaauggaaucauggcaaaacaauuaaccuuguucucuauaauacaaccaaaaugauaaacccaaaccaacaaaauuauaaaguuguuaaacugaaaaaggaugcaaaauguguauucauacugacuggagaggcagauucaaaugcaguaaaaaguuuuaaaccaguguauugaggcugugagaaauucuagauaauugguuguuacuauaauguaaaaggcaguacaauaauaugucuguggccuuuagcaagccaguuaaugaagcuguugaaaaaauaaguuaauauuagugcagcuaacacagaaaaaugcuugucagaccuuuucuggcuaaaauagguuucagggacacaauuuucuuugguaccugaauuaguaugaugaauuaugguuagucuccucuauuuuauuuuaugauacacagaucaaaaauauguagaaauguuguaaugucauuuuauuaaucugaaauguauaagauuuacaaauaguggaauaucuuuccacaucaugggaaugcuugcuuuugggugucuaaaacugaccguucuagaaaacagaauuccggccggguccuguaaucccaccacuuugggaggccgaggcggguggaucacgaggucaggagaucgcgaccauccuggcuaacacggugaaaccccgucucuacuaaaaaaauacaaaaaaauuagcugggcuugguggcgggugccuguagucccagcuacucaggaggcugaggcaggagaauggcgugaacccaggaagcagagcuugcggugagcagagaucaagccacugcacuccagcuugggugacugagccagacucugucucaaaaaaaaaaaaaggaaacagaguuccauguauuguuaaaaucguuggcucugggccggcucaguggcacacgccuguaaucucagcacuuugggaggccaaggcugguggaucaccugaggccacgaguuugagaccagccugaccaacauggccaaaccccaucucuacuaaaaauaccaaaaauuagccgggcaugguggcgcgugccucuggucccaguuauucgggaggcugagacaggaggauugcuugaacccagaagguggagguugcagugagccgagaucgcacuauucguugcacuccagccugggugauggagugagacucugucuuaaaaaaaaaaaaaucauuggcucugcauuguuaucauuggagaugauagcucuauguguuauugcgcugaagaccuuccagugggacagauguggagauggaagacgguaguauugaugauccugacccuguguaggccuagacuaauguguguguuuaucucuuaguuuuuuuuuuuuuuuuuuuuuaauaauggagucucccucugucacccaagcuggagugcagugggcucacugcaaccuccgccucccagguucaagcaauuauccugcuucagccucccuaguagcugggauuacaggcgucugccaccaugccuggcuaauuuuuguauuuuuaguagagaugggguuucaccauguuggucaggcuggucucgaacuccugaccucgugaucugccugccucagccucccaaaguguuaggauuacagauaugagccaccgcgaccggcugcacauuuguuuuuguuuuguuuguucuaggagcuucguaagaguggaauuguuugcauaaacaguuuguuucugauugauggguauauuuccucuguggagaauuccauuuuggaaauuuaacuuuuaaggcauugcuacauguuuuucugugcguguguguguguguguguguguguguguguguguguaguaaaauguacauaacauaaaguuuauuguaaccauuguuacauauacaguucucugacauuaaguacauuuacauugucgugcaaccaccacugccguccaucuuccgaaccuuuguauccuccccuacagaaacuccauaccugugauacaguaacuccccauucuuccccuacccccagccucugguaacuaccauucuacuuguuucuaugaauuugacuuuucuaaguaacuuguauaaguagagucauguaguauuuguccguuuuuuuuuaccccuugccccgagaguuuugcucugucgcccaggcuggagugcaguggcacuaccuuggcucacugcaaccuccgccucuuggguucaagcaauucuccugcuucagcuuccugaguugcugggauuacaggugugugccaccaugccuggcuaauuuuuguauuuuuaguagagacgggguuucaccauguuggccaggcuggucuugaacuccugaccuuguaaucaaucuaccugccuccucuucccaaaguacugggauuacaggugugagccacugcacccuagccuuauuuguccuuuuuugacuggcuuauuucacuuagcauaaugucuuugaggugcauccaugugguagcauguguuagaauaucuucccuucuuaaggcugaauaauuuuccauuguguauauaugucacauuuugcuuauccauucaucuauugauggacacuuggguaucuuccacuuuuuggcuauuaugaauaauggugcuuuuuaauuaauuaauuuauuuuuuauuuuuaaaauuuauuuauuuauuuugagacggagucuugcucuguugcccaggcuggagcgcaguggcacgaucucagcucacugcaagcuccaccucccggguucacgccauucuccugccucagccuccugaguagcugggacuacagucgcccgccacuacgccuggcuaauuuuuuguauuuuuaguagagacgggguuucaccguguuagccaggauggucucgaucuccugaccuugugguccucccgccuuggccucccaaagugcugggauuacaggcgugagugaccgugcccggccaauaauggcacucuuaacauggaaguacaagcaucucuuugagacucugcuuugagauuuguuuuuggugccuacccagaauuggaauugcuggaucauaugguaauuuaguuuuugauuuuuuuuuuuuaaggaaccaccauucuuuuaaugaugguuguaccacuuuaaauucccaucagcagugcacaaggguucuaguuuuuguacauccucaccgaugcuuucuguguuuuuaaaauuaaacaaaaaaacaauuauaguguuacagcucuuuuagaauuugucuagcagguuuucuggucuuuaucggaaaauucccggcucuucugucuaaaaaaaaaaaaaaaaauuguaaucgcuaucccuaaaggguaggaaguaggaaucuuaugguuauaauuuuuuuuuuuuuuuaaauugagguggaguuguucuuacaguguugucuaggcuggucucaaacucuugggcucaagcagucuucccaucuuagccucaaaauagcugggauugcaggugcaugccaccgugcccagcuuagaaucauguuuugaugacauacuuaauuaugugcuugacacuuaguagcuagucaauaaauguuuguucaacaaaucaaagaaaauuauaugcacaauuuuuuuuuuuuuuugagacggagucucgcucugucgccaaggcuggaguacagugacgcgaucucggcugacugcaaccucugccucccggguucacgccauucuccugccuuggccuccuaaguagcugggacuacagaugccugccaccaugcccggcuaacuuuuuuguauuuuuaguagagacgggguuucauuguguuagccagcauggucucgaucuccugaccucaugaucugccugccucggccucgugaauugcugggauuacaggcgugagccaccgcacccggccacacaauuguuucuuuaagauuuauuauuuacagcugacuuuugcuuuuaggcauagccuguuucuugacacauuuuaaauugggcuauuggcagguaaaaucuuggcugggugcaauguuguuuugggguucaaauagcaacugcaaguaguaagaggcagauagcacuucauguacagugacuacauguagugauaaaaugguugcugguuaaaauuggugguacuugagauuuuuguuuagaauugcuaagcucguaaaccauagacuuagauugcaguagucgaauugguuuaacagauaccagcaaaauguaaaauccucaagggcuacuucuugagaauuuguauuccagagagcuuuuaucuuuuauuguaaguguccuuguuuucucugaaguacaugcuuaucuuuuacuaugauuguuuugcuuaccaucccuacuuucuugcagauuuucuauuuuguacauacauuauuuuguauauacuguauaugaugacuucagugagcagugaccauugucgaggugcucgggaaaaaccacagauuucagcagcacaaucaacgcaaccacagaaacaagugguacagguaaguuuuuguggaacucuuuuuuuuuuuuuccuuuuuuuucuuuuauuauuauacuugaaguuuuaggguauguggaacucuuguuugccuuguuuagaauuaaggaaauuaagggagagcauaugauuuaauguuuuccuuuguaggaaacuuuaggauuuuggacccuuuguuuaaacaguaggugauggccgggugcgguggcucacgccuguaaucccagcacuuugggaggccgagguggguggaucacuugaggucaggaguuugagacuagccuggccaacauugugaaacccugccucuauuaagaaaauacaaaaauuagcugggcgugguggugugcgccuguaauccuagcuucucgggaggcuaaggcaggagaaucgcuugaacucaggaggcagagguugcagugagcccagaucacgccacugcccuccagccugggugacaaagcgagacuccuuccuaaaaaaaaaaauaaaauaaauaaaaaauaaaaaguagguaaugaagaauaguaaggaaagagguauuguacuugauucagguacaauuggauguuguuccaugagaacucuuuaaugcuaaccuuuuccagguaccucuuagcuauuaggcugccacugccaccaccaccaccaccaccaccaccaccaccaccaccaccaccgccgcugccgccgcugcugccuccuccucuuccuccuccuccucuuccuccuucucuuccuccucuuccuccucuuccuccuccuccucuuccuccuucucuuccuccucuuccuccuccuccucuuccuccccuuccucuuccuccuccucuuccuccuauuccuccucuuccuucuauuccuccucuuccuccuccuccuccuccucuccccuuucaccuugcucugcuucccuuccuccuccuucccugcugcuucaucaucaucuccucucccuuuucucccuucuauuaauuuaaguguguccuuggaaugaaauaugaaaauccaagguagauggagaacuaauagucugaaguaguaaaauaccugaauuacaauagacuuuaaaaagcugccuuugcugggcauaguggcucaugucuguaaucucaacacuuugggaggcugaggcaaaaggguugcuugagcccaggaauuaagagcaggcugggcaacauagugaggaccuugucucuacaaaaaguuuaaaaaguagcugggcaugauggcuuccauuuguagucccagguacuugggcggcugaggugggaggaucacuuaugaugaugcuacugcacuccagccugggugacagagugagaccuuggcucaacaaaaaagcaaaaaccugccuuuucuucaaagcacaaggaagagugcuugaaucuuagaauggcuuuuaaugaucaagauccacuugaggccgggcgcaguggcucaugccuguaauuccagcacuuugggaggccgagguggacagaucaccugagaucaggaguucgagaccaggcuggccaacauggugaaacccugucucuacuaaaaaaaaaaaauacgaaaauuagccaggcaugguagugggugccuguaauggcaguuagucgggaggcugaggcagggagaauugcuugaacccgggaggcagagguugcagugagccaagaucacaccacugcauucaagccugggcaacagagcgagacucugucucaauaaaacaaagacccauuugaauaaaauuuuuaauguuaaauacucccuccuccucaauuugguuauauuauuauuuuaagugaagugagauaagugcuaagcacaguaccuggugcaaaauuaagcauuauauacauguuauugacuagauuggcaaacccuuuuucauaggcaauaugcaaguaaguaaacuauauccaguuugucuuacuugcagauugauuugacuauacuuugauaguuaauuaaaagugcuucuuaaaaucacucauuuauacccaagugcccuguugauguuaggggacauagugaggagauuuaaguguugcguuacauuuuucaguauaaaguuaguguaguauucugcugguauuaacagacagauaucucugcuacucagugcuugauccuaaauacacuuacucugauaggaauuuauucacaaacugaucuaguccagugauggaaaaauuuggagguuuuaggcuagguccuccuuuuauaguugaauuuacuuaggaaaaaguuugcuuaaugaauggucuuuuuuuuuuuuuuuuugagacggagucugucgcaguggccagucucggcucacuccaaccuccacuucccggguucaagugauucucuugccucagccuuccaaguagcugggacuacaggcaggcaacaucaugccugccuaauuuuuuuuuguuucuucgagauggagucuccuucugucgcccaggcuggagugcaauggugccaucucaguucacagcaaccuccgccuccuggguucaagcgauucuccugccucagccucucaaguagcugggauuacaggugccugccuccaccuccaguuaauuuuuguauuuuuaguagagacaggguuucaccauguugcccagccuggucuccaacaccugagcccaagugacugcccccuuagccuucaaaggugcugugauuauaggcgugagccaccgcaccugaccuuuuuuuuuuuuuuuuuuuuuuuugagacagucucgcucuguagcccagucuagagugcaguuacucuaucuuggcucauuguaaccuccgccucugggguucaggcgauucuccugucuuauccuccccagcagcugggauuacaggcgugagccaccaugcccggcuaacuuuuuugcauuuuuaguagagaugaaguuucaccauguuggccaggcuggucucaaacuccugaccucaagugaucugucccccccuugaucucccaagguguugggauuacaggugugagccacugcaccuggcccuuuuaaauuuuuuucuuuuaaacacuaguaugcauuaggaaaauuauugauguuuauuuauucauuaauccuauucugggaaguauuugcuaagaaaguaaucuuaaauuggugucauaaaaaguggcuuuauuuggcaauuuuuuucuuucuuuuuuuuuuugagauggagccucgcucugucgcccaggcuggagugcaguggcgcguucucagcucauugcaaccucugccuccuggguccaagcgauucuccugccucagccucuggaguagcugggauugcaggcauguaucaccaugccuggcuaauuuuuguauuuuugguagagacgggguuucgccguguuggccaggcugguuucaaacuucugaccucaggugauccgcccaccuuggccucccagagugcugggauuaaaggcaugaguuaccacgcccugccgguaagauguuaauuacucaauuuuaaauguccaguguuauguuagagguguucugagauaaccuauucagguugcaugaugaaagagaguuuuuuauuuuuugagacggaguuuugcucuuguuguccaggcuggagugcaauggugcgaugucagcucacugcaaccucugccuccaccucgccuggcuaauuuuuuguauguuugguagagacgggguuucaccauguuggucaggcuggucuugaauuccugacuucaggugauccacccagcuccgccucccaaagugcugggauuacaggcgugagccacugcagcagguggugagaguucuuuugaauccguauaaaccaggauuuuuguccugggucuagcacuuaguaauuagaugaguuacuuaaaucuccuuuaaccucuuuuuuuuuuuuuuuuuuuuuugagcuagagucucacucuguugcccaggcugcagugcaguggcuugaucucggcuaacggcaacugugccuccuggguucaagugauucuccugccucagccuccagaguagcugggacuacacuuguacaucaccacacccggcuaauuuuaguaguuuuaguagagagggguuucaccauguuggccagguuagucaguuuugaauuccugaccucaggugaucugcccaccucagcuucccaaacugcccggauuauaggugugagccccugggccugaccgugaaccucaauuuaaaaaaaaaaaaaauacauugugagauuuacggaaaaguugcaaugggaauaugaauaauuacugaauacccuuuuuucagauuccccagauuuuaacauuucugucacaucuacuuuauccuguucucuuccuuucccuacaguuuauucccagaaacguuugacaaguaguugugaauaagguucuucuucacuuaauaccucaguguuuuuuaaaaaacaaggaucuuuuuacauaauuacaguacaauuauaaaaaaucagaacaucuacagaccauacuuauauuuuuucaaugguccucauaaugccuuuuuuuuuuuuugagacaguuuuacuuugaugcccaggcuguagugcaguggugcgaucucagcucacugcaaccuccgccuccuggguucaagugauucuccugccucagccucccgaguagcugggauuauaggcaugcgccaccaugccuggcaaauuuuuauauuuucaguagaaacgagguuucgccauguuggccaggcugcucucgaacuccugaccuuaggugauccgccugccuugaccucccaaagugcugggauuacaagcaugagccacugggcccagcuguaauguccuuuuuagcuaauuagauuguggaauauacauuguauucagaugucaacucucuugugaauuuaugugaaaauuccacaaaauuaugugaacauuccacaauuaugaagugauuauaagaauauuugaaaauuaugauauaaaaugucuuagaaaagguauacuuccugaucaacugaaaaaaauauguaaaguuaaugcaaaacuguugaacauuaaugaguacaggcuuaguagacuguuaauguuuaucuuugguggugggcauaaauaauccuacuuuauuauuauuuccaauuuuuuucugggugacagcucuaauuaaaaaaaauuuggauucauuugaaaaauuucacauuuuccacugugaaagcagcuuaguucguaauaagccauaugaauggguaagagauccagaggaagagcuguagugaugguacuuuucuuggcaagauauuuuucaacuugagaugugaccuaguguaugucacuaauguuuauugcaggggagggugcacugaccuuguuuaacuuaagaauuaccaguugauccugauuuuuccucuuuuuucccaagcuguaccgaccucuugacacuuccuagagcucagccugguaacuucccuauuauacucuuauguuuggugcuuuguuuaucaaauauuuauugaauuguuuaucaaagaaaauuauuuuuuucuugacucaggguauuuuauaaaguuaaaaaaaauacuuaaaguucucauuaaaauuuauuuucauaaauaugcuagcacuaguguuacuauauuguuauuguuaaaugacuauuauguguauuggcuaugcuuucagaaguagucugucuaucccuuuuaugaauaaaaaagauauuacugaagagaaauacaguauuugugucauauaauacuuaagcugaaaaagcuaagucugaauaaaucagucauuggcauuuaccuuacauauggcaaugaauagugacuuuauaguuagaaauguaugggugaaacaguaucagaaugauaauguagaaacauauauaagccccagacugcccccuacagcaaaaugcgauuauuaauaacuauucugcuugaaauauuuggugagauucuuucacccaucaagugcuuguuuguuaauauuuuaaucgggucgguguuucuuugguuuuguaaauugugcacguuuacaaagcacuggcuguucucaggcaguuuucaaguuuaaauauucuugccuuuagggucauuauuuguuccugguucccccacucugccauuacuuuuucauacuuuuuccacaaagauuucagccauacucccugacuuugguuuaucuucuacucugacauaucugcaugaaguaguuucugucugaaaugucuugaaaccagggauguucuuauaauaauacuuacugugcagugaguggauagccacaaguaauccauaauuuuacuuuuuaaaaaaaaauguuuguuguagcuccuguuuaacacaucuaccaccccaagccgccgccuguacuccuuuucugucugccaaaaucccuccccacaaugcuuuauuaugaaaauggucacagaugaagaaaaguugagaguuguacagucaauauccauauguucuauuaccuuuuugcucuauuuguuuuaucacaucuguuuagccagccauuauuuuaucuaaguuuuuaaugcuuuucaaagugaauuaaaugauuaaugguacucuuaaucacuucagaauggaugucauugacuaggguguauuauuuguuuauugucuuuuuuuuuuuuuuuuuuuuuuaugaggcagaguuucugcccuuguugccuaggcuggagugcaguggcgcgaucugggcucacugcaaccuccaucucccagguucaagugauuuucccaccucagccuccugaguagcugggauuacaggcaccugccaucaugacuggcuaauuuuucuauuuuuaguugagacgggguuucaccauguuggccaggauggucucaaacuccugaccucaggugaucugcccgccuugaccucccaaagugcugggauuacaggugugagccacugugccuggcuguuuuuuuuuuuuuuuuuuaauagacaggaccucgggcugggcgugguggcucaugccuguaaucccagcacuuugggaggccaaggcagguagaucaccugaggucaggaguuugagaccagccugaccaagauggagaaacuccgucucuacuaaacauacagaauuagccaagcaugguggcacaugccuguaaucccagcuacuugggaggcugaagcaggagaaucucuugaacccaggaggcggaaguugcgaugagcagagaucccaccauuguacuccagccugcacaacaagagcgaaacucugucucaaaaaaaaaaaaaaaaaaggaaauauaagucauuuauuuuucauuuguuacauggaauauuuacauagauuguuuccugcugggcaugguggcuuacuccaguagucccagcagaggugggaggauugcuugaguccaggaguucgagaccagccugaguaacguagugagaccugucucuacaaaaauuacaaacuucuuauacuguaugguaggauaagugcuugaaucuauuggcuuaccaauuaauaaaaaaacauuuugaaccgggacaugguggcuaacaccuguaaucucaacacuuugggaggcugaggugggaggauuguuugagcucuggaguucaagaccauccugggccaaguagcgagacccugucuccauaaaaaauauuuuuuaaaaaauuuauaagaaaaaaaccuuuuuggccaggugugguggcuugcgucuguaaucccagcacuuugggaggcugagacggguggaucaccugaggccagggguucgagaccagccuggccaacauuacaaaaccccaucucuacuaaaaauagaaaaauuagcuggccgugguggugugcaccuguaaucccagcuacuugaagggugaggcacaagaaucacuugaacccaggaggcagagguugcagugagccgagacugugccacugugcuccagugugggcgacagagcaagauucugucucaaaaaaaaaacaaaacaaaacaccaaauuuuuagggaaaaauuauuuuggaauaauuuuaagaguuguaaaaaaguugcaaagaacgauagagauagagauauauucaccccgcuauccuaaauguuaacuuuuuuuuuuuuuuuuuuuuuuuuuugagacagucucgcugugucgccaggcuggagugcaguggcgugaccuuggcucacugcaaccucugccuuguggguucaagccauucuccugccucagccuccaaaguaguugggacuacaggcgcacaccacugugcucagcuaauuuuuguuuuuucaguagagacgggguuucaccauguuggccaggauggucucgauuucuugaccuugugauccgccugccucagccuaccaaagugcugggauuacaggcaggagccacugugccuggucagcuuuuuacauaaaggauugccuaaccuuuucuguaaaguguuaguauauaucuuacgcuuugcaguccagacacaaucucuguugcauuuugauuuuauuacauuuuugagacggggucucauguuggccaggcuggucuggaacuccugaccucaggugauccgucugccucagccucccaaagugcugagauuacaggccugagcuacugcacccagcugaugacagaguuuuugacuucuuuuguguuaugucuuauugcuuccacacaccauccugguucaaagggaaccagaaggugguagaauuagauuaucccaaaauuacucauuuucugugucccacuuuuuuuuuuuuuuuuuugagacggaguuucgcucuuguugcccacgcugcagugcaauggcgcgaucuuagcucaccgcaaccuucgccucuuggguucaagcaguuuuccugucucagccucccaaguaacugggauuacaggcaugcgccaccaugcccggcccggcuaauuuuguauuuguauguguauuuuuguuuuuugagacgagucucacucugucgccaugcuggagugcaguggcgcgaucucggcucacuacaaccuucgccucccagguucaagcgauucuccugccucagccucuggcccucuuuuaaaauaauuggucacuaggacgguucagcauaugcaacucaaugaacaggauacaucucauuaagaaaaacaaggacaggccagugcgguggcuuaugccuguaauugcagcacuuugggaggccgaggcgggcagaucaugaggucaggagauagagaccaucuuggcuaacaaggugaaaccccgacucuauuauaaauggaaaaaaaaauuagccgggagugguggcgggugccuguagucccagcuacucgggaggcugaggcaggagaauggcgugaaucggggaggcagagcuugcagugagccgagaucacuccacugcacuccagccugggcaacagagcgagacucagucucaaaaaaaauaaaaauaaaacauacaaggacaaaaaacauaugaucauuucaauaaacgcugaaaaauguaugugaaaaaauucaacaucccuuugugguaaagauuaucaacaaccugaguguggaaggaacauaccucaaaauaauaaaggcuauuuuuuuuuuuuuuugagacagggucacccaggcuggaauauaaugaugcgaacauggcucacgguagccuugaccccccuaggcucaagagauccuucugccucagccucucggguagcugggacuaauggugugcacuuccauacuuggcuaauguuuuauuuuuugaagagacagcgucucaccaaguuacccacagggcugguuucaaacucuuaggcucaagggauccaccuuccucagccucccaaaguguugggauuacaggcgugagucacugcaccuggccucacuugaguacuagaacuucuagccagagcaaauaggcaagagaaggaaauaaaggggucuagauugcaaaggaagaagucacauuauauucuuauuuauagaugacauguuguauuuagaaaaaccuaaaaacuccaucaaacaucuguuagaacugagaaaugaauucagugaaguugcaggauacaaaaucaacaacaaaaauuagccuuuauauauaucaacagcaaaacaguuguacucugucuacauuguucagguacucauuauauaguauaugcuucuccuuuggccauuuaguaaauaauauguucaguagucacugucaauacuuaagucaguuucucuagucguuuugauugucugaacccauugcuuuuguugauuccucugaaaggaauuaugagaacaauauuccuuguguuuggugguguucacaauuuauaccuuuuauacuugaguagaacaucaguuuuguuggcucuaagugcuaggcccacauuuucuuuacguuaucuuuuuuuuuuugagacaaggucucacuuugucacccagacuggagugcaguggcacggucaugcucacugcucccuucucccuugaccuccuggacucagauaauccuccuaccucagccucuugaguagcugggagcacaggugcaugccaccacacugguuaauuuuuguauuuuuuuguaaaggguuuuguuguguugcacaggcuggucucaaacgccugagcucgagcaaucugccugccucagccuucugaacugcuggaauuacaggugugaacugcuguaccugacuaucuuaaauauuaauuuuuucuugcgcaaagcauugcucuugacaaguuuguugauauucuaauuucauucucuucugugucucuugacauuucugccuaguuguccaguggauguuuguucuuuuagaguccaguucuucuucuuuuuuuuuuuuuuucuuuuugagaugagucucacccugucucccaggcuggagugcaauggugcgaucucggcucacugcaaccucuggccucccggguucaagcgauucuccugcuucggcuuuccaaguagcugggauuacaggugcacgccaccaugcccggcuaauuuuuuuguauuuuuaguagagaugggguuucacugugguggccaggcuggucuugaacuccugaccucaagugaucugcccgccucagccucccaaagugcugggauuauaggcaugagccaccacgccuggccagaguccaguucuuaaacuaaagaauaagaaugucuuaguguggacugauuauuuagggauugauauucucaaggacgguguauuuucauugacauauuuaugcauuuuuugguuuguuuuccagacauuuuucuuaaauuuuaguuuuaaggcucuauacuguauuuuuauucuuuggaggcuuauuguccauagcuuuaaguuggguugucuuuugccuaucuucaguguuugacacuuugcuuucuuuucucccauuccuauuuaucucuucauuucucuuuccuuuuauuuccuuuuuacaggaaaaaaauuuccccaguuuuauucucuguuauucuugagacauuaauuguuaaguuuuauauuccuuguaguuuagacuccauuuucauaugugauaggacuuucuuuaaauuauuauuucuugaauucuguaauuuaaagaagaaauagaaaaacuuagagauauguuauucuuuuaucagauuuuuuuuuuuuuuuuuuuuuuuugagacagggucuugcccuggcuuccaggcuggagugcaauggcaugaucuaggcucacugcacccucugccucccagguucaagcgauucucacaccucagccuuccagguagcugagacuacagguaugcgccaccaugccuggcuaauuuuuuuuuuuuuuuuuuuucuugagacacaguuucacucugcugcccaggcuggaguacaguggugagaucucagcucacugcaaccuccgccucucggguucaaaugauucuugugccucaaccuccugaguaguugggauuucaggcucgugccaccacgcacugcuaauuuuuguauuuuuaguguagacgggguuucaccauguuggccaggcuggucuugaacuccugaccucaagugauccgccugccucagccucccaaagugcugggauuacaggccugagcuaccaugcccgacuguuguuuucaaugggauuuaagaaaaaggugaugcaagaagugucugauuuuuaaauguuuuacagagaugggggucucacuauguugcccaggcuggucuccuccugacucagccucccaaagugcugggauuauaggcgugagucaccgugcccagccuuaaaauuuacuuuuuuuuucccuauuuuuuuuuuuggagacagaaucucgcucuuuugcccaggcuggagugcaguggcgcuaucucggcucacugcaagcuccgccugccagguucacgccauuguccugccucagccucccgaguagcugggacuacaggugcccgccaccacgcucggcuaauuuuuuguauuuuuuuaguagagacgggguuucaccguguuagccaggauggucucgaucuccugaccucgugauccacccgccuuggccucccaaagugcugggauuauaggcgugagccacugcgcccagccuuuuuuuuuccuuuuuuugugaccagguuguucugucacacaggcuggagugcaguggcgccaucuuggcucacugcaaccuugaccuccucgggcuaaggugauccucccaccuuagccucugggguagcugggacuacagcacuuaccaccacacuuggcuaguuuuucuguuuuuuuguagaaaugagguuuugcagucuuaauagugagcuaagaaauaaaaauuacaccaaauauagaccauuuuaaguaauuaaaaaguuuuaaaagcuuuuuuaaaaaguucauuaugcccguuuugggaaagguuuugaggaggcagguucucuuauuuacugcucguugaguauauaucuuuauagccuuugugcagagcauuuuuguggagaugguuuuaaacuccuuuuaacacugguagacauuucuuugacccuauaguuuuacuucuuuguauucauuguuagaaagcuauauuuggggcugggcgugguggcucauaccuguaaucccagcacuuugggaggccgaggugggcggaucaccugaggucaggaguuugagaccagccugaucaacaugaugaaacccugucucuacuaaaaauacaaaaauuagccgggcauuguggcaugugccuguaaucccagcuacucaagaggcugagacacuagaauugcuucaaccugggaaguggagguugcaguagccaagaucgcaccacugcacuccagccugggcaacaagagugaaacucugucucaaaaaaaaacaaaagaaagaaaucuuucuuuggccgugugugguggcucacgccuguaaucccagcacuuugggagggcaaggcaggagggucauuuaaggucaggaguucaagaccagccugaauaacauggugaaaccgcaucuguacuaaaaauaguaaaaauuagcugggugugguggcgaacaccuguaaucucagcuacuggggaggcugaggcuggagaaucgcuugaaccugggaagcggagguugcagagaaucccuugaaccugggaggcggagguugcagugagucgcgaucacgccacugcacuccagccugagcagcagagcaugacugucucaaaaaaaaaaaaaaaagccaucuuugauguauguacagauuuggguauaagaauggaccucagccugccacaguggugcauaccuguaaucccagcacuuuggguggccaaggugggcagaucacucgaggucagacguucaagaccagccugaccaacauggugaaaccccgucucuaccaaaaccaaaaauuagcagggcgugguggcaugccuguagucccaagcaugagaauuguuugaaccuaagaggcggagguugcagcgagccgagagcacacuacugcaaggcaacagagggagacuucgucucaaaaaaagaaaaaaaaaaacaacgaaagaaaagaauggaucucuggcaguguuuuaguaguaauaaaaauuugcagaguaagaaagauauaggccgggcacugugguuuaugccuguaauccuagcgcuuugggaggcugagcagaggaauugcuuaagcucgggggguucaauauuaaucugggcaacauggcggaaccuuguuuguacuaaaaacaaaacauuaaccaggugucguguugugcgccuguauucccagcuauugggggaaauuaugggggguggagugcgugaggugggaggauugcuugagccugggaggcagcuguagugagcacugauugugccauugcacuccagccuagccgacacaaugaaacccuagcuuaaaaaaaagauguuaaggcugggcggguggcucacaccuguaaucccagcacuuugggaggccgaggugggcggaucaugaggucaggaguucgagaccagccugaccaacauugugaaacccguucucuacuaaaaauacaaaaauuagccaggcgugguggcaugcaccuguaauccuagcuauucaggaggcugaggcaagagaaucgcuugaaccugggagauggagguugcagugagccgauaucgcgccaugcacuccagccugggcgacagagcgagacucugucucaaaaaaaaaaaaaaaaaaagcaccuaugcaguggauugucauguagcauuaaacgugauauagauauucauaauaaauugugucugugagugauuccacaugguaguauguuaaguauucuguuuuugauaaaagaggaaaauagccaagugugguggcucaugccuauaauuccagcucuuugggaggcagaaguaggaggauugcuugaguucaggaguuugagaccagcaugggcaacacagugagaccuugucuuuaugaaaauaacaacaacaaauuagccaggcaugguggcugccaugguugcuacucaggaggcugaggucagaggagugcuugagccugggaggucgaggccauggugagcugugauugugccacugcauuccaacacagagugaaacccuguuuuuuuguuuuuuuuuuuuaaugaaaaaauauaaauaccaaauacauaaauaguuuugguguuagauggucacuuuauggauuuuucaauuuuucuuguguuugacuuguaaagcuuauaauuuaagaaacuguaaugaugggaagggaugagcaucaguggugcuuggauuggaacaaggcuaccugaaucugcugguaugguacauuuuuuagguuugaaacacagggagcagaaaauaauaguguuagggaaaacaggcaaacucuucauacaggcuucuugcaacagggacacuaacagucuacuuucauuuugugaaaauugauuauaugaauuggaguuaucuugucauacccaacuaaauuuagagucaguggaccaaggguuacgguaaaaaagugcuuggggcacaaaccgcuugcccagggauuauauugcaggccagcugccacaaugacaugcuguaaccuuaaauccaguuuuaccuacuagcuguugagaugaacucuugugacucuaagucuaguuuuaccaaccguguucacucaccaaucagagcuuaccagcucccaaaagcuuuaguaguuccagugaguuuucuuucaaaacaauaggucacauuucuuuuucuaauaaaacucccaaccuucuuuguguucuuuggacacacuaggaggcuacccuaguauguguauguauguauguccuggauugcaauccuacuuauauauucuuucuaaauaaaaccuuuuuuacuuagagauuuguuucucucuauauuuuugacuuuaacaguucauaacaaguugucauuacuccaaacccaaauguauaauguggaaaugccaucuuuuaaaaacccaucucucccuuugcuuuucccuuuuacuucaucuaguugucaugacaguggugcucuuggcuguggcacugggacuuauugguugguuaugauucaggaaaaugauugucugauuuagggauagugagaguauauguaagguccuuacauuuacagggaacaauugagguaagauuuucaguaaggguagacacugaauuucuguaccaaugucuuuuuggguauaauguagcaguauugcagcaguuaaacugaggucucagcaggcauagguugggaugaacaggccaaagcaccuggaguuuguauaaucacccacccacauggccuggaaaggccuuuugaaaagugcuuuaaaaugcaaaaaaugucaacaacucccacuuaucccacuucagucaagauuauuugaaaugaguguauauaaaaaacucagaauaaaagcuguuuauuaguuccuuauggcuuuucuuccucuaagaucuuuuuguaaacuguuaagcuuuuuaaauauuuguguugggaguuaguauagacuugguuagcgaggcaacuuaaacuauuuuggaguaauuuuagauuuaauagaccguuguacagagaugauacagauuguuccuguauauuccucaccuaauuucccuguuguaauaauuacgguaccuucguuaaaacuaagaaaccagacuggcacauuacaaagucacgccacagaagaauaacuuucuuuagaacuuuucugauuuuuuguugguaaaaacaucagaaaacgaaacuucagucaguaaugugauugaaaaaauauuuugagugacaaaaguaaauaguuuuucugcaaauagccagaugugguggugcgcaccuguaguccaagcuacaugggaggcugaggcggcaggaucucuugaacucaggaguuggaggcugcagugagcuaugauggcaucacuacaccgcagucugaggggacagaaugagacccuaccuuuaaaaaauuaaauaaauacggcugggugcagugacaggcgccuguaaucccagcaacucaggaggcugaggcagaagaauugcuugaaccugggcggcagagguugcagugagccaagaucgugccagugcacuccagccugggcgacagagugagacuccaucucaaaauaaauaaauaaauacuccagccugggcgacagagugugacuccaucucaaaauaacauacauacauacauacauacauacauacauacauacauacauacauacauacguaguaaucccagcuacucuggaggcugaggcaggagcauugguuaagccugggaggcggagguugcacagucaagaucacggcacugcacuccagcuaggguaacagcaugaggcuccaucucaaaaaaagaaaaaaucgugaagaggguaauuuuugccagaugcaguggcucaggccuguaaucccagcacuuugggaggcugaggugggaggaucacuugagcccaggaguucaagaccagccugggcaacauagugaaacccugucucuuagaaaaacaaaauuauuguguauaaaaaagauaauguaacuuuaaaaauauuuuuaauuuagcuaaauacagcuuuuuuucuucagaacugaccagcauaccuuuuuagaccugacaacagagcuuuuuugacacaaaguucuaagccugugucugggcaguuguuugcauuaccuuuuauuuuuucuuuuauuauuuuuugccuaccaacuaccucuaaagauuucauuacuuuuuaagccuuuuuuuuuuuuaaucuuuuuaaaaauuaaauagagacagggucucucuauguugcccaggcuaauuucgaacuccugggcucaagcagugcuucuaccuuggcuucccaaaggcaugagccaccaugccccgccaagauuuuauuauuuuuuguucuucugcuuucucuugagcugauuucccccacucuaccaagggaaagaagauucaaguaagucauuggccaguuaagaugaacaauagcuuuaggucguuuggucaaaggaauggguccuuuauguuacuuaauuugaugcuuauuuuuccuaugggaacagguuauauaugguugagaggccuaaauucacugucuuuuauuuguuguuacuuaguauuucuagugcuugagagccuuaucuguuugacccagauuuuggaaucuaacuuaugcuuuugguguucaaauccuuaacaauuguauguacuuuccaggcaacagcugaacagaugcgucucgcucaagugaucuuugauaagaaugauucagauuuugaagcuaaaguuaagcagguauguuucuggcaaaggauaucaucauuuuuauaaucuauuuugauugugcuuaaaaagauaauuucaguaaagauuuuuguuuuaaaguauuacuucuagcuucuagucucaccugaaaucuguauauuggauuuuggacuugugauuaaaaauaccuuuauuggugggcaagugaaggaauugaauacguucaccugccuuacaauauaaucuuucugaguuacuaguguuuacaugugaacauugaaccagacauuucuguaagcacacugagguuuuccgauaccugugcauagaaaguauaucuaacauuuggcacagucucugggaauuguguuuaauguuagagaugaacugaauuaccuuuaaaaaauuuuuuuuucauagagacguggucucacucuguugcccaggcuggagugcaguggugcugucauaguucacugcagccucaaacuccuaggcucacgcuauccugcugccucggucuccugaguagcuaugacgacagauguucaucaccaugcccagcuaauuuuuaaaauauuuguagagacagaguccugcaguguugccuaggcuagucuugaauuccugggcucaagcaaucugccuuggccucccagagugcugggauuacaggauuacuggccugaauugccauuucaaacaugguugugauuucauacucuuguuggaaaaguauaaaauuaaauuuuaaggcaaugucuucauuuugaacuuuaauaagagguauuuuugauaacuuagucuuaauuucuaacucuucuuugcugacccuuucucaucaagauccuagaaaccaagcuguaaccgcuaccucagugccagauauuccaacucuugguagaugucgucuaauaauuguucuuuggaguaaaggucucacaaugaaaucuuguuuugucucacaagaaaucauagauuucuuucucuggaaugagaucuucauacaguuugagauauacuucuguauauuacauugccuuuuaucugaauaguauagauagaacacuggcccaggaguucagagauuuaaguucuaauuuuaguucugucugucaauaaucugaucacuggggaaauuuugauguugacugugugucuuaaaaauuguauguugcaggcauucacuuaguacagaucauugauaaaaaugagacauuuauuaguagcuauccaaagacugaagcaucagaaagcuauagaguaugcagaacuuuugcugcuugauaaaaugaaaagaugaaagcagggaggccaaaugguauagugcagagagcugugauuaugagaucaggaggccuggguucuagaugggcuuugcuauuaauuaccuuugugaccauagacaaaucacuugauauguugggaucaagcuguuuugaacuucagcuaguacauguuaaaauaguuaaauguaguuaaaaugcaauagauauuaaaucauagauuuauucacugauacuugagaaaccugcauuuugccuagucugugaucguucuagugaugaaaaugcuaaguaacaaguaucucuugcuaaugagaauaaacugaagaguuucuuucaucauuacuucaagcauagcaccauguugaagauccuugagaaaauaugucuaggaguguguuuugugauaguagcagaauuccacuuguaagacuuuagggugucauauaacuuaguauguacauggaaugauguuuuuucuucuuuuuuuugaggggggagacagggucucgcucugucuccugugcuagagugcaguggcacaaucauggcuuauugcaaccuucaccuccagggcugaagcaauccuccuaccacuacgcucgguuaauuuuuuguaaagaugaggucucacuauauuguccagucucgaacuccugggcucaagcaauccucucgucucugccucccaaaguguugauuauaguugugagccacugcggcuggccuuugaaguguucuaauccaaauggugaaagccagcauauggaauauugucccugacaaaaaauuuguauuggauuuuccaugaaugaugaccguguacucauauaguuccaccucauauuuaaguuuaggaauccugugugcuugaauuaaauuugauuauucagauacuugaucuuggguauucugagaauguugguacguaugugugugcugcugauuaaugaucugcuccuuggucaacuuggaggaagauugauuuguaguuagauucuaccaguguuagugaaaagacaugcauggaauggccacaaaaaaauaaguaaacauguccucauuguaaacucaagagucuagaagaggccaucuucauguagaaggauuauguaauucuguauuuguauagaagaaucuuaauaucaagugccaguuuuuuguuugccucuaaccauuuucugauauguucacuagcuuauggaagugacagggaaaaaucaggaugaaugcauaguggcccuacaugauuguaauggagaugugaacaaagcuaucaauauauugcuggaagggaauucagacacaguaaguauuauuaauugauuugcauuguuuacauuugucuccaauuccguagcacauuuucaacuucaccuuguuuggggguagggauggaauggauuauggugccauuccauauuuguuuuaaguuccagaaagaacgauuaccugaaaagacuguuuuuguuauguaugguuucuucaugaagucguagaaucugaugacuugaaagagaacuuggugaucuacuccagccuuacaguuuccaaaaaucucugugccuguguauauuuucaccacccccaccugaaaagcaucucuuggcucuguugcuuauguuucuucaucucaguccucaccucugauuacuucuuacaucucuauuauaacagaaaaccaggauuugcugguauauguauuugcuuauguggaauauuaaguuuucuuuuuuuuuuuuaauauuggguuaaguuuggugagcuugcaggcucaugagcucaggccuuggauuuuaagaaggauacagcuaaagcuacaccaggcacuugucagcccuaaaauuuugcuguguguauauauuuauauuuauauauuauaguuuuuauacauauguauauauuuauuuauaaauauauauuuauuuaauaauuuuaaauuuuaaauaauuuaauuuuaaauuaaauuaaauuauuuaauaauauauuuaauaauauaaauauauuuauauauuuaauaauauaaauauauauauuuaauaauauaaauauauuuauauauuuaauauauauuauauauaauauuuauaauauuuguuuaauaauauauaaauauauauacuuuauauauauauuuauauuuaauauauauauuuauauauuuauuuauuuuuuugagacagccucacucugccacccaggcuggagugcaguagugugaucuugacucacugcaaccuccgucuccuggguucaagugauucuuuugccucagccucccaaguagcuaguacuacaggcaugcgccaccacgaccagcuaauuuuuguauuuuuaguagaggugggguuucgccauguuggccagacuggucucaaacuccugaccucaggugauccacccgucuuggccucccaaaguguugggauuacaagugucagccaccacaccugaccuguguuuauguuucuuaaauugaggaaacuauuuuagaguagauuaaaaaaaaaugacucaccuaaaagaggauacaaagaugaacacaucaauaacuaccuuuccuuggaaaauuuaaaacaaacaaacugaccgugucaguguucagauuuaauugaagucucauuuuagggucaugcugcauuagguacaagaaauacaaaaaugaacucugagaaacugaaagcuaaaaugacuguguuuuuaguugaugugaaacaaagagaaugaauucuuuuaaaguaaaaauuaacuaauguggaaaagauuucacuguuugaguguagcaguaauuguugguaaaauuccauguaagagaacacugguacacaagacaaaccaucaaauuugugauuuuuuuuuuuugggaaaaccauauuauaugauaaauuaaaauuuugaauaguuuuuguuuacugaccugggacuaaguauccuggguuuugcaaaauauggaggaucuguuuaccuuaucgcuaauggguacagcagagaguggcuuucaguuauuuucaaagugaacugaagagccuaaccgcccucuuuguuuagggaaaaaaaaaaaaaagaaaaaaucuuugggaauaaacaaaauaacccaaauuguucacuggagaggaucuuuuuggaucuuuuuaugguagagauaaguccagacacuauuuuuuguugccuuuccuuuagcuccagcagauuuaauuccuuuucucugguaguuuggugaauuuuuaaguuuuaaauguccaguuuucucuuucuguuuugaguuuuaacacccccuccuccuuugggaccgaaccugaaggagcugguucugggcuauguauuagaaaguaagacugacugggcacugcggcucaugccuguaaucccagcacuuuggaaggccuaggugggcagaucacgaggucaggaguuugagaccagccuggucaacauggcgaaaccccaugucuacuaaaaauacaaaaaauuagccaggugugguggugggcgccugcaaucccagcuacucaggcggcugaggcaggagaauugcuugaacccgggaagcagagguuguagugagccgagaucgcggcauugcacuccagcccaggcgacagugcgagacucggucucaaaaaaaaaaaaaaaagaaagcaaagcugaacuuuucaugaagaacaccucuuugguuaccucuugaacgauuuuauagugugggcuauaucugacuucuuguuuucuucaaagauaagaaaauagcaaaugaaguucugaauauaguugugaaagaauacacuuguucagggcugagugggcugugggggacagaaguagagguaaagucuuuguuuuaguuguuugguguuuuggguuuuuuauuaagacagggucucacuccguugcccaggcuagagugcaguggugccaucacgguuuacuacagccucgaccucccgggcuuaugccauccuccagccugccgaguagccgggaccacaggcgcaugccacuacgcuuggcuaaucauuuuuauauuuuguagaguuagggggucucuguguuucuauguugcucaggcuggagucuuugaaacccugguuuguugaggaccacucucugguacaucuugucucucauacuguuugccucaucucuuaccuaguugccaucugcagcaccuauggcuaaacagcuuugauuaucuucccuugacugagauagaguuaauuggaguaggguugacagaauauaaacacugugauguugcuaggagcaagagcaugaaggcaaacgauucuuuuccuauuaucuaaccuuccucugugcugaaacaaaauuauuacuuggaaaagguguuaaguggaaucguccaugauguuuuuaaggauaaauuuauuuuuucuuauguaaguauaucugucacaaaggaagauauugaacauaaguacugaacuuuuuguuucaucauaauguuugguugaugugacaaaauuguuuugaaguaucggucucuugaauuaauguacuuaacucuuuuuaguaaguuguuuguguugguaguuuuuggcaaaggcaaaguggugggagaguaauuuuugaacuagcuggcuucgaagacugcuguucugauuauuaugugguggcugggaggaccucuccucuuagaguuucuucagaccuguucugcaacuagcaaaauaccgauaacagagguugccagaaauucucuuggaaauccuccauaauuacuugguuaacuuuuuaaaguaugcauguguguauacuuugcagacuucagcaaaauacacaguaaucuuuuuagcaguuacuaugguauuguaaagauugcuucuuaaagguucuuuucccuauuugugccccccccccuccgcccgauaaguugucuuuguagagcucauaaaccaagacuuugcuugaggggcaguaggauggggaggguaucuuuuuuuuauuuuuauuuuuuugagaugggagucuugcgcugucacccaggcuggagugcaauggcaugaucucagcucacugcaaccucugccucccagguucaagcaguucuccugccucagccuucugaguagcugggauuacagacaugugccaccacgccuggcuaauuuuuuuuuuuuuuuuuuuuugagauggaguuuugcucuuguugaccaggcuggagaguaauggcgugaucucggcucaccacaaccuccugccucccggguucaagcgauucuuccgccucagccucccgaguagcugggauuacaggaaugcgccaccacgcccggcuaauuuuguauuuuuaguagagaugggguuucuccauguuggucaggcuggucuugaacucccaaccucaggugauccacccgcucagccucccaaaguggugggauuacaggcaugagccacugcacccggcugcuaauuuuuguauguuuaguagagaugggguuucaccauguuggccaggguggucuggaacuccugaccucaugaucugcccaccuugggcucccaaagugcugggauuacaggugugagccaccgugccuggccaggguaucauuugcuauaugaaaugggguaaaguguuucucagauguuuuacaaagacagcuggccccuuuauaaagauagaguaccuuucggcgaggcuguguaaagauguacauuguguauacauacacuuuaugccaacucuucugggaugauuuuuccaggaccucuggaauuuacuuuuuguauucuaaccuaagaggacuggauucuguuuuacacaguugucuaguauuuucauauuagcaaacauaauaaauugaguuuguucagugugggcauuauuuucucuggcauagauaagcuuuauuguuuaauuagaaaagaaaugcagaaaaauauuaaagauuaaaucaaauuaaacauccucacuuaaauaaugacuuauaccucuuccuucaguaaguacauaggcuccuauuugaacuaaaaaauguaauucuauaugcuguuugcugauagcuugcuuuuucuaucaaggaccucuuucuauauguaccuauguaacugguaaaauggcuacauacugcuccauuuauggauacacuagacuacuuagucuccugaauuugauauuuugggaauccgccuccccuccuuuuaugcuguugaucauuuugucugcacauaaauguuugaacaauucuuacguuauuauuauuauuauuuuugauacagagucucgcucugucacccaggcuggagugcaguggugugaucuuggcucacugcaaccuccaccucccagguucaagccuucuagguucaauugauucuccugccucagccuccugaguagcugggauuacaggugccugccaccacucucagcuaauuuuuguauuuuuaguagagauaagaguuucacaauguuggccaggauagucuccaacuccuggccucaagugaucuuccugcuuuggccucccaaugugcugggauuacaggcgugagccagugugcucggccacguuguuuuauuugaauaagggccuagaaguagaauugcuggguugaaagaguaugcaccaaauaggccaggcgcaguggcuuaugccuguaauaccaguacuuugggaggccgagguagguggaucaccugaggucaggaguucgagagcacccuggccaacauggugaaaccccgucucuacuaaaauuacaaaaauucacuggguguggugguguacgccuauaaccccagcuacucgggaggcugagacaggaguuaucacuugaacccaggagaugcagguugcagugagccgagacugugccauugcacuccacucugggugacagagugagacucugucucaaaaaaaaaaaaaaaauugggggguacuauuucuaaguaaccuucuagaaagguuacaauagaugcaugcucaccagaacuguaugauaauaccucauuguuucaccuuaacuaucaggugauaguauauucagucuucauuauuaaagcuuagagguggaacauaauuuauaucuuuuucauauccauuuuauaucuaauuaaauaugugaguucaucacagcuuugcagaagaccagauauuccauuucaaaaaaagaguuuggaaguuggcuuccacuguuauggaaauaauucaacuuaucacccaaauuuuaguuuauuaauuuccagugcuaauguuuacuuuggauauauaaugucaaauuuuguuuuucuguaagauuuuuaaaaagcauaaaacaguuacucuuaauuuuggauggagucauuuccagucccuucugaaauaaggcagauuaugaauaaguaaauggaaacuauugggccaauuuuaggauuucucuguaacuacccugcuugauaauuuuuauauccacuuauagucaagaauguaguaucuuuuucuuucucagccauuuauauauauauauauaugguagauuagauuugguaucaccauuaggggagagguggagaagggagguuauauaaauuauuugacuucucacuagaagaauucuuuggagguuaaaaauuuaggugcuuuauaaauuuuuuaaaaacccaccaaaaccaagcuaaaauuuuacuuaucugccauuaaauuguuuuagauaauuaguuugaauaauggaacaggcaagguuguauuccuggagcuuuuggggcaucauucuaaguaauuuuguggucuuugaauuaauaaguagauuuaaggccuaauagagagguaagugaggugguguagaauaggagcuuggggaaaugacuuuuacuguauuccuaaauuugcauaggaaagggcuuuauguugggaaaauguacaguauuuugucaggucagcuaauagcuguaauuauuuagcaacaggagcuuagcaagaggauuguuaccuucaucaucaauaaaguagaacuauagggaaagaauuuaaaugauaagcaggugagcugcaagcuguggguaguuagguuugaaagauacgugcaugugccgggcgcgguggcucacgccuguaaucccagcacuuugggaggccaaggcgggcagaucacgaggucaggagaucgagaccaucauggcuaacacgaugaaaccccaucuccacuaaaaauacaaaaaauuaguugggcgugguggcaggcgccuguagucccagcuacucaggagacugaggcaggagaauguugugaaccugggaggcggagcuugcagugagcugagagggcgccaugcacuccagccugggcgacagagcgagacuccgucucaaaaaaaaaaaaaaaaagaaagauacaugcaugugccuuugauaauuguacacacuuugaaugauaaaugauuaacagccguucucucugauagacuucaugggagacuguaggguguaagaaaaagaauuuugcaaaagaaaauucagaaaacaaagagaauagagagaagaaaagcgagaaagaaucgagucguggacguggaaacaacaaccggaaaggaagaggcggcaaucguggcagagaauguaaguacagacuuucuccucaguuuuuucucuucuuucaucucaagugacccucccgccucagccucccaaaguuuugggauuacaggcaugagucacugcgcucagcuuucucaaauuuuuucuuaguuuccauacauucugaacgacugaaagauuaguccauaguaugcucauaaauucguuuccucaaugcagaauuuguucuaauaguuaacacuagaaaugaguggcaccugaguaguuucauaagcgccucccaugugguuucguaucagcauugaccugggcuguaggcaggugguuguguagugugaugacucccuucuguuaugagucagacacauuuguuaauuuuagaaugguguguguguggcaaagaaggggccaggggccauuuaguuacagguagauaaagcuguuuuauauucuccauuuauagacacucaugguauagacaaggguuagauuaagaggaaaguugcugaauaggcaggauuucucauaggcaggucucauuuccauuagaccuagguuuucuagguuuugucacuguuuaugcaaaacaaccuugucugcucuggcagugugucaguguagcuaaguuaugaaagaauaaaauguaaauauuuaacauaucacccugagacucuugcugucucauauauuccacugauauuuauugaguaucuacuauguaguggauacuuuuauaggcauacagcaaugaauaaaguaaguaaaaucuuugccuuucuaaaacuuuuaaugaaggucaaaugggauguaacaauaaagaaaauaaaauauuuuauauuaauauauuuuaaugauguuauguagaaauuauguuauagggaaaaacagagaugcaaauuaugggaagaggucuggcaaauuuaaguggguugccaaggaaagccucacuggaauucaugugagucagccucugaaagaggugaggggagcaagccaugccaauauccuucauaaaauuucuguauuauguagagcuauuaaugccaauauagggaugagaaaaagaaaagacugcguguuggcaucuuccuguuaguauccuagaaaaacccaacuccaacacuuuaguuuuucuaagaacucaggguuuccuugguauugcuauuuugcuauucugugccuuuccaggcuuugaaccuaauuaaugagcaaauucugugauacauuaacguaguugcauaauggaaguaguuuuuuugaagcaaaaacuucacagcaaguccacaaagaagaaagaaaaaucaguauguuaauuuauuuucagaauuuucaugugaauuaaggaagaugugauuucauauauauauauuuuuuucacuuuuuuugagacaaggucucacucuuucacccaggcugaagugcaguggcaugaucacagcucacugcagccuugaccucccugggcucaggugauccucccaccucagccuccugaguagcugggacuacuagcugcacgcugucacaaccauaccuggauaauuuuuguauuuuuuuguauuuuguauguuguauuuuuucugagacagagucuugcucacuuucccaggcuggagugcagugaggagaucucggcucacugcaaccuccgccuguuggguccaagcaauucuccugccuuagccucucgaguagcugggacuauaggugcgcgccaccacacuuggcuaauuuuuauauuuuuugguagagacaggguuuccguguguuagccaggcuggucuugaacuccuggccucaagugauccacccgccucagccucccaaagugcuggaauuauaggugugagccacugugccuggccaauuuuuguauuuuuuuguauguugcccaggcuggucucaagcucuugggcucaagagaucugccccccucagcuggaaauuacaagugcuggaauuacaaguguaagccacugugccugaccucauucaguuuuuaagucacuuuuguuuuuguuuuuccuguuuuugaacccguuguuuaaauuguagccuguuugucauuccuucuuugccuuuaauaggugcuugauaagguuauguacaagagguuuggaaauggaaauuugauuuuucugcucuuuucccccuaguuagaggugaagaaaauggaauugauugcaaucaaguggacaaaccuucagaucguggcaagcgagcccgggguagagguaagcuagaguaagagggaagaaaaugcuuucaauuagggggaagaagcaggcaguugcguugcuggacugugacuagggauggcaguguguucugaaagaauagcaggucaucuaaaaucugaucauuuguuuacugaugccuguaaaugaacuauuuuggguuauguaguuuugaagaaaccaaaggguuguuuuuggaugagcugagaaagcccuaugaauaauuuaaaacuuaaagcucuaaccaaaagcauugacaaauuauaauuguauuacguuuggaauacaaugcaauaggguuuuuuaaaccuuauuuuaaaaauacuuuauugcuaaaaaaggcuaugaucauuugagcuuucagugaguuguagucuuuuugcucuaguccucacuucuagcuauuuugaaguguauaauacguaauuguuaaguagucaucuuacucuacuguugaacauuagaacuuauucccuuuuuuugagacccugccuggcuaacacaaggaaacccugucucuaccaaaaaauauaaaaaauagcuaagugugguggcacgcaccuguagucccagcuacuugagaggcuaaggcaggagaauugcuuggacccaagagguggagguugcagugagccgagaucuccucacugcacuccagccugggcaagugagcaagacucugucucagaaaaaauacaaaauacaaaaaaauacaaaaauuauccaggcauaauuaaaugcagggucuuacuuugucacccaggcuggagugcaguggcaucaucucagcuaacugcaaccuccaccuccugggcucaaacaauccuccuacuuacccuccugaguagcugggacuacaggugcacgccaccaugcccagcuaauuuuuguauuuuugcuagacaugggguuuuaccauguuggccaggcuggucucaaacuccuggccucaagugauccaccugccuaauccucccaaagcgguaggauuacaggcaugagccaccgagcccggccuagaauuuauuccuucucucuguguuuuaaccuauccaccaaucucucuuuauuccccacccucuauacccaucaccuucucugccucugguaacuaucauuccacucucuaccugcaugagauaaccuuuuuagcucccacaugagugaguacgugugauauuuaucuuucugugucugguuuauuuuauuuaacacaaugucuuccaaguccauucauguugcuccaaaggacgugauuucauucuuuuauggcugaguaguauuccaaccuguaaauauaucacuuuuuaaaauccauucaucuguugaugaacacuuagguugauucucuauauuugugaauauugugaauagugcuucacuucaaaauagcuagaagugaggacuugaaaaguucccaacacauagaaaugauaaaugcucaugguaacggauauccuaaauaccucaacuugauaauuauauauucucugcauguaacaaaguaccacauguaccccauaaauuuguuuaaauauuauguaucuguaaaaaguuaaaaauuaaaaaaaaauagaaauugccacagccaccacaaccuggcaaacaugaagcacuauugguuuccuuuucuuuguauaaauaucugcuaaugggauugcuggaucauacgguaauucaauuuuuuguuuuugauaaaucuccauacuguuuuccaaaauggcuguaccaguuuauauucccaccaauaguguaugagaguucccuuuucccuguaucuucaccagcaucuguuuaauuugcuuaauuaguuaaaugcagugucaugaucauaacucauugcagucuugaacuccuggguucaggcaaucuuccuguuucagccaccucaguaguugggauuacaggcuauuuuuugucuuuuugauaauagccguucuaacugggguaagaugauaucucauugugguuuucauuuguauuuuauugauguuuagugaugagcauuuuuuguguaccuuuuggccauuuguauauugucuuuuuagauccuuugucuacuguuuuuuuuucucuuaagagacagugucucacucuguugcccaggcuggagugcaguggcaugaucauaacuuacugcaaccuugaaauccugggcucaagugauacuuccaccucagccuccugagcagcugggacuauaggcaugagccccaccaugccuggcuaauuuaaagaaaaaaaaaaauuuuuuuuuuaagagauggggucuugcaauguugcccagguuggucuggaacuccuggccucaagcuguccuccuaccucagugucccaaaucucagggauuacaggugugagcuacuaugcccagcuguuugcauacuuuuuaaugggauuauuuauauuuuggcuguugaguuguuuagauuccuuguauugucugaauauuagucccuuuucagaugaauaucauccugcaaauuucuuagaugauacuuccuuaaugcugaggcuaaauuggagaccauauuuuuaaaucccagggauucaggccgggugugguggcucauaccuguaaucccagcacuuugggaggccaaggugggcagaucacuugacauuaguaguucgagaccacccuggccaacaugguaaaacuccaucucuaauaaaaauacaaaaauuagcugggcaugguggugugugccuguaguuccagcuacucgggacgcugaggcacgagaacugggggaaguggaggcugcagugagccgagauuguaccauugcacucuagccugugugacagagugaugcucugucucaaauaaaaaaaucccagggauucaguauuauucuagguaaaguuucuugucauaugccacauaguaaauugguaaaaaccaaguauaauucugucuuccacaagcugaaacugcuuaguauuuuuuauauuuaggaccagguuucuguaaaguaaguuucaaacuuacuauugucaaagauagaaagauggcaacgaagaguguuggcacguacaccucugcuaauuuauuagguccuaaacccugaaguacacaccuugggaagaaaaagaaaauagaagguaacaaaaagaaagaauaaaaugacuuuauugaccccuaaauuuuacugugucucaccagggagggcggucacaguauaagaccaacguuaugugugugauuaguccuuaccacccuguucugguuaaaauaucauuguucugauauuccuuuguucuuaagguuuuaggaauacauaguaacccagcuucuuccccucuuaccagggagaggguuuucuuuccuaggguauuugaucucucacaugcuucugcuggcauuagugggcgucuuagagaaaucgucaaaucuucaugacugaaaucccacuacugacuacacuguugaauccuuuacuuuuacccuuugacaguaggaaucuagucacaguauguauuuggauugguuguuuagagacauguuuaaggauuacaagcugauccaugucauaaaucagacagauuuauuguuauaaaaacacauuauaggggggccgggcaccguggcucacaucuguaaucccagcacuuuuggaggccgaggcgagcagaucacgaggucaggaguucgagaccagccuggccaucauagugaaacccugucucuacucaaaauacaaaaaaauuagcuggguaugguggcaugugccuguagucccagcuacuuggaggccggggcagagaauugcuugaaccugggaggcggagguugcugugagccgagaucaugccauggcacuccggccugggugacagugagacucugucucaaaaacaaaaaaaaaaaaacaaaaaaaaacaccacacauuauaggggauaaccagugaauuggagauugaguaucuguuaggauggguacuguuauuacuuugaggaaaaaguugauauguuuaccuugguucuauuuagacuaauaaaccccaaauaaauaaaaguuaacagaccauguaaaaucaccauaguuuuucuuaaucgcaaguaugcuagauaaauucugcaggggguaugguguuuuauuugaccuguucuuccuauucuuacugggacuguaugguggcuguucauauaauuuucucaucaguauauauaccggugaauaggaacagaaugcaaacaaucaaaaacauaguccauuuaaacuaucugggcgacaaaaugggcacuuaauuuuacugucaaaaucuauuacguucgcuuuauauaaaagcagcuauguaggcaaacuaccuaccuauuuuuuauuuguuuugguuuuuguucuuagcuugaucaguuggccuugcuggauaguaaguugucguaaguguggagcagaguuugcauucaagcuggagccacuugaaaaaucauuccuauagaguauaucuuucauaagcuuuuuugcuaguggaguguaauugaggauuuuugcaaaggauuuggguugaagcggaauuauuagaaugucagguaaguauguuuaccagcaggcccuuugacagcuugggugaaagaggggcugcuggcugcuggcaguucugcugagauuuuuuuuaggacuuuccugaagcuuagcuucagaguuguaaaaagcaacugcaaggaguggggccugucuugggaucugccagauaugugaugaucauaggggaaggagcaacugucuuauaucuuaacaauucuguucuucucaccaguauccugaagagaggaaagagaaaagcagagagaaguuuuccauuucauagagauaaugugaaaauuacuaugauucugacauuauuuuuuguaguguaccucuucucuccccuuccuuccuuccuuccuuccuucccucccucccuuuccccccuucccuccuuccccgcuuccccccuuccacccuuccuuccuuccuuccuuccuuccuaccuuccuaccuaccuaccuaccuuccauccuuccaucccuccuugcaggagucuguguugccuuggcuaguaucaaacucaugaacucaagcaguucuauaucaauguauuuaaaaaauaauuucaggccaaguacaguggcuuaugccuguaauucuagcacuuugggaggcugaggugagaggaucacuugagcucaggaguucaagaucagaguggacaauguagcaggcuuuuuuuguuuaaaaaaaaaaaaauuagccgggcaugaugaugugcaucuguagucccagaaacucaggaggcugaggugguaggauggcuugagucugggaaguugaggcugcugugagcugugauugugccacuacacuccagccuucagauauuuuaagcuuuucagacaguaggccuuuauuuacuaucguaucuuuccccgucuuuuauuuauuuguauuucuagauauauauauauauccagaauauauauauauauccagaauauauauauauauccagaauauauauauauauccagaauauauauauauauccagaauauauauauauauauccagaauauauauauauauauccagaauauauauauauauauccagaauauauauauauauauccagaauauauauauauauauauauauauauauauauauccagaauauauauauauauauauauauauauauauauaugaaguaaauaagcccauauuauuuuuuuggucuugacauaauuuaggaguuccaaagcaauauaaaauuucguguggcucaccguuuuuauuuacuguauuuuuauuuauuuauuuuugagacagguucuugcauugucacccaggcuggugugcaguggugugaucuuggcucagugcacucuccaccucccaggcucaagccaucuucccaccucagcgucccuaguagcugggacuacaggugcacgcuacuaugcccagcuaauuuuuguagagagaggguuuugccauguugcccaggcuggucucaaacucuugagcucaaacaacccgcccaccucaaacucccaaagugcuugcauuacaggcaugagccacagcgucuggccugcuauuucauuuaacuuuguuuugaaugugcuuuaugcagaaaaagauaucaauauacuuaauguacuugacauagauccauuuuuuguacuuugcuguaguugaguguguuuauguauuagaaaugacgcucgccgggugcgguggcucacgccuguaaucccagcacuuugggaggccaaggcgggcagaucacgaggucaggagaucgagaccacccuggcuaacacggugaaacccugucucuacuaaaaaaaaaaaauacaaaaaaagauuagcuggugugguggcgggcgccuguagucccagcuacucaggaggcugaggcaggagaauggcgugaaccugggagacggagcucguagugacccgagaucacgccacugcacuccagccuggacaacagagcaagacuccgucucaaaaaaaaaaaaaaaaaaaaaaaaaaaaaagaaaugacacucaggauuuggauuaaagcagaauuauuagaaugucaggauuuggauuaaagcggaauuauuagaaugucagcuaaguauguguuugccagcuuugcuugaagauuugauuccaugauacaguuuuuuguuguugaaacugggucugucucugucgcccaggcuggagugagugcaguggcgugaucucggcucacugcaaccuccaccucccagguucaagcaauucuccugccuuagccucccgaguagcugggacuacaggagugugccaccaugcccggcuaauuuuuuguauuuuuaguagagaugggguuucaccgguuacacuuauuuauuuauuuagagacagagucucacucugucuccaggcuggagugcaguggugcaaucucggcucacugcaaccuccgccuccgggguucaagcaauucuccugccucagccucccauguagcugggacuacaggcucagcuacuucuuguauuuuuuaguagagacgggguuucaccauguuggccaggauggucucaaucucuugaccucaugaucugcccgccucggccucccaaagugcugggauuacaggcaugagccaccgcaccuggccaguuauuuuuuauuuuuauuuuuugagacgggaauuucucucuuguugcccuggcuggagugcgauggugggaucuuggcucaccgcaaccuccgccucccggguucaagcaauucuccugccucagccuccugaguaccugggauaacaggcaugcgccaccacacccagcuaauuuuguauuuucaguagagacgggauuucucuauguaggucaggcuuaaauguguauuuaaauuacucuucuuuuguauguuucuuuaucuuguguauucauaaaugguuuaucagcuuauauguauuauuuuggucuuuuggugagauugagucaaguaagguagugaacuauaguuucuuuuuuuagagacagggucucacucuguuacccauccuggaguacaguggcaugaucauagcucacugcaaccuccaacucuuacguucaagcaauacuccugcugccuuagcuuccugaguagauaggacugcaggugcacaucacaaugcccagcuaauuuucaaaagcauuguaggcaggucucuguguguugcccaggcuggucuugaacuccuggcuccaagcaguccuccucccuuggccuccuaaagcagagggauuacaggcacaagccacugcuuuggcugguaaugaauuacacuugaaguuacagggguugguuuccuucuggauggaagaaaaauaaugcaaaaaaggcaacaauaguuuacucccuaaccuuucucacugcuuuaccuuacuguuuuguauuuagugacucagauuaguuccucuacuuuuucuuucuuucuuucuuuuuuuugagacguagucuugcucuguuaccuaggcuggagugcaguggcacaaucucggcucauugcacgcucccccuccuggguucacgccauucuccugccucagccucccgaauaguugggacuauaggcacccgccagcacaucgggcuaauuuuuuguauuuuuaguagagaugggguuucacuguguuagccaggauggucuugaucuccugaucuccugaucucgugauccgccugccuuggccucguaaagugcuaggauuacaggugugagccacugcacccggccuaguuccucuacuuuuaaaacuaauuauugcaugaauacggucuauauaguacaagugcaaaguaauuuugagcaccuacuauguuuuaacauucuacuuaaaaauuuuuuuuuuaagguagagaaggggcucuugcucuguugcccagggugaucucaaacuacuguggcucaagugauccucccaucuugaccuaccaaggugcugggauuacagacaugagccaccagacccagcuuacguuuaaauuucgaauccucuguaguaccuucuuugggagucuugcugaguccuuguuccacauagcauuuaauaaaaugcugauucucaaaucaguuacugaacagauagguuauuuccuguaauuauauaaugccauuauugugccucuauacaugagaguuuaauccaugaaagacuccauauuuaugaaguugggauuacagaucagucuuuuuuuuuuuuuuuuuuuuaaaagacagagucucgcucugucgcccaggcuggagugcaguggugcgaucuuggcucacugcaaccucugccucccggguucaagggauucuccugccucagccucccgagaagcugggacuacagagauugagaccauccuggcuaacacagugaaacccugucucuacuaaaaauacaaaaaaauuauccaggcauggugaugcacaccuguaaucccagccgcucgggagacugaggcacaagaaucauucgaaccugggaggcugagguuguggugagccaagauuacgccacugcacuccagccugggugacagagcaaaacucugucucaaaaaauaaaaaaaccuugaacaaucauucaacagagauguaguagagucccagggcuugaggaggaaagguacagcauuuaccauaauaugguuuauucgcuuugauaaucuuuggaaacguuggacuugguuuuugugauuaaaagacucuggaucuuuauucugagcugcuagauuaaucuguucauuccagauaacaaugcagggaaaugguauauacacagaaaccaauguuacuaguagcguuacuaccaggugaguaggaaacaauaauucuauuaucuugcuagaauuuauggggacgauggauuagauuuuuuaauuuuuaaaaauuuuuuguuuggcugggcgcggugguucacgccuguaaucccagcacuuugggaggcuaaggcgggcggaucacgaggucaggaguuugagaccagccuggccaaaauggugaaaccccgucucuaauaaaaauacaaaaaucagccaggcgugguggcaggcaccuguaaucccagcuacucaggaggcugaggcgggagaauugccugaaccugggagguggagguugcagugagccgagguggcgccacugcacuccagccugggcuacagggugagacucugucucaaaaaaaaaaaaaauaaauaaaaaacaacuguuuuuguuuuuuccaagaccgagucuuacuuugucacccaggcuggagugcaguggcgccaucucggcucacugcgacugcugccucccagguucaagcaauucuccugccucagccucccuaauagcuggcauuacaggcaugcgccaccaugucuggcuaauuuuuguauauauauauacauuuuuuuuaguagagaugggauuucaccauguuggccaggcuggucuugaacugaugaccucaaguaauccaccugccucagccucccaaagugcuaggauuacagccacgagccacugcucccagccuaagaaagaaaauauucuuuacaaaauuuacauaccauacauuucauccauuuaguguacaauugaaugguuuuuaguauauucaccaaguugugcaaucaucaccacaaucaauuuuagaacauuuuccacaccgcagaaguauaccuuacccuuuaucauuucaccaauucuuucauucuuccaccucaacccugagcaccaguaaucgccuuucuguuucuguagguuuuuguguucuggacauuuccuguaaauggaauuguauaauauguggucuuuuguaacugcuucuuucucuuagauaauguuuuggguuccccaucgccuuuacccugaagggauuaacuuaauguuuuaaacauucauccauguuguaguauguaucaguacuucauuccuuuuuauggcaauauaauauaauguuguaugaauauacugcauuuuuuuuucaguucaagguuuuaaguccugagaauaguuuccuuguuuuguagcuuguuuaauuuuggccuguauucuugccaaaagcuauagacugaaaguuuucuucuuagagcuaauuagcugaauuucuuaacauucuuguaagucacaguaauaccucugugugaagucuuacuuuugccuucuuaaaaaaacauuuauuaaaaaaauuuauuguagagguggcaucucgcuuuguugcccaggcugguuuugaacuccuggccucaagcgauccuccugccuuggccuccaaaagugcugggauuacaggugugagccaccaugucaggccucaauuuguuguauaaacauauacccacaagcacaauuucaugaucauauggucaaucauuguauuuuuugaggaacugccauacuguuacccauaguagcuguaccauuuuacuuuuuuuuuuuuuuuuuugagacggagucuuguucaguuguccaggcuggagugcaguguugugaucucggcucacugcaagcuccgccuccggguucacgccauucugccucagccucccgaguagcugggacuacaggcgccugccacuacgccuggcuaauuuuucuuuuuuuuguauuuuuaguagagaugagguuucaccguguuagccaggauggucucgaucuccugaccuugugauccguccgucucggccucccaaagugcugggauuacaggcaugagccgcugcaccuggccccauuuuacguuuuuaccagcagugcacaauggugugcuccacaucuuugucaacacuugguuuuuuuuuuguuuuuuuuuuuuaaagauagagccucacucugucacccaggcuggagugcaguggcacgaucucagcucacugcaaccucugccucccggguuccagcauuucuccugccucagccucccagguagcugagacuacuggcgcgcgccaccacgccuggcuaauuuuugcauuuuuuuaauaaagacgggguuucaccauauuggccaggcuggucuugaacuccugaccucgugaucugccugccucggccucccaaagugcugggauuacaggcgugagccaccacgcccggccgccaacacuuguuauuuucuguuuuuuuacuuuaauuuugguaguagucauccgaaugaauaugggauuguauuuuauugugguuuugauuuggauuucccuaaugaucagcaauacugaguaucuuuuaauguguuuauuggucauuuguauaucuucuuuggagaaauccauauucaaguccauugcccgcccccccgcaccccccccuuuuuuuuuagucucacgcuguuaaccaggcuggagaacagugacgcaaguuaggaacuguagccuccgcccccuggguucaagcgauucuccugccucagccucccgaguaccugggacuacaggcaugcgccuaauuuuuguauuuuuauuagagaugggguuuugccacguuggccagguugguuuugaacuccugaccucaggugauccgccugccuuggccucugaaagugcugggauuacaggcaugagccaccgggccuggccguugcccauuuugaauggaguauuuuguugucgaguuuuaggaguucuuuguguguuccagauguuacucugugaucagauauauaauuuauaaauauuuucuuccauucuuuggguugccuuuuuacucuguugguaccgugguguuuuuuuguuuguuuuugagaaauggucucacucugucacacugacuagaguacaguggugcaaucucagcucacugcagccucaacuucgcaggcugaagcaauccuucgacuucagccuuccgaguaguugggacuacaggcauguaccacuaugccccauuaauauuuguauuuuuuguagagacaagguuuugccauuugcccaagcuggucuugaacuccugagcugaagcaguccaacugccucgguguuccaaagugcugggauuccaggcaugagccaccgugccuagccaauauguguuuuguuacagauuuuguuguuguuguugagacagagucuugcuaugucacccaggcuugcauacagugguuugaucauaccucacugcaaccuccaacuccugggcucauggauccuccugcuucagccugucagguagcuaaguuagaggcacaugcccauaaaaauaguuuuguagagagggagucucccuauguugcccaggcuggucuugaacuccuggcucaagccacccuuccaccucagccucccaaauuguugagauuauaggugugagccaccaugccugucccagaaaaguuuuuaauuuucauaaaguccauuuugucuauuuuuucuuuuuuugccuguaguuuuagugucauacucaagaaaucauugcuaaauccaguguugucaagcuuuugcuuuguguuuuucucugagaguuuuauaguuuuagcucuuaaauuuaggccuuugcucuucaguuuaggauuuuaaugaagagaauguggaaaggugcuagucauaauuuucucuucuugcuugcuuguucucaugcuugcugccauuuugaucuuugaucacagacuaguauuuaaaaugauacuuaacagugccuucagcuuacuuugcauuuuccucuuucugguucucauuucauuuauaguaguggcuuauaauuccaugguguuagcucuuucugauuuuaaaagaugcagacuguuuuauaauacaaccucccuguguuuagcugucaaauaccacaaauauaauacaaggauaauuuaauucuuuucuagccuuagaagucacuaacuggguauagguaguuguaucagcagggaucaguuaauugggugcccuggauuggaauguuggugcuacuaggaauaaugauaauauugucuggguagugaguauaggaugaagaaggaaguguaauuguguaggacauaaguauuauuuuauacuauaauuguguguuuuuuuaaaggauuuggacguggcagagggagaggggcaggaagguucucaacccaaggcaugggguaagugauagccauccuauuuuuauaauuauuuacuucccuaguuuuuauucugcaguugcuucuaauacccuacaucuaauuuagucaucauggugaaucuaguguuuucuauacuuaaagagauuuacaaauaagaaaaauaauaugaauaaaauugaucuuuuaaacaggcauuagagcaggguuucuagccuuggcauuauugagauuguguauuggauaauacuuccauggggugguaggaucuccuguauauuguagguugcuuagcaacaucucucuucucuguacuauuaauaaaugucaguagcacuucgccugaaguugugacaaaauaccuauagacguaccuaaauggcacugccuaagagccauuuuaguuaauccagccauugucuuugaaugcuaaguaaauguaaugcuuauuuauguaugagugauaccuuuuuccugaauugaaauaguaaacauugaacagacucaaaggcacuaaaaucagagguuuauuucuuguuucuggguguuuuuuuacuuuuuguugcuucuaaaacauuagcucccauuggauuuuuaggaagaguuuuaaaacauccuguggaagccauacguagaugcagucaaggaaaggaauuggcuccaagaaaagcccuuugucucucucuaacuucaggcagcacucuugguguuaaugccuucuagaaguaguggugccucaugcaaucugccuucugccuaagcuccuuugaggaaaaggagggaugaaaacacagggagcaaacucucaggagcacuuuaagacauagcccugcucauuagcuuuaaauuguuuuguggauuuuucuguuuacuucacauuccuuugugaaaauuuuaaagguaauauuuguuuuggcucauguuagaccucugaaccaugauucgauuaaacuggguguucaguuuaggauuuuauugaaaagaaauagaggugcugaacaaaauguuuucuucuuuaucuaauguuucuguaaaggagcauauaaaucuaagcuguaaaagccaaacuuggauucugacuugggaagaaaauaccuguugccuauuuaugccuuauuuuucagcaggacucucauaagagcucuuauucugccuugaaagauuauacgucuccuugucugcuuuaggaugcagaggaccguguuucaggaaaauaaggcuauuauaccagaauguguggaaggucccuaggcaacuucugguuuucacaucugcaucuccauggcuggcagaauuaguuauauuuaaauaggggaaggagaggugaugucuuuuacaguggcugugagaaggcacugggcuuguuugguggaagaucauguaugguuaauauuuuggcuuagguguuugcuucuuuugccuuuauuauuucuuuauuucaaaccccaggacauuuaauccugcagacuauucagauucuacaucuacagaugugugugggacaaagcuaguaguuugggaagcugcucagaauggugcagaugagggaacugguaaguguucuguuuuugccagagaugaguuuuaaauguuugagcuauuaagaguuguauguucucauacaaagaugaagucuaaaugugcugauggaaaagaaugaaaaacaggcuacuguccuaccucugaaacuauucuuaguugguucuuaccacccaaagucugucacauacaaaucucaugaugacaaggaauuugauuuucccuucugcaagcuaagaaagaggcuauauaagguaauuggcauaaaucagcacaaacccacacucugaucaaaguaugucacagauauauagaauuucugaggagaagauuuuuuacuggaaguacuucccauuucuaaugguggauucuuuggccagauaauguaugauaaugugguagaugauagauggguuuguagcaacguugccucugcagguuuuucuguaucaugcuguuucuggauuauuuauuuucugaaauucuugggguaaauauugguuauuuauauagaguucuuuguacaguaauuauugagauuauacuuauagaaacauaauuuagcugggcgcgguggcucacaccuguaaucccagcacuuugggaggccgaggcagauggaucacuugaggucaggaguucgagaccagccuggccaacauggugaaacccugucucuacaaaaauacaaaaaauuagccgggcaugguggcacaugccuguaaucccagcuacucgggaggcugagacaggagaaucgcuugaacccaggagguggagguugcaaugagccgagaucgugccauugcacuccagccugggcaacagagcgagacuucaucucaaacaaugacaacaaaaacgaaaaacagaaacauaauuuaacacaaugaauuauaaccuagacuuagaauauagcucaauaaauuaucaaggccaggugcagugguucaugccuguagucucagcauuuagguggccaaggcgggaggaucacuugagccagaguuugagacgagccugguuaacauaguaagaccucaucuauacuaagaaaacuuaaaaaauuagcauggcaugguggugugcaccuguggucccagcugcuugggaggcugaaguggggagugucacuugagccuggcagguugaggaugcagugagcuaugauuuugccacugcacuccaaccugggcaacagagcaaggcgugccugaaaaaaaaaaauaaugcacacaaacauccauauaacaucaacccuagccaaaaaauaagagaguaccaccagaagcacgacuaaccaacuguaaauagagaaacuguaaagagggucaacaaaauuuauaaguuguuauuugaaaacacuaguaaaaucguuaagcuucuuaugagaucaucaagggaaggugagaacgugaauaauugguuccaggaaggagaaaaggaauauugauauggaucauauagauauuaggagauuauaagauaacucagcuugagcucaggaguuugagaccagccugggcaacauggugaaacuccgucucugcaaaaaaaaaauuaaaaaguuagccgggcauaguaucauaugccuguggucucagcuacuugggaugcugaggugggaggaucacuugaaccuaggaagcauagguugcagugagcugagaucgugccacugcacuuuagccugggugacagagugggacucugucucaaaaaaaaaaaaaaaaaaaaaaaaaagaauuauacacgguauuuaaguuugcuuaacugguuuuuuuuggggguggggggguguuugagguggggucucugucacccaggcuggagugcaauggcacgaucuuggcucacugcaaccuccaccucccagguucaagcgauucucuugcuucaguguccugaguagcuggaauuacagguguccggcacuaugccuggcuaacuuuuucguauuuuuaguggcaggguuucaccauguuggccaggcuggucuugaacuccugaccucaaaugauccacucaccuuggccucccaaagugaugggauuauaggcguaagccaccgugccccaccuucuuuucuuucuuucuuucuuuuuuuuuuuuuaaagagagagcaucucacucuguuguccaggcuggagugcaguagugugaucauagcucacuguagccuugaaccauuggguucaagccaucccaccuuaaucucccuaguacuuacugcuggaacuauggcacacaccacugcacugggugaauuuuaaaguuuuuuguagagauaagauuuugcauuguuguggaagcuggucuuaaacuccuggcuucaaagauccucccacccagccagugcuaggauuauugacaugagccaccaugcccagcuuaguuuguuuaacuuuuaaaaaacaagucaaaucaacuccuagaugcauacccaaaagaaaggaaaauauagguucacauaaaaucuuguacaaaaagauugauagcaacauaauucaucauuauaaaaaaguagaaacaacccauacuuccuguugaacaggucugucuggggggaaaaaaccucaaauguuuaucaauggaugaauguauaagcaaaauauagaauauacauagaauggaauaauguucagccauaaaaaggaauuaagguacaugcuacaacauggaugaaccuugaaaauaguaugcagagucacagaaagaccacauauauuguauuuuaugauuuuauuuaucugaaaugucuaaggcaaauuuauagggacagaaauuagcuuggugguugccuagagauagaacuauuugggaaaaguggugagugacuacaaaugaguauggaguuuguuuuuggagugaugaaaauguucuagaauuagaggugaugauugcacaaauugugaauauacuaaaaauuauucaacugucuguuguaaaaggauagauuucauguuauguguauuguauauaaaaauauagaaauuaguauuauccauuuaacaaaauuaaggagaaaaauccguaugauuauuucaguaaggaaaaguguucaauauucguucaugauuaaaacaaacaguguuucugaguggcacgugggauuugagccugauaauggcccuugauuccaccaacauggagacuuuguaccgcgucccauuagugcucaaaugucccaaccugaagcugaagaagccgaccaggcugcacaugcccucggccaugacuauguaugcccuggugguggugucuugcuuccucaucaccagaggaauaauuuaugauguuauuguugaaccucaaaguguuggcucugugaccgaugaacaugggcaucagaggccaguagcuuucuugguguacagaguaaauggacaguauauuauggaaggacuugcauccagcuuccuguuuacaauggaggguuuagguuucauaauccuguaccaaucgaaugcaccaaauaucccaaaacccaguagauuucuucuucuauucauuggauuugucuguguccuguugaguuuuuuuauggcuagaguauucaugagaauguaacugccgggcaaucugauaaguuagagugccuuuugagaagaaaucaauggauacuggauuuguuccugucaaugaaguuuuaaaggcuguaccaauccacuguugugaaauguggaaaagaaugaagagcagcaguaaagaaauauguagugaaaacacuggaaguguagcuuggaguaaaauuucuucuugguaucaaagagacaaguuuaucacaguauuuuuucuccugcugaccuauugacaucaaugauguugagugacauuuucuucuuaguuuuucauuuuuuaaagaaaauauacuccaguuuacaaauauaauauugaauaaagugauuauuuuuuacagccccuuuaacuuguuuuuggagaugacauuucugauuuucagaaauuaauauaaaaucuggaagcaagauuccauaaauugagaauucuagauggcugaucagcuuuaccuguggugcuuugccuuuuaauagggagugugauaauacauuauuucagauacguauguaugacuguuuccugaacaauaagaucuaugaaaggagcagaaauaaauaauuuuucuaauuaaaaacaaacaaaauccuggcaguuaggaauacaaggaauuuccuuaaucagauaaggaauaucuguaaacuuucagcagguguuacagucaauggugauauauugaaugguuuuccucuggaacaagauaaaaacacaugcggucacugcuuccauucacacuguacuggagguccuagccagugcaauaaagaaaaaauaaguaagucauaaggauuggaaagggagaauaaaccguuguuuuuugugauuguguaaaagaaucuguagacaaauuauuggagaguuucacaagcacaagaugcaagacacaaguuucaugaaggcauguauuucuauaaaucaucaacaaacagaaaauggaaaaaaauugcuaauagcuucagaaaacaccagaugccuaggaauaagucuaaugauauguaagauauguaagauuagaaaaaauauaaaacaauauugagagaaaauaaagaagacaauaaauagagggauauaccacuuuaauauauuuuagucccacuguugugacauuuaguuuuuacugacucagucuuugaauuuauuaauucacggugguccgucucauguaaauuuuccccacugauuuuuaaaaaaaauuagauuuguugauguaguuuuuauauguauacacauauauucuccccuuuuuagagguacagaggaugaauucuaacaaaugcauauagaauuauaaccaucauuaaaauauaauuaugguacuucuuuacuagcagugaacaauugcaaacaaagaauaagaaaaacaguacuuuuuuuaguaguaccaaaaaaacaagaaauaguuauuucugacuacguauaugcaagauuuguauguuaauauuaugcaacauguugggaaagaucaaagaagacccucauaaaagggaacauauucaguguucaugaauuagaagacucaauaucuuugaaaugucauuucucuccaaauugaucgauagcuucagcacaauuccaaucaaaaucuuagcagauuuuugacaacuugauucuuuuuuuuauuuuauuuuuuuucgagauggagucucacucugucacacaggcuggagugcaguguugcgaucucaacucacugcaaccuccaucuccugggugagugaucucuuaccucagccucccgaguagcuaggauuacaggugugcaccaccaugcccagcuaauuuuuuuuuuuuuuuuguaguuuuaguagagacaggguuucaccauguugggcagguaaguauugaacucuugaccucaagugaucugcccaccucagccucccaaaguggugagauuacaggugugagcuauugugccuggccuugacaacuugacucuaaaauuuuuauauaauauuaaaggaacuaaaguagccuaaacaauuuugaaaaggaaaaaaaaguucuaagacccacacucccugauuuuuuauuuuuuugagauggagucucgcuucgucagucaggcuggagcgcaguggcacgaucucugcucacugcaggcucugccucccggguucacgccauucuccugccucagccuccccaagugccugggacuacaggcacccgccaccacaccuggcuaauuuuuuuguauuuuuaguagagacggggcuucacuguguuagccaggauggucuccaucuccugaccuugugaucuacccgccucggccucucagagugcugggauuacaggugugagccaccgcacccggcccacacucccugauuuuaagaacugcucuaacacugcaguaagcaagacacauaaaucaauagcauaguaguuuagaaauaaacacauauacauauggcuaauuguuuuuugucaaagauuaugaggcaauucaaugccauacauuauacuguauacaaaaauuacccuccaagguuacacuuaaacaugaaaccugaaaguacaacuuacaaagaagauauaguggcaaauccuagugauuuuagguuaggcaaagaucucuuauauagaauccgauaagccugagucauaaaagagaaaauugacaaaguacauuuuaucaaaaauuguaaaauucuucugaagagaaaaaugaaaugauagaaugagacguagucuuggagaaaauguuuauauaaaauccauauuugauaaggacuuauauacaaaauaaauaaagaacucucacaauucaguaauaagaaaacaacccccuaaaacaaaugagcaauuaaaaauggggggaaaaaauggaagaaguucuagaaauggauaguaaugauuguacaacauugugaauauacucugugccacuaaauuguacacuuggagagggucagaaaugguaaauuuucuguuuuaacacggagacuggugaaggauaauuccugugacucuauaauuauuuuaagauaaaaaguuaauuaaaagcaaaauauuugcauuuauaagggaacaugauaaauggauagcaaacaaauccgugagugugcucaucauuauuagucauuggagaaauacaaaguaaagccacauugaguuacccccauucaccuauuaaaauggcuuuaaaggaaaugaaaaauuccaagugcuggugaggauuguggaauaacagguacucauauacaugccuggugggaaagcauaccuaucauacaaucugacaaucccauucuuagauuuuuauaaaaguggaaugaaaacacauccaaacaaaaaucuguaugugauauuauagugcuuuuauuaauaccuccacugauguuuuuuuuucuugcuucuuuuuuuuuuaagagaugggggucucaauuuguuguccaggcuggaguguaguugguauucacaggcguaaucuuagugcacuacaaccucaaacuccugggcucaagugauccuccugcaucaccuuccuguguagcugggacuacagcccugcaccacugugcacagcuuccacacaguguggaagaacuguguguggaagcugugcuggcuuccauggcuuugaagccgaauguugugcaaguguugaagcagaauguugaauuagucaauuaguuacuuuuuuuaaaauuuucucuuuccuccucucucuuuucuuucaucuccucccacuuauuauuuaaaguagcagauuucuugcugaaaagcauuuagauaagcaaaaccaauuuguuguagaauacaguuaaaggaugucagcugauggugcuggcuguuuuuccagaggccucacagaaugguauuggcuuguugauaagagaguuaugaguccaggacucagccuuauaggcucagaaacccaacuguugacaguauaauaaccacaaaucuauuccugauaugagggacccucaaauuaaccaaacuagaaagacuuguguauacucagaaggcuaauuuauaaauuuucuaaaaacugguaccuguugaacagauuagaauacucucuuugaugagugagaagggagcuugguaaacaugggcgugagaaugagaauaauugaagugauuugaguguccaagagccaucaaggauaagauucauaacuugauuugcagugaccuguaagaguauggauuucaauuacauuucacuauccuugggcaguaacgcagcauauacauagcuuugacagugaccaucuucucugugaugaauacuuucauucuuuucauauguuuaaacccucaauuuuacauugguccacagaacuggcaucaaauacucacaacauagcucaggaucugucaaacaaaaguucuuauggacucaaagguaugaauacuuaauuuuuuaauuuuuaaaauuaagaaucuuauaaauugcuugcaauaucuuucauuuuuuaucaaagcuagcuaauaaaaauuuaucagauaaauguuuguaaacuauaccuauuuauuugguaaucagauuugcaguuugcuaauggaaauguuuuauugauugacuuucaaggugccacagaauuuucaucauuauuuuccauguuccuaaguggccuuaacauacauucguuagaggacuaacaccaaguuaaauugaacauaaaacauucaucuccaauauauuguuuuaagcugaaaauaaggauuguugaaguuuuuccguuauauuuugugguguaggucuaaugaccaaauuaaaauuuuaauauuccaaaauaugauuaggaccugagccuuugccuucuguauuuaaugucuggaauuuuuuauagucuguguggguauggcuaguuccugcaacaacguggcacuugcuucucacaugggaguuuccccuguaauuuccugacuuaccacucuaucauguugcaucucugcuuauaacuaucuguuucgcuguuuuuccuucaggcuacauacauagugccuuguacuugcuuuuaaauguacucagauucucacccuauuaugcaaguccaaaguuguguuuaauuauuuucaaaauacugcucucaaagugguaggccagucuuuuuuauuuuuauuauauuauuuuuauuuauuuuuuuugagauggaguuuugcucuuguugcccaggcuggagugcaauggugcgaucucggcucacugcaaccuccaccuccuggguuuaagcaauucuccugccucagccucccaaguagccgggauuuacaggugugaggcaccacuccugacuaauucuuuguauuuuuaguagagaugggguuucaccauguuggccaggcugaucugaaacuccugaccucaggugauccacucaucucugccucccgaaaugcugcaauuacaggcaugagccacugcuccaggcccuauuuuuuaauuauuuauuuauuuauuuauuuauuuauuuauuuauuuuugagauagagucuugcucuguugcccaggcuggagcaguggcaugaucucagcucacugcaaccuccgccuccuggguucaaacgauucuccugccucagccuccucaguagcugggacuacaggcacacgccaccacgccuggcuaauuuuuguaguuuuaguagagacgggguuucaucauauugaccaggcuggucuugaacuccugaccucgugauccacccaccucggccucccaaagugcugggauuacaggcaugagccaccaugcccagccuuuuuuaaacuuuuaauaugucuccugaauugccaugguaggccauucuuacuacauaucauguauaaaagucuguuuuaacuuacuacauuaacuguacauauaguggcugagcugugcaauuuuaaaaauuagaaaaaauaauguauauuuuaagcuuuagaguacuuuaauauuuuuuauguagguuuuuguaauguuucaucauuguuuuucuccuggaaauuuuccuuuauaucccuguguguguauguuuaucuucgccaucaagcuuucucuuacaauucuggcuuucauuaacuucauccuccaaauuuccaguguauuagugguuucucagacagaauuaaauguuuucgguuuugaaacaucuguauuuuacauccaaauauuggcacaguuuacaucacauuucacagagagccaccccaaucugaaaucagguacauccuguuaaaaacauuccauaaauaaggacucuuuuucuaggaaacaaucaucauuuuacuuaugaggaggucaguuauuuggcuguuuacgugauucuaaggaagguagacaugguuaccugacuucuuuugucucacaagcaugcuccuccucuucccucuccauacacaacuuuuggagagaaauggaauuuuguuugucagaugauuaacuccuuucuucuuaugaaggaacugaaaacauccauaaucccucuuucugggguugucguuaauuucuuaguguauuuccuuuaaaaccauuaucuaugggcauuuuuuucauacaugcuguaaacaauggcccucuacuuauauaagaucuguaaguaaguauuuuuugaguagcaacacuuuugaaaguacuuagauguguuauggaugaguauucuguaagaacuguuugagcgcauccuguguacugacuccagaacuuaaagcagcagacuugauaugagcaagaguaauguugaacuuugcuggagaccuauuaggaagccauguaguagagcuaauauuuuauuaaaaggaugcuucucuaaauuugauaauucaguaauccaccugaaauaggguccaagacagauuugccuuaaaaugaaauuuguuguuuugaagacuauaucggaagaaaucaaaccauuguuaaaugucuauauuugugcuacauccauacuuuucuuacucauggcagaauugcuuggaugugaccuauauugaagcaaaauccauuugaaacacugauuugagguuauguagauagugacuacuagucaaguugcauuuguaaacauuauuucaaagagaaggggagaaaagaaauauuacugauuuuaccgagaauagauuaagaacgucauguuucuuggguuguaaacuaaauugcuagugaggcguauguaucuuuuuuccccgcauaguacacaaaaaggaaucauuuggacugagacuguauuugacuuugugguauaaacuuugauugcuguuguuucccaacaggggcuuggaagaauucuguggaagaguggacaacagaagacuggacugaagauguaaguguuugcugucagaugagaccuuucuuuuuuuuuuuuuuugaaauggaauuucacuuuuguugcccaggcuggaaugcaauggcgugaucuuggcucauugcaaccucugccucccagauucaagcaguucuucugccucagccucccaaauagcugggauuacagaugugcgccaccaugccuggcuaauuuuguauuuuuuuuuuaguagagacgauguuucaccauuuuggucaggguggucucaaacuccugaccucaggugauacacccgccucaaccucccaaagugcugggauuauaggcgugagacacugcgccuggccgauaccugucuuucuuucgguguuugguggggacuuuggugcuuggaagaaagagccugagacaucuuaucucaucuuggcuucuuuucuggcauguaucguagccaggguuuuugaggguuggcuuuuuuagcagaugcuucuuaaaaggaacuuagauuuucagauuuuuaagaauauuuguuuuugugcuuaaaaaugaccaauugucaagaugauugggagauuggaaaaaaacaaacaagaaaaaagguugagguguuaggcugggcguagugacucacaacagcacucugagaagcuaagguaggaggaucacuugaagccaggaauaugagaacugccugaguaacaaagugagaccccugucucuacaaaaaaaaaaauaauaaaaaaauuaccugggugugggguugugcaucuguagucucagcuacucaggaggcuaaggcaggaggaucucuugagcccaggaguucaaggcugcauuaucauucgaccgcccucuagccugggugacagagcaagaauccaucuuaaagcaaacaaacaaaauuuaccagguguuaaguaggauugauuuuuuuuuuaagcuuaucuguguuuuguuugaccugauagccagcugacacuguugcccagauuugugaacuauuauucuuuagaauauuuucauuaaaggggagucuguauuuuggaucacaguugaaauuaaccugaauaaguuugcucugguuccaugcccaaccucuuccccuuuugacuagaagaaccuuuuuuuaaaaaaaauuccuuuauugcacagauauuuuugagcauguuacacuagcuucuggguacugucagucuauaaguucugcuuucagcauaguauuuuuuuuggaaaaauaaguuaaauaauaaagagaaaaaagggauaaauaacccaauaccauaaaauuuuauaccucuuuucuguuugacugucaaguucuagaacucuugaguuugguaucugucugacacagaguuugagcagacauugagagggaaauaauaaauggguuacaaauacagauccucaaaacuauauacaaugacgcacacuuugagauucugucuuuuucucugucuccauauguguuuccauuuaugcuaacaggaccugcuuugaaugagaaacaagaaacaugauuucuacuugacuuguuuaaugaccuuaggcagggcguuguuccuugggucuuacuacuccuucacacacaguauuauuuggguuuuaagugguguuugaacaacccacuaccauagauagauucauuuuaccuuguaaaaaauaaguacuuuaauuuuuuuuuuuuugagacagggccuugcucucgcucugucaccaggcuggagugcagaggcacgaucuuggcucacugcagccuccgccucuggguucaagugauucuccugccccagccaccugaguagcuggaauuauagaugcacgccaccaugccuggccaauguuuguauuuuuaguagagacgggguuucaccauguuggccaggcuggucucgaauuccuaaccucaggugaucuguccgacuuggcuucucaaaggucugggauuacaggcaugagccacugcgcccggccuuuuuuuaauuuuagagacuaggucuugcacuguuggccagcucacuccagccccaaacuccugugcucaagggauccucuugccucagccuccaaguaguugagauuacaggugcgugccgucaugccuggcccuuccuuuaaaaaaaaaaaaaaaaaaggccgggcacaguggcucaugccuguaauccagcauuuugggaggcugcggugggcggaucaccugaggucaggaguucaagacaagccuggccaacguggugaaaccgugucucuacuaaaaauacaaaaauuagccaggugggauggugggcaccuguaauuccaauuacuugggagacugaggcaggagaaucacuugaacccgggaggcacuugcagugagacaagaucacaccauugcacuccagccugggcagcaagaaugaaacuccaucucaaaaaaaaaaggggguggggaaccauucaguguuuuauuaucauguuuagauaugucaauguuuauaguaguucucauuuauuuuuucucuuuuucguaaaucgauuuaauuuguaaguuucaggcaaaaauggauucacugggaauauuaaaauauacuaccuuggggcaggcacaguggcucaugccuguaacccuagcacuuugggaggcugaggcaggaggaucgcuugagcccaagagaucaagugcagccugggcaacauagggaggcccugucucuacaaaaaauuuuuaaaauagcugugugugauggcaggugccuguagucccagcuacuuaggaaguagaggugggaggaaugcuugagccugggagguugaguuuguagcugcagugagccucagugaucaugucacugcauucuugccugggugacagacuaaggucugucucccaaaaaagaaaaaaaaacccuucccacacacccuguuuuggaauaggaugcaacuuaggcccuucuuguugacuuguugaaccgguaaacaauuuagcacuuuuauauuguugaagaaaaugaacaccuacugucuccucuaccuccugcuuacacauaguaugucaugcaggaagucugguuuuauacaguguuucugagacauuuagaguugauaagaauuaugggaacauuuugaguagcauuuuuauguuuuccguguuaccucauuagaucaacauuuuccagccuuucaaagccgaguccccacauugaaaacauaaaaagaauauguaucuuuuauuaaugucaguugagguuucaaaaaauuuauccugaaugcccuaaaagugaguuaaaacagugugcauauaucccaaaauaauuaugcugagugaaagaagccaggaauaaagguuuggauacuuuuaugauuucauuuaaaauucuagaaaaugcagccuaaucuguagugucagaaagcaugugagugguugccuggggaugcagacaaguugugggauugagugauuccacagggacagguggaaauugugggggaguaaagaauauguucaccguccuaauuguggugaugguuucaugggggccuauguaugccagacuuauucaguuauuugguuugaauauuugcgguuuauuggauguguuagaaugugauaaaauuaauuuuuuaaaaauaauagaaacucaugguuuaauaaaaaugaaauguaaaauuacugaucaauuaaguacuaaagacaucugucuuuggggggagaaaacaucgauuauuucaccuuuacaaacuucuuaaugacuucuucuuuuuuuuuuuuugaggcaggaucucacuuuguccccuaggcuggagugcaguggugugaucauggcucacggcagccucaaccucuggacugaagcgauucuccugccucagccucccauguagcugggacaggugcacaccaccacgaccagccaauuuuuuuuuuuuuccuagagaugaagccuuacuucuggccucaagcaauccuccugccucggcugcccagaguguugggcuuucaggugugagccaccauuccuggccaccuucucaacuucuuuuuggcauuucuguuagcauuguugguggguuuauugguauucucauuuuguguaaugacaaauagagaagugagucugcgguugagcccugguuugaguguuucacuguguuguuuaccauuagucucaucauuuuccugauuugaagucauucuuguaggccuuucaaucuaaaauuaccuucacuugcagccgggcgccauggcuuauacuuguaaucccaacacuuugggaggucaaggugggugcaucacuugaggccaggaauuggagauuauccugggcaacauggcaaaacccuguuucuacuaaaaauacaaaaauuagcucggugugguggcgcaugcuggugcgugccuggaggcccagcuacucaggaggcugaggcgagaugaucgcuugaacccaggaggcacagauugcagugagccgagaucacgucacugcacuccuuccugggcaacagcgccagacccugucucaaaaaaaaaaaaaaaaaaauugcauucacuugaaaauuacuugucauggucacuuguauauuucauuuucuuuagaauagcuguuaugcgaaguguaagagacuacugaugacuacaaaugaucaggaagucaguguuuuggguuuaguaguauguagaauaagauuaaauuuuucaacuuuccauacagcuuucugaaacaaaggucuucacugccucaucugcuccagcagagaaucacaucuuaccugggcaaagguaaauacuuuuugccaucuuauauuuguuauucaaagcauuacagaaaucuuuugccucaggaaaaguauuuucauuuuugggucucuuucuauuuuuucccuuuuuauccaaggcuaacuuuuauuuuaccacuacuugguaaaucugacagagcuucaaucauuuucuaauugauguauccacugaugaauuuguuagcaguuguugcagacaucauguuaaacuuuuuuuuuuuuuuuuucuauuuugagacguaguuuugcucuuguugcccaggcuagagugcaguggcgcuaucucggcucacugcaaccuccgccucucggguucaagugauucuccugccucaagccucccagguagcugggauuacaggcaugcgcccccacgcccagcuaauuuuguauuuuuaguagagacaguuuuuccauguuggucaggcuggucucgaauucccaaccucaggugauccgcccaccucagccuccgaaagugcugggauuacagaugugagccaccacaccuggcccuuuuuuuuguuuuguuuuguuuuuuugagacggagucucacucugucgccuaggcuggagugcaguggcacgaucucggcucacugcaacccccgccguccugaguucaagugauucuucugccucagccucccaaguagcugggacuacaggcgccugccaccacgcccggcuaauuuuuguauuuuuaguggagacgggguuucaccauauuggcuaggcuggucucgaaauccugaccucgugauccgccagccucggccuccuaaagugcugggauuacaggugugagccaccgcgccuggccuaaacuuuuuuaaugguugcuauuuucacuuuuguagaccuguuuuuuuuuuuuuuugacagaaugaacuuaauacauuguauucuuugguuucuucauguaccauuuauuuagaucuucugaaacuaauacagaucucuuauuuuauuugaguucuacuaguuuuacucugcuagauuacagaaaaggaaggaacuuaugggauaaccacauucuuagaauguacacugaaacaaaugacugaagagcauuuauuuauauucuaguuuucacacuaaacaccuuugaaagugguuucaaaguguagugaucuggaaagauaaaagacugguuacauaugauaccuuagaaaugaaggcaguuuugaaccuaacaggaucaaucucaugcuaaaugagauggugaugagauuucauuguagggaaauaaaaaugauuaaugauuaugucuuauaguauauuguuuugagauuguuuggaguuuguuguuaaaugcacauauucucuauuguauuuaugauucagugaauuuacugggaucauugucaugaaauucaacuuggcuauagucuauaagggagaggaacucaggcuaggaacuuugccaugugucaggaaugagucuugaauuguccuguaaucugccugucuuauuggcauggugagaaugucaguuaggagaacugaugggaacuggccuuugaaaggauucaauggcauucauuacaagguuagguaauacggugcaucuggcagguccuacuacacuagguaaguuuagaaaagaguugguacaggaaguuuguagcucauuguugucagguaguccaaauuggaauaucugucugggggguguuuuaagaguucugguuaacaguauauuuguuauuauacugugcauuuauuccugaauauuuuaaagauaaaauuauaugggcguguguguguguguguguguguguguguguguauauacacacacuuaaauguauuaugggauagaauguaaaaauuuaagauaaauaugaaacuuggccagguaggguggcucacgccuguaauuccagcacuuugggaggccaaagcaggcagcucacuugagagcaggaguuugagaccagccuguccaacauggugaaacccugucucuacuaaaaauacaaaaauuagcugggcaugguggcacacgccuguaaucccagcuacucgggaggcugaggcacgagaaucgcuuaagccugggaggcagagguugcagugagccagggucacaccacugcauuccagccuugguaagagagugagacacugucuuagaaaaaaaaaaaaagugaaacuuauugaauugcuuacugcaggugaggucuucauucccuagaaauauggauuuauuaggaacucugguuuuagguaauaaauggguaaaauauucuagguaaaaugaaccaaacuugagaaaauuguuuaauuuuacuuuauugcuccagguuuucaaaucaguuuauaauguguuagucauuacuuugaaaauuucucaauacaccuuuugauucucuucucugcaaaacccugcuucagucucuguggcuugguauguucuuuuguguggaugaugcccuccuuuugcccccuuaaaccccauuuuccaaagguucuccucauuugauuuuuaauguaaauucacuauauauugauugacuucucacauucauuuguugguaagauuugcuuaugacugguuccucauugcuuuuugucugcuuagcauugaucugguagccuugcuccagaagccuguuccucacagucaagccucagaagccaacuccuuugaaacuucccaacagcagggcuuuggccaagcccuugucuucacaaauucgcaacacaacaaucagauggcaccagggacuggcagcuccacugccgucaacuccuguucuccucagagccugguaacucacuuuuauuucagugugggauuuuaagaaauauacccauuagcaaauguauucuagaauaugauacaugcuuuauaauuacuuucuaaauauaaaaauaucuacaguaaggccgggcaugauggcucaugccuguaaucccagcacuuugggagcuggggcaugaggauuacuugaacccaggaguuugaaaccagacugggcaaaacucugucucuacgaaaaaagcaaacuaacaaaaauuagcugagugugguguugugugccuguagucucaguuacuugggaggcugagguuggagggucacuugugcccaggaguuugagguugcagugagccaugaucaugccucuguacuccaggcugggugacagagcgagacccugucucuaaaacaaaacaucaaaaaauucuacaguagaucuuaguccagaaaacaaugaugugguaauuuccaagcacauaucugaugauuccauguggaauuuaacuaccugaguuuccuggacaaagauaaaaauuuuuuuaugguuugucaaauucuuugaacugaugaucacucuugagauugaaaguaccccuuucuucugaaugauguuuuccuuguguuuuguuucauauuaugucucuauaguuaguauauucaauuucuuguuuuccaauuaaaugcgaaaguuuaucagaauugacuugcuauaaaaucauguaaaaacagucugagucugccuaggcgcuuacauuuuuugcuuuuuuuucccccuaagaccguaaaauaagcuacauuuucuuaaaaugccaaaugauuaacagaggcccuuauaguuuggauguguuuuuauugaaacagugucauuuaguacuguaugacugacuuccaauguguguuaagcucccauccagaaggaacuucagaaacuguuagugaaggcugugaagauaggcuuauggaaguauaagcuuagaucauagcuuauacaagaauguugcuuuagaauggugaacugaaguuccuacccaacuacaggaaguucugagcuggcaaggggaaguuagaaaggucuauggaugcagaacuacagcucuuacuagggauaauuauuuuaguuuguugcuguguuuuuccugaaauuuauugcugagaaacagaauuuucucccgagucaaaucguuuguuuuacccugauaaaauugagaauugaauauuuaaacuuuuccuuaguauuuucuacucuguguagccauaucauguguugggcuuggggacuugguguuuuuaguaucauugguauaugagguggugucagugcuugaaguagaacagcccaaggcuucucuauuuugagaaggccuaauaaaaacccugauuuuuaauugacgcaccagagucuuuuccuccuccgccuuucccucugcuacugguauaauuauguaaugcccuugcugaaaucuauguguguccacugaauugauaagaaggacuugaguuuuuacagcaaucuucagauauguugcuuuauguagugaccagcaugagaaugaccaacaugagaaggcagaauaagaauuguuuguguggcguuguauuagagcagugguucucgacccuacucuaaucuuuaaaaaucacugggagcugggcgcgguggcucacaccuguuauuccagcacuuugggaggccgagguggguggaucaccugaggucaggaguuugagaccagccuggccaaugugguaaaaccccaucucuacuaaaaauacaaaaauuagccaggcguaguggugggcgccuauaaucccagcuucuugggaggcugagucaagagaaucacuugaacccgggagguggagguugcagcgagccgugaucaugccauugcacuccagccugggcgacgagagaaacucuaucucaaaaaaaaaaaaaaaaaaaaaaaaaaaaaaaaaucauuggggaggccaggcauggcaugguggcucaucccuguaaaucccagaacuuugggaggcugaggcuggaagauuaugagaugccaggaauuugagaccagucuggcaacauagcgaggccucaucuugcuaaaauaaaauaagcugguugucauggcacaugcccuguaaucauagcuacuguaaucccagcuacuugagaggcuggcaugggaggaucacuugagcccaggagguuguucuguggcccuccagccuggguugacagcaauaccuugucuccaaauaauaauuaauaaugaaccuaguaaauaacagcagcaacagaagugaugaugauauuucccaagucucuaaaacaaaacauguccucaucuuugggauugggauuugggcacuguguguguuuguguguaugugcauguaugcacauguguguauuguauacauuuuaaaagucucuccauugauuuaaauguguagguggacuuaagaggccuaugcuguguauuaccuaggacauggcaguagucauugauucagugauuucgcuguguuguaaagcacauagugcauuugauaaaacuagcugaugcauguuagggauuauguaggauaacaggaugaagagagucaucaccugggaagccuucauuaaaucagugggcuugagcuggauuuuugcaaauugguagcaaccucagaccaguguauugggcaaccugaaaaaagaaucuggagcagugauaaguaauguuagcacaacuguuucaguaugagcaaucucugucacagcuguccauaaccuaauguuuuacucaaagcgaaguuaggauuuccauccaagugggacauuccuugucuuugaauguugauaauagaaguaauuguuucaacuuacuugagggaaggcaaaguauuuguuuuugaccuuaaauggauaugaaauguuauuuuugggccaggcacgguggcucaugccuguaaucccagcacuuugggaggcugaggcagguggaucacaaggucaggagauggaaaccauccuggcuaacauggugaaaccccgucucuacuaaaaauacaacaacaacaaaaaagccgggcgugguggugggcgccuguagucccagcuacucgggaggcugaggcaggagaauggagugaaccugggaggcggagcuugcagugagccgagaucgcgccacugcacuccagccugggugacagagcgagacugucucaaaaaagaaaaaagaaaagaaaagaaauguuauuuuugaugaagaacuuauauuucagaaugaucuugauauguaaaaauguaguugaucuuccauugucuuuucuagucauaggcuuucauucucuuuggaucucgaccugacaggacagauggggcaggaguaacauuguuuuuccuguacuuauuuauggaacguauuugguguucuuagucaucuaaacaacuugaaaugaaaauagcagugucuaugguauuugcucaacuucaaauaccuauguaucgcagugucucauuuuggaauaguaaccacugaaguucaguucuuugaccuguauuugaucuugugcgugugugcgcgugcaugcgcgcacacacacaugagagacgagucuaagcucugucacccaggcuggagugcaguggugcgaucucaccuuacugcaaccuccacuuccuggguucaagcgauucuccugucucagccucuggaguagcugggauugcaggcguucaccaccaucccuggcuaauuuuuguauuuuuaguagagacgggguuucaccacguuggccaggcuggucucuaacuccugaccucaggugauccacccaccucggcuucccaaagugcugggguuacaggugugagccacugcgcccagccugaccuguauuugaucuugcagggucaucucacacugaucucuucuuugacuguacaucuuguaaucauuaaagaugaagacugugguucacagacuaggaaaauaauguguuuuuguuggucaagcauaucuuugucauguauuucauggcauuccucuuuaguuuuuuuaaauagugauauuuaauugugaacuuaugacaucacuuuuuauuauuuuauuuuauuuuuauuuauuuauuuauuuauuuuuugagauggagucuugcucugucgcccaggcuguagugcaguggcgugaucucugcucacuacaagcuccgccuccuggguucaugccauucuccugccucagucucccgaguagcugggacuacaagcgccugccaaaacucccggcuaauuuuuuuguauuuuuaguagagccgggguuucacugugguagccagaauggucucaaucugcugaccucgugauccgccugaccuuguaauccaccuaccuuggccucccaaaguguugggauuacaggcgugagccaccgcgcccggccaacaucacguuuuuaaaaauugauuucuucaaauucauggcaaauauuucccuucccuuuaacuucuuaugucagaaugaggaaggauagcugcauuuauuuagucaguuuucauugcauaguaauauuuucauguaguauuuucuaaguuauauuuuaguaauucauauguuuuagauuauagguuuuaacauacuugugaaaauacuugauauguuuuaaagccuugggcagaaauucuguauuguugaggauuuguucuuuuaucccccuuuuaaagucauccguccuuggcucaggauuuggagagcuugcaccaccaaaaauggcaaacaucaccagcucccagauuuuggaccaguugaaagcuccgaguuugggccaguuuaccaccaccccaaguacacagcagaauaguacaagucacccuacaacuacuacuucuugggaccucaagcccccaacaucccaguccucaguccucagucaucuugguagguauacauuguuuguggguuugccccuacugaggacguuucaagcuuuggcagaguguguugacuugugaagacuaauguggaauuuguccagagauguuucuuuuuaguagaacucuugcaguuucucaguuaaaucagucuuccuuuguuauacaauacuugcauuuauuuguuuuuguuguuguucuugauaguuucauuauuguugguaguaauuguggugguaguacaugccuugaaaaguaugguaaaagcaugcaaauaugaacaucuaacacuuuguguaaaugcauggacagaauuuucugagcucucuuagaagaggguggugauagaacauagaauguggaaaacauuuuaagacuuuuuuuuuuuuuuuuuuuuuugagauggggucuuccugugcugcguaggcugaucuccaccuccuggccucaagcagucuuuuaaucucagccuucugaguaacugggauuauagaugugcaccacuguauccagccuagacaauauuuuacucuauuauuuuauuuuuuuuuuuuuugagucaggaucuugcucuguugcacaggcuggaguacaguggcacaguaacgcgucacugccaucuugaccucccaggcucaguccauccucccaccucagccucucuaguaggugggacuauaggcacaugccgucacuccuggcugauuuuuuuguauuuuuuuaaugugacagggguuugccauguugcccaggcuggucuggaacuccuggacuaaggugaucugcccaccucggccuccaaaagugcugagaucacaggugugagccaccacgcccggccuggacaguauuuuaacuaucacacucucaugcuuucucauucuaacauuuugaaguaucaacuaugauuucaucaaccuuuacauuccgugguuuguauuguaaaggucccauguguagacuggauguuuucuaaacuaaacucccacagaaauugugacauuaagccaccauuccccaccagcacucacaugccacacuguauuaaggaauagcaggggauuucauucauuguggagcuggccaugugggcugguuuaugguuagggcauauagagagacagggaagcauauuccucuguucugugaaaugacuuacuguguuggaaguacaugagaccacuccgggguuugaagcgaugucuaccaagggaaaucauuagagacucagugcccaaaguuuuugcuggggcaagaaauguagguacccugugccuacauuuuuugcuauagcacauagcaaaauuacagauuccuagaaggaaagcagauguugagcauaaaccacauuguuuauacagacauucuuagcacagugagccacucuuaauagguuaguguguuggcacccuuugccaaguacauaccagcaguccaaauucucagacauuagccaagguccagucaucaagcaggccuuuuugagaggaauuguaggucccuauauuaacuuuuucugcacacauaacuagugagugauaggacuuuuuagauagaaccaugcuauucccauauucuuuauaaaaccuguguguuuggugcaugccuauaauaccaaguucaaaaaugaaugcgccuaaaccagcucugccauuuguuuuuuuuuaaauuaaauucuguugacacucagcuagcugggcacaguggcucauguaaucccagcacuuggggaggcagaaggaggaggauugcuugagcaggaguucgagaccagccugggcaacgugaugagacacaaaggcuaaaauauuagguuguuguacuaucuggccccauagagaaaaagagggccaaccucugucccauaugguagaacuggcuuuucaaaucaguagugaaaaaacgcuuuauuaaaaccguuugaaaaaugaaguuggaucucuaugccaaaaugccagugggucagauaguuaaacauaaauagugaaucuagaacuauaauagagaaaacacaggagaauuuuuuuguuguucugugugagggagaccuuucuggguauggcagaaaacaccaaauuaggcagacaaacaaugaaaaaaauacucaaaauuuguaucauagacaaaaagaguuaauuuccuuaauauaaaaagaguaaaaauaaagcagaucaacaaacagguuaaaaaacuggcuaaagagauaagaacagucuauaaguaaagaacacuuaaguauaugaaaugauacuuagcacauuuguaucauuuuaguuuguauuuuuuaauaccauuuuccaccaauuaaaccaggagauucaaaaguguuugauauuagaguguguuaaaaaggauguguucuaucuguggacaguaauuuuauaauauuuaucaaaauucaaaauauauuuacccugugaaggggcaacuuuauccuaccaguugauccuacagguauacuuguacuugcacaaaauaucuuacauacaaauguauucauuagugcauugcuuuuaauagcauaagauuugaccuaaaaguccauuaauauaguacugguuuuauaaaaugauaccuauguguacuagauuucuguguagucaccaaaaugaguaugaaguagcucuuugaacauuaaugugagacacucaauggaaauuaaaugauuugugagacaguaagguauauaguguguguauauauaugucugucugucugucugucuauauauauugugauauaguaucucugaaagagacauucaggaaaaccggguacaguguuugccuuuguggagcaaguaugggagagugguguggaagagaaacauaauauucgucauacauauucuuguaucuauuggauuuuguuuuuuguuuguuuguuugucacccagucugucacccaggcuggagugcaguggcgccaucucagcucacugcaagcuccgccucccggguucacgucauagggccugccucagccucccgaguagcugggacuacaggugcccaccaccacacccggcuaauuuuuuuguauuuuuaguagagaugggguuucaccauguuagccaggauggucuugaucuccugacuucgugaucugccugccucggccucccaaaguguugggauuacaggcgugagccacugcgcccagccaucuuuuggauuuuguaacaucauauauauauauauaucaauuaguccaaaaacuuaauaaguuuuuuuuuuuuuaauuuuuggaugaagacauggucuuguuuugucauccaggcuggaaugcaguggugcaaucauagcucacugcagccuuguacuccugggcuaaagcaauccucccaccucagccucccaaagugcuggcauuauaggcaugagugacugugccuggcucaaauuuuuaacaguuauguagaaaauccauaaaauaauaaaaguaugauucucuguuagcuaauggucagguguguauagcaccauaauauuguucucacgaguucaucacucccuaugcuuaaacauaaaccaaaucucucuggauaggaaacaagguguguacccauuuaggaacuuuucccguuuaucauaaaugaaguguuacacauaguguguguaaaaccuaagaaauucaacuggaaaugauuuggagaaauuggugguaauagaacacuucauguucuauugaagaacauugugaagccauuaugccucauuaauugcugcuuacuuuuuuuagacuucaaaucucaaccugagccauccccaguucuuagccaguugagccagcgacaacagcaccagagccaggcagucacuguuccuccuccugguuuggaguccuuuccuucccaggcaaaacuucgagaaucaacaccuggagacagucccuccacugugaacaagcuuuugcagcuucccagcacgaccauugaaaauaucucugugucuguccaccagccacagcccaaacacaucaaacuugcuaagcggcggauacccccagcuucuaaggugggcauuucaucaugaagucaccguccuaaagcuggaauuauuuuuacauucagcucuagugggauacuaaguuuuggaaacugggguacaguguuuuucaagcacauagcuuauugauugcauaauaaggauauggccauuucugagugaccagacuaguauuagagggaauggguuugugcugagagccacagauccuuauuucaaguacagauuugaagaucuggcucagagaacuguuguucuugaggguuuugcuguaucccauaguuggaggaugcaugguuccuugaccaggugauacuuucaucauuggugaguccccaaaaauagaguagucagcucaguguucacuucccacccaccaucacaacucccccgcauugcucuuagaugcagguggugauauuaaugccaaccauuccuguuuaacuuuuaauuucuccuuuuuuuuuuuaaaugagacagggucucgccguguuguccaggcuggucuugaacuccugggugcaaaugauccuccugucuuggccucccaaaguccugggauuacaggcaugagccaccaugcccagccaacuuuuaauuuuucuuagcuuguuuuuuuucuuucucuuuuuagaaaagucuuagccuauuuucuccuuguuucucacuccuucuucuugccaguauugccugggaaccuaaaugcuuguuuggcucuguuauaggccuuugugaccuggaaucugugaccucuguuccugacacgacagcuuugcuuuuucagaucccagcuucugcaguggaaaugccugguucagcagaugucacaggauuaaaugugcaguuuggggcucuggaauuugggucagaaccuucucucucugaauuuggaucagcuccaagcagugaaaauaguaaucagauucccaucagcuuguauucgaagucuuuaagguacugaauuuaguccuuuguuaugaagcaaaauagacccuaagagagaucaacugguggaaaagaauacauccugugguaauagcuauccucaguguuuauccagaccuuccaucaucuccauaagaaaccccauaccuguagcagacagucucaguuucuucauugcccugccccuuagcaaccaauaaucugucucuggauuugccuaccuggacauuucauauaacuggaaucuuggaauauguggccuuuuaugucugaucuuucacuuaguguaaguuuucgagguacacccauguuuaauguaucauuuuuauugccaaauauuucauuguguugauaauaccacauuuuauucauucauuaguugguggacauuuggguuguuugcucuuuuugacuauagugaaugaugcugcuauggacauuugguuucaaguuuugcaugcuuucaguucuuugggauguauaucccaggaguagaguugcugagucauaugguaacuuaaccauucaggaaacucccauacuguuuccacuguggcuguagcauuugacauuccuaccaguagucuaugagggaucuaauuucuccacauguuugcagcagucauuuuccuucaguggaauauuuuauaaauacaaaaucucagauuuuaguuuucuuuucuuuucuuuuuuuuuuuuuugagauagggucuugcucuguuguccaggcuggagugcagcagcaugcuuggcucgcugcaaccucugccucccaggcucaaaugauccuccugccucagacuccugaguaucugggauuacaggcgugcaccaccaugcccagcuaauuuuuaaauauguuuuguagagacaggguuucgucauguugcccagacuggccucaaacucuggagcucaaugaaucugccugcaucagccucccaaagugcugggauuacaggcaugagccaccggccuggcugacuuuguuguuguuguuguuuuaguuuuuucacauuccagaggcaaaaccugauauuuguuuaaguuuccuuuuuaaagauggucucaaacaccuggauuccuuaaagaaucuucuuauuuuuuuucuuuuuuucuagacagagucuugcucugucgccaggcuggagugcaguggcgcgaucuugguucacugcaaccucugccucccgaguucaagugauucuccuuucucagccuccagaguggcugggauuacaggugcccacugccacgcccugcuaauuuuuguauuuuuaguagagacgggguuucaccauguuggcaaggauggucucgaucuccugaccuccggauccgcccaccucugccucucaaagugcugggauuacaggcgugagccaccgcacgcagccuaaguauucuuaaagaugucccccuaucucucaguuaaauuaggugggucucauuugggauaauaaauugaugcaguaguugcaucucgugaagcuguuuauguuuuuuuuuuuuuaugaagcuauuuaaaguaacaaaauuauguugaauauuuuugacucuuuucagugagccuuugaauacaucuuuaucaaugaccagugcaguacagaacuccacauauacaacuuccgucauuaccuccugcagucugacaagcucaucacugaauucugcuaguccaguagcaaugucuuccucuuaugaccagaguucugugcauaacaggaucccauaccaaagcccugugaguucaucagagucagcuccaggaaccaucaugguaagugguauuuuaguuuuuuucucagaagauguccgucuuauuuggaaauuaauguuugguuaaauuaugcuucuuggauaugauuuuauuuuacaaauugacuaaccuuuugaguagaauccuuauaguucauugaguuuguuuauagugggcaucucuagcacccaugcucuugaguguguggauagaucugcagguucauacacuuuguggagaaaaccaagcaugcguguaguaugagcacuuuggcuguaguacuggguacuucuacauugucugaaauaucucugaauauuucauguacugcuuucucucugauugccccauuugcuuugaauguauuugcuucuucaucacuguuagguauuuuuguguuaaaauuauguauuuucuaccuaguuuuuguuaauaauacuggacuauagauaaaggaaccagaucuauuuuugauauaguuuuaaaguuuuacccuucuagauucuugcuaacugcauaucugauggucauugccaguuguauugcuuucuguuaaguugagauguaccaauaucuccugagaaucuuagaaagaaacuuaaaaaagaacaaguauacacauuucaugucacacuaguaauacuugaacaucauucugucccaggaaauuaaaauaauauggaugacacuacaggcauaccuuggagauacugcagguuguuuuauaccacugcaauaaagaaaguugcgcuaauuuuuugguuuccuagugcauauaaaaguuacaauguggauaucuuaauuaaagauacuuuauugauaagaaaugcuaaaaauuaauaugugagcauucagugugagcaauucuguggauuguuuguuuuuugggggaguacagguucuugcuuugucacccagguuagaguccaguggcgcgaucacagcacacugcagccuugaccucccgggcucagugaguccucccacccuagccucccaaagagcugggacuacagacaugcauugccaugucuggcugacuuuuguauuuuguuuagagacgggguaucaccauguugcccagucugaucuugaacugcuggguucacgcaauccaccuaucuuggccuucuuccaaagugcugggauuauagggugagccacuacacugggcucuuuguuccuuuuaucacuugacauuauuuuguaaauaugacaugauagcuuaggauuucagcucaacaacucuguauguccaagguuucugaguaaauuuuuaagccaacaauuuuuauuaacagugcuggaacuugauaauccuaugaguaaauccaagcccuugccccacaagaaccccuccuaggguguauacacccucacacacacauuugcagcaucuuacuugguguaggcagcugagaaaaguauagauaugcuuccaguuuaggaagaagccuuucuagagccaaagaaacgacacuguggugguucccauauuaaaucugccugcaugcauccgaugucuuaacugcauuugaauuaaggaaucuugucgucguggccuucuuccuccuccuccuuuuuuucuucuuuuucuuuucuucuucuuuccccucucccucucccucucuucccucucccuccucucccucccccuccucuuuccccuccuccucacccuccucccuccuaccuuauuuuuucuucuucuuccuuccuucccucuuucuucuucuuccuucuccucuucuucuccuccccauccuccuccuccuccccuccuccuccuccuccccuccuccuccuccucccccucccccuccucccccucccccuccucccccccuuccuccuccccuuccuccuccccuuccuccuccccuuccuccuccccuuccuccucccccucccccucccccccuucucccucccucuccuucucuucuucauuuugauacagggucuggcucugucacccacugaagugcaguggugugaucacaacugccugcaaccucagccucccgaguaguggggacugcagacacaugccaccauaccuggcuaauuuuuuuguagagaugggguuucaucauguuacccaggcuagucucaaggaaucuugucuuauaaagcacacaaauggcugagagcauuaaaaacacauaggaaucugggcgcaguggcucacuccuguaaucccagcacuuuuggaggcugaggcaggcagaucaccugagaucaggaguucgagaccagccugggcaacauggugaaacccugucucuacuaaaauacaaaaauuagccugaugugguagugcgugccuguagucccagcuacuacuugggaggcugaagugggagaaucgcuugaaccugggaggcggaggagguugcagugaguggagaucacaccguugcacuccagccugggugacagagcaagacuccaucucaaaaaaaaaaaaaaaaaaaaaagacauaggaaaucaaauaauguuauuaagcuauguuuucugagauuaugccacucuaccucuaaugagacauaaaaucacaaacaggaauagaaucuuggaacauauaaacugaguaaaauggggagcuuuccauguuuugucuuuucaucauucccuucaacuaaacauuuagaaaaauauuugugucccuuguccgucuuggauggaucauccucccuuccuuuuucucuuccccuuccacagccuggaauauccacagauuaaaauuaccuucucagagaugcuuugacagaaauaaguuagagucuauauccugacagaugggcacugaaacaagaaaaaccaugugaacuauggaaauuucaaugacaagcuuuuuuuuuuuuuuuuuugagauggagucuugcucuguugcccaggcuggagugcaauggcgugaucuuggcucacuccaaccuccaccucccggguucaagcgauucuccugccucagccucccuaguagcugugauuacaggcacccaucaccaugcuggcuaauuuuuguauuuuuaguagagacaggguuucaccauguugcccaggcuggucucgaacuccugaccucaggugaucugccugccuuggccucccaaagugcugggauuacaggcgugagccaccacgcccggccaaugacaagcuguuuuuguuucaacauaaguuuuugagaagcuuaucguguaacauuucuuacauaaucuaaacaaucauguugggcugggcaugguggcuuaugucuggaaccccagcacuuugagagguggaggcagguggauugcuugaggucaggaguuugagaccagccuaagcaacaugacaaaaaacucugucucuacaaaaaauacaaaaaguggcugggcgugguggugcgagccugugguccuggcaauuugggagacugaggcagguggaucacuugagcccaggaguucacaaccagacuggacaacaugaugagacccugccucuacaaauaauaauaauaauuaggugugaugguacagaccuguagucccagcuacucgggaagcugaggugggaggauggcuugaaccaggaagcggagguugcaaugagccgagaucacaccacugcacaccugccugggugacagagccagacacugucucaaaacaaaaacaaaaaaacaaaagaaaccccccaaaacaacuauacacaauguaguuguguguaauguaguguguguaaauauauguaucuauuuuuugagagggagguuugcuguuguugcccaggcuggagugccacggucccggcucacugcaaccucugccuccuggguucacgugauucuccugccucagccuccugacuagcugggauuacagccgcccaccaccacaccuggcuaauuuuuuuuuuuuuuuuuguauuuuuuaaauagagacgggguuucaucauguuugccaggcuggucuugaacuccugaccucaggugaucaacccaccacagcugcccaacgugccaggauuacaggcaugagccauugugcccagcuuaauuuuuuuuuuuuuuuuuuuuuuugagacagagucuggcucuaucgcccagugcaguggugcgaucuuggcucacugcuaccucuuccucccagguucaaaugauucucuuuccucagccucccgacuagcuagaacuacaggugugugucaccccaccuagcuaauuuuuguaguuuuaguauaggugggguuucacuauguuggcuaggcuggucucgaucuccugaccucaaaugauacguccuccuuggccucccauagugcugggacuacgggugugagccacugcauccccugucaacuugauacuauguauucucaacuacaugcuagauaauuuuacuuauuuacaccccagacgcaguuaaauugaaccuuugucagacuuuucccucuguauauugcuacuuguugauuuuccauccugguuuuagacauuaguucuugaugugcuaccaugcaauauaauuuucacuuuuuuuuuuuuuuugaaucaccaccagucucacuuuauuuuuuagaaagaguuuguguuggauuguucuccuuccuaccuuaaauauuuaguagcauucaccaguacagcugucugggccagaaguuuucuuugcaaggaguuuuguaauuguaaauucaauuccuucaauugguagagggcuauucagacuguuuuuuuuuuuuuuuuuuuuuuuuuugagcuggaguuuugcuacagugcccaggguggucaugaacuccugggcgcaagcaguucuccuguuccagcguucugaguagcuggauuacaggugugggccacugugcuucaguuucuuuugcuguuuguguaugucaaggaauuuguccauuucaucuaaguuguuaauuuacuggcauaaaacuucaauguauuucuuuccuguccuuuuaauguuucugagaucuauagugguauugucuccuuuauuuauuuauuuguuuuguuuuguuuuguuuuuugagauggaguguugcucuguugcccaugcuggaguacaguggcgcaaugucagcucacaugguggcucacaccuguaaucccaacauuuugggaggcugagguggguggaucacuugaggucaggaguuugagaccagccuggccaacauggugaaaccccaucucuacuaaaaauacaaacauuagccugguguaguggugcgcgccuguaaucccagcuacuugggaggcugagguaggagaaucacuugaaccugggagauggaguuugcagugaucuaagaugcgccauugcacuccagccugggugacagcgcaagacaccaucucaaaaaguuaccuuuaaaaaaaaauuauuugggucugggugugguagcucaugccuguaauccugugcuuuuggaggccaaggcaggaggauugcuugagcccaggaguuggagaccagccuggucaacauggcaaaaccccaucucuacagaaaauacaagaauuagcuaggcaugguaggaugcaccuguagucccagcuccuaggcaggcuaagggggaggaucaccugaaccuggggaugugaaaaaaaauuuuuuugaacauuuuuguucuugcaugagaguuuguuguuuaucuucccuuuauuaaaaaauagaauaaaagagauaauuguuucuugauuaagcuacauguuguagaaaguauaaaaagccacucagguaaugauuucauuuuguaaguuuauauucucuucucuucuuuuccuuauagaauggacauggugguggucgaagucagcagacacuagacaguaaguauagcagcaagcuacucuugucauggcuggugccaaccaaacagaggaagaggauagcucacgugauguggaaaacaccaguuggucaauggcuuauucguuaaaaagcagcccuuuugcuuuuuuguuuuuggaccagguguuggcugugguguuauuagaaaugucuuaaccacagcaagaaggaggugguggucucauauucuucugcccuaaucagacugcaccacaagugcagcauacaguaugcauuuuaaagaugcuugggccaggcgggguggcugaugcccauaaucccagugcuuuggggggccaaggcaggcagauugcccaagcucaggaguuugagaccacccugggcaacauggugaaacucugucucuacuaaaauacgaaaaacuagccgggugugguggcggcgcgugccuguaaucccagcuacuugggaggcugaggcacaagaaucgcuugagccagcuugggcuacaaagugagacuccgucugaaaagaaaaaaaaaaaagaaagaaacuacuucuaaaucaaaaauuuacuauucuuguucaggaaagauaggcucauugucuuuaggaccugaaggacuguugcuuagaaagagagauaaauguucacuguggacauuugggagaaaaugagaccccccccccccgccacuuccaacagcucagugauuaccaaagauagugcagguaaauccguuaauugcuucuuuucuguaguuggccagcuugacugaugguuuauaguaguuuucuuucuuuauucaggaaggcaaauggguggggaagccagaaagacucuuuaaauaggauuuccugggagugcggauauugaacuuaagcagaccgaggugagccucaguugaaacuguaaugacagauuuggagccccaggauuuugguuugacauuugcugguauuguugggcugccaaggcuguuuggagauucguuggucguucugagcuuguuggaugacagaggaacuuuugacucuagcagugguaguggcagguuucuuuugucuaggcaugggucgagaacuaaaguaucugggaagcaguguacauuaaccuacuuuucauuucccauacucucuucucccucacuuccuccuccccuucccuccccauuuuguuuguuuguuugagagaggcuuccugugaagcuguuagcaucauaauacaaggcccagggcgguauguuuuggggucuuaguuuuaggugagguguaucuguggugucuuuauacaguuuaucuaugaacaagguuuauauauggaagagacugccaauaaaaagaaggccucuguaagaacugaccuagguguaaguugacccuuucauugcuuauguuuguuuuugaccugcccuuccuuuagagacucaagugcuuucccuggguuuuagaagggucaagguugcuccucuuuccuaacuggaaaagacaaugauguuuuauuuccaagcacauaucugaguuguauguguggacagcacugagacugagucuuuccacagcuaggacugagugucuccacauccuuucugaagccuacgaagcucauuuaugugcucugagauacaucuauucaagcacauaccaaggaaaugcucacugugcauuuggaaguagguguuggacaguuggacugcagauguuaggugucugugucucuccacaacauaggcaucaaccccaaucugccuuacguuggccgugagcauugguagagucagccugacuuggcggaagcacguguagguggucuugccuguuagcuucuuacucccccuugcugugcccuuugaggaguuugccucacguuauaauucuacauauuaggcucagcaccuguuuuucuuucuggaugcaucuacagcuuagguuccuuuaggugugaaaaguauguccccauauaggauagguuggguuauaaaggugucauuuccuauucuuugcugcaucuugaacagcugaccauggugugguguccuuugauaguguuguuugacagacaaagggcuaucuggcgauaugcuuggcauuuuccuggggaauguaacuuuauggacgucucaacugaggcugacaugucacaagauauugagcauauuuucaggcacuuaggauugguuuuagaaauaaacagaucugcuucuuacagcuacuucaucuguuccagcuccaaagacaacaggcccucccucugcccucccgucugugagcucccugcccagcaccaccuccugcacugcacuucugccguccacaucccagcacacuggcgaccugacuagcagcccucucucucagcuuagcagguauggggaaggugugggcccaaagugagaaguaccuuggggcaaguccuggagcuccuguagaagguugcuuucaugaacagagcacacuuguugucucugacgugauguccugggcuuuugcauuacgacuguagcuuagguuuuggccagguuguuccuuaaaaccaccagauauggaaaccuugccugcuuguaccgccucugcuggcacagagcacuggguccccugggaguagggugaggccagcagcucccuccuaccugucuucacccuccagagggugccugagccuagccucucugggcaucgcugggcccaugucacugagguggaaugagaaugauggauuucugagcaggugucugacuugaacuuuccauggcugaagaaacgauguuauuagaacaagguguaggaaaauggguggcguugcuaccugugucuucugaggaguguucuccaucacucuuuagcuaggagcaaaaguggauuugaugggaauuggcauguggaguugagcauaggaacuuugaucccucguucacagauugaaugggauugucaaggaugaccguguucuuagugcaacucugucuucacuuuucgcaucugaggagcaaauggaugucguugagggaagcuggcucuggaguuuuccagaccucauggcgagucauucccguccaccaggaccccaucacugggcucuguggggauaaggaaugaggaugggucugaagccgguccugugcuagggacuaugauaaguuugaaucuagcucacugacccacgugcgucuuguucaucuggagucacuuguucagguggacauacggcgcucuguuuugucuucuaguucgcucuccagccaccagagcagccucucugcacaugcagcccucuccucgagcacgucacacacaguaagugucugcgcggcuuccucuuccuccgccaugcuuggggagccuggagcuuagucacaugcagcuggggcuucagucugauuuuuagugucugauaaucuagaguugcuuggcugaaaugucuugauggcaugaucugguucgagcuucugauuuccugggcaccaucuggggacaucuugcuuucuaaguuuguagcgccugggaagaaucauugcuccagaccuuaucugucauuggcaggagugucagguggugaccuugcucccaggaauuugcuguuugaucuuuccucgugccuucuuuccugacucagacgcagagauugcaagaaggucaauguuggagaagggagucuagaugguggagggcaggaguggaagcaaacaugcacugccgagaagccaggcaggagggcuggagucggcgcgccagcuuuaauuuuccucauaugccaaagaguagcccuagauuaugguuauugagguguggcucagugggucguggagccgugagcauggcuuucagugguaggagucagccagauugugguggguugcggagugaaugguagugagauggagaggagggaggaggauuguagagggcaugcaaugaaaacuuaagagaggcuggagccucuauugggaggauagaaaggugccuggauuaacaaaaagugcaugcuccuggacaacaggagguguugggcgagguuggaguaggcagguccacaggcugggaggaaggauuagggugcagacgaauggaggaggcaggaaacugaugaacuugguguccucugaagaagacagcagcucaccagcagagugaggugguggaaaagggacauccuguccuuuccucuggaucuggcuaaugcuguggcuuucauacucuaguguuccaagucaaaccuuacacagaaucuuuuaucauaaaacacacaaacugccacuuucaaaggagagcauaguguggacaccucugccugucccucugccccugcccucuguggcucaugggaguggugagcugaccucagcaggagugccguggagcuguccucuguguccgugccacugcugccugggagcccagugcuccugcacucauggggagcugcacucuccaucuccucaaaaaaaaaccuccagaccauguauuccagccugccacagccagaaucgucucauccagugggucccauacuuugucagcaugacagaacugugacauugcuaauacaguugucccuccauauaugcaggggauucauuccaggaccacugcauacaccaaaaucugcacauucucaagucccacaguugccccuguggaacccaccuauaggaaaagucagccuuccaaauauggguguuuucaaauuauguaugcgugcauuggguugaaaaagaaaucugccuguaaguggacccaugcauuucaagccuguguuguucaggggucaacuguuuguucauaauauuucaucugaaaaguuauggaaagauagacaaugaaaaguuuuucugucucucaucuacuuggcucuacccuuacauuuucuccauccuuuuaauaaauaaaagucaaaacacgcagugcauacauguagucauuuccccauuaucauccgcuuuuuuuuuuuuuuuuuuuuuuugagaugcagucucacucugucgccuaggcuggagugcaauggcgcaaucucagcucacugcaaccuccacuucccggguucaagcgauccuccugccucagucuccugaguagcugggguuacaggcgcauaccaccaugcccggauaauuuuuguauuuuuaguagagacgggauuucacuauguuggucagacuggucucaaacuccugaccucguaauccacccgccucggccucccaaaguggugggauuacaggcgugaaccaccgcgcccggccaucaucugcccuuuuuauucuuuuucucuuguuacauaaaugagaguauuuuauguacaguguccuucaacuuuuuuuuccccacuuguguauccccacaaguguaucuugauguuuccauguugaaacuuaaggguuuuuuguuguuguuguuguuguuuccccacaguucugcuuuaugauguuauuuaagguuauuuaagcagccguccauuuagggucguuuucagucuugauaccacagagaauguugcauuugauaaccuacauauguuguuucauguguauagcuguauguagcgggucaguacgugauguggaacagcaaggcauuuaugauuuuauacacauuugcagauugccccgcauagugauucaacccuguuuaccucccacuggcggugaaugaaauauccuauuacaccauggcauccucaaaaugguguuauuaaacauuuguauuuccuuaauauguuagcagaaaaauggcccaucagucuaguuuuuaaugagguuguacauccuuuuuuuuauauauuugaaaaccauuugauuuccuuuaugugaguuuuuaauuuuuauuuuauuuauuuauuucuuauuauuuuucugagacggaguuuuacucuuguggccuaggcuggagugcaauggcaugaucucagcuuagugcaaccuccaccucccagguucaagcaguucuccugccucagccucccuaguagcugggauuacaggcacacgccaccaggcccagcuaauauuuuuauuauuuuaauagaggcaggguuucacuguguugaccaggcuggucucaaacuccugaucucaggugauccaccugccucggccucccaaagugcugggauuacaggcgugagccaccgugcccggccuaugugagcuauuuauauucuugguuccuuuuuuugucaggucuuuggucucuauuucuauauuagggagcccuuggugaugggaaguacagguauuuuucccuaaguuugcuguuuaugauuuuuuuuuacauagaucuguguauuuucuuccauuuucuuguaguuauaucuuuaccacucuccaucaauacauaaaggaaaucuuagcaucuucuccugccuuuacuucucugggccuguccuggggaguugacugcauagggcccauuggauggacugagcgaagccuugaaaauuaguguugacuuuuuaauucagcagguugauguacucccaguucuggaagaugagggccagagacaggaacccugucaggcagcuaagggagaagagacuugccagaugacucuugagucccuuucagcaagucaggaccuaguucccuagugagcaucucuuagcgauggagaauguucauuuuuccuuccgagauuaaaagguuguauauauccaaguacacuugcgagcacuggucagagcugcuccagauuucuguggcaguugguggggagucugccuccuuagugagaaccuaguuggugggcaggccagugcauccuuuggcccgcuccugguggggcucucuccggccugguccugcccaucugugcugaaggaacaagacgccuuggagccccaggaaaccauguuuuuggcugucuuuaccuuggugaaucuguucuggauguuagcucuguaaagccagugcccaggcggguagugaccugugggcaugggauggcggcggagaguuagucugcgcaggcagguuggguccuucuccugggcccuucccguucuuuggcuuuucuucuacgaguuuauaugcugcuuucuauguccugguuuggagacuggucucccucuuacagagcuuuucuucccuuuuuugagacuugccuuguccaccuaggugugccccccaccuaccugcucggagcuugaaguucuucauaggacccuguugcuaggguugggcagcuaggcagggcuucugggacucggggcugauggagcauccgcugguucacucuuucuucacagggguaccuugucaaacaggcauaaguggcaggccaugcccuuuuaggugggcacuggugaggcauugguggacugaaaggugucaccagguuuuggagcaaaggccucucucagccuccuguuuccagaccacaguggcugagaaucccaauagaagggaaaucuccaaaagauugagacuuacgcugggcuuccuguggccugugcucgccucuucucagacuguuugcuuugcucugagguagguacuugucccauauucagauagucuguguucauuuaugauccgaaguuaucuugggauuucuaugcccucauuuuggaugccaagcaugagcaacuugaaggauuuuuacagagaguuguggucauuaaagcuuaauguuaauaguuuugauguucaguuuauguauuguauccugauggcuggaaccagcugcuaugugaggggccgcagugagcacugagcacagagccucucaccuuaagggagccugggugguuacaucauugccugccugcucagccuugagacuugggcccaagcgccaggccaggcucuccccagcacccuccuccucugccuccagauccauguguccuggcuuuucuuuugccagcaugccaguguggagagcgccucuucccaccaguccucagccaccuucuccacggcagcgaccuccgucucaaguuccgcauccucaggcgccagccuguccaguagcaugaacaccgcgaacagccucugucugggugggacccccgcgagugcauccagcagcaguagcagggccgcgcccuuggugaccucagguauuugcuccagaggccuuuccugcccaccccugagccccucaaaggugccugcuuggcgucccaggaaggcagugcaggugucaggagagucucaggcccgccgagugcgcugcguguuccacugaccuugaggcccaaucuccccaccccugauggggaugaauucuuccuugcaggauuccuggccucugcgugcuucuagcuuuucagucuuuccucuuuguucuuuccuggagccgaguugacauugugacuuggaggggccagggaugacuuauggugggcuccacgacugcagaccuaggcugucuguaggcccagcagacuaugauuugauggucgcugcuaaaaccgacuucgaacucagccugucccucuccuggcacugcauggcuuccuugcccucuuuggaggaggcagauucuuuuuauauuucucuuugcucagugcagugggaccuuagggacugggggaaaggggcugcuuuugucugggcccggaacucucugacguugaaacaaccucagugugguggccgggcuuucugucuccccuucacugcuuuguagaaugacccucugccucauucggccacugcccuucuuugaacccaucugggguagcucagugacugugccuccuccugaagcagcugaggacucucacucuuuguggugaccauuucacuccauuugauuuuucccucuauacaggcaaagcacccccaaacuuaccucagggggugccuccccugcugcacaaccaguaccucguaggucccggaggacugcuuccugccuacccggugaguguauggcggaacuccuggccugcccagcuccccuggccucgggggcuggcaccuggcaggaaccuggcguugggcccagguugcccaccuugagcugcccuuccaucccugagcacccccgucucugccccacugagcccugguggucuucuuccaucuagacuccgugaaggcaggaucuguucccguaacagcuaauccagaucccauucccggguguguuagagccccccaaccuuguuuugacuccuagauggaccugggcuucccagggugugguaugugguuccuaaaauacacuuucugguucucacacagaucuauggcuaugacgagcuccagaugcugcagucacggcugccaguggugagugggguauggacuggucggagcagaggguucagaaucuuuuacauguccccccucuuauggucuuggcugccacacucucuggcccuuaggauccucugccugaggaaccucucagcaccacuacugagaaagcuguuuucaucuggcgguugugccaggcgugaccauagcuuuagcacagaguauccagugcucaucccugggaaacaugaaggccuuugggaccuggggcccugguaggccauguccccuguuaaauguugguccuuaucuucccuccuccaucuuguuuucucucucuuuuuuaaaaagaaaaaccauaugacacaagacauggagguugcuuacguggcccuggaguuuuauacugucuuccucuuccucagaguaccauauagugucuuuggucugagauggccagugacugcucuucugcaaucagcugagugaguggcuugagcugauggucuuuaaggucucuucugggucuggccucccaucuagauuugugagaaugccugcccugggacgucccuggugguugcagccuuacucugagaccaggguugccucuuucuucugaccguuggugccagaaugcagugugggccuuuccugggauagccacaugaacagaacuguggggacagaggggaauaggcccgcuccuugcccugcccaugggcaggacuuccuccugggagccacugucuucuugcucugccauuucccagggcacuugucagagaguugcaggcaguuuggacaccaccucugcuggauacagucuuuccuguugcuggaggaagaggcuuucucccuugugcagugaugccuucuuccccguggguguugcucccuucucugcugcaccacaaagagcugacggagcugcucuuguuucagaagaguagcccuuuccacuggcuggccguauuuccagaagcagaggccuagccugggagcggagcggcuucuccccacugugcaaaccagcagcccuuuaaucugccggccaaaggcccaaacugcaggagguggugcugagccccgggauucauucugcuucaggggcucuccguggucuccacacuuauucacagcacucuuuuggcuuuuaucacuuugugccuuagagaaaacacccucuggagcccaccuuuugagauauguugcucuuucuaucccucggguuguuuguucaccucugcugcuugugagccuaguuccugccuggagaauucucguguucugugaaagugcucccccuucugggcuuucucugcucccguccucaguugugcagcucuguguguucccagcucugccucuuccggggguucuaggcugcuauggguuuccgggagguuuccuggagggugugagugccauucccagccaggauggcuccuuucugggaucgggcacagcccaagggcuuugccuuuccucaggggccagguguguccaggagugcgaggcccuggauggugagugagggucaggucagaccuccccuccuccacgaagcuccacugugcuuugccgucucugucuccacacuuuguuguaucugccauacuucccccaaguccugggccagggguguccaauguuuuggcuuccuugggccacauugaaagaauaauugucuugggccacacauaaaauacacuaacauuaaagauagcugaugagcuuaaaaaaauugcaaacaaauuucauguuuuaagaaagacgaauuuguguugggccacauucaaagcugucaugggccguggguuggacaagcuuguccuaggccaugucaguguuuugagagcaguguagguggugacaggccaguucugggcuucaccugggguccugcuuauucccgugccuaccuggcacugcccccuguccccccuuaaaccuuucaggccccugcacuucuguugccuccuuuuucaggucugcucuguuuagucagcuuuccuagcugcucuagucucucacacagaaaagccagcgaaguugguucagcccgaggcauucacacaagcaccugccuguggugucaaauggaugugugaggcuuggucuccagcagcucugccuggugaagcugcaggguuggccggucugugugcuuauguguuaggcaggccgccuaguugcacacucuuccgaggggcaccauuuacuuggcguucccugggacugcuggcucucaggcauggagucuguuucaggaguguggcgucaccacuuccaugugcugguucugcucuccugggagucaagcagggccagucgcugaucaagccucccuggucucuccuaggacuacuauggaauucccuuugcugcacccacagcgcuugccagccgagaugggagccuagcuaauaauccauauccaggugaguuugcucaauggaugaggaguagcccggggccggccuagcgcgaacuccaggagcugggaagcagcaacagcaagcugagagaggccucuuaguagccugugcugagcuggcagccagaccuguuccuguuugcagaagccaguguggccuuucucugguuggaggaagggcaguggcuggagucagugcucuuuccuaggugaugucacaaaguuuggccguggggacucugcauccccugcacccgcuaccacaccagcucagccacagcagagccaaucacagacccaccacacagcccagcagcccuucgugaauccugcacugccaccuggcuauagcuacacuggucuucccuacuacacaggcaugcccagugccuuccaguauggccccaccauguuugugaguauuucagagggugugacugugucuccuggccuuggguugcuggcagguggaaaccugggaccuaucuuccagcagggagggaggguugugauuccacuccgucuuaccuggucuucagaaacuguucaggcuggggacaaggucacuuuuccccugcuguguuuagauccagcauguguugcacuaaugaaaacacagguccccugugguuguggguaugucaccugcugccuuaggcucuggcagggguaccugaccagccucagcuugccucuuccuacacuaauaccucaucugcuugcccccccaggucccuccagccucagccaagcaacauggggugaaccucagcacucccacaccucccuuccagcaggccagugguuauggccagcacggcuacaguacaggugagggguacuucccagacagagacacaugggguuagacaggcuugccuggcucacacuugccucuuguacccugccacgcuagguuaugacgaccugacccaggggacagcagcaggagacuacuccaaagguggcuaugcuggaucaucgcaggcaccaaacaagucugcagguucugggccuggcaaagguaguguuuaccucuccuuuccaggauaaggccuggaguggugggcuccugccugauccccucucaggcagggcaaccccugagugauccuggagguggggagccuggagcugggaacaacugcuguggggaacaacugcuuuuccuccuaggaguaucagugucuucaagcaccacuggucuaccugauaugacugguucugucuacaauaagacacaggugagggacaaagguggguuggguguauagguuuuugagagguuacagcccaaccugaccuucaccauugucuucuuugcccuguagacuuuugacaagcagggauuucaugcagggacgccuccaccuuucagccugcccucggucuugggcuccacugggccccuggccucgggagcggccccuggcuaugcacccccaccauuccuacacaucuugccagcccaccagcagccccacucacagcugcugcaccaccaccuuccgcaggaugcacaggugaguacagugauggaggcagccacccuacucugggccagggguucugcuccagccuugacagccuucccuucuccucuuccucagaguggcucgggucagcgcagccagcccagcucccugcagcccaagucucaagccuccaaaccugccuacggcaacucuccauacuggacaaacuaaacccagaagagaggggugggcuggggcaaggcuuauccugggcaggagagaacacacgagcacguauuugggagcccagugcccuuuccuagaauucccgacaugugucagccaugccucuguggggagucugccucccagacuggcuacuguauguaauguauuuauguauguauuuguaaaugugauagaagucugggggggaguugggggauggcggcagauguuagccaggucugcccuccccauucaagccccuucuccacuguagcaaaauaagcacccccaccccaucugccuucaggucuucuucacagccugcacugcccagugggccacuaggggcagucucuggaagggcugguucaaggcuguuuggguauaggggucagguaccaaugaagaaucacgacuugucucacuccuuuggaaauuguuuucuuuccuguguaauuacuucauaccucuguuuuugagaaacuguuccguuugucaucugucauggucuccuuccaccaaaucuucaucugggaauagcagcgguaucccuccacccaaguauggccaccuguuugucuucauauagaacaggggcuucuggucuggucaugucccuagagacuuacuagagacuggcugaccaugaaaaaaaaaaaaauaaucugaguuauucagccagucagcuccccuuuaaaaaucuaagguaucuccaagcaacacaucuccauucuaguugucuugaaccacgugggcaacuguuucagggguuuucucuugcccaauccccaccuaauaaaguucugagagcaug

SEQ ID NO: 191364 - RNA, 76821 nt, Homo sapiens
gacgggacuguuagguugcgggcuuuggggcucacucccgacggcauugucuucuccucuucucagacagggcagaccgaggaguuuggaccgaggugagaaagggcggggagaauagaggagggguaggucugguccggaaccguggcgccugcccgcggacacgggugcgcgugacgucggcugagcgcgggaggaaacuggcaguugugagggaaccgagaguuggccccucuuggcucuuccuaaaguucaccuacuuuccuaucuuucauccccauaucucugccuuuucuucagcaauuaucuugaacgccacuucucucacuuugggagacuaaacucuugagucccaaagccuucuugcuuuugaaccgauaagccugaccggcaccucuuuuagggcauuucuauucgcccuuggguuguuuacuuccgggaagcccguucgcuucccuuuucccauaaaauuuugaagccuuugagguaaggcaagcaucguucacaaugucuugcacauaguagauuuucaggaaauauuuguugaguugaauuuaauuuacaagaaauagauuggauuccucuucaugcccugccuuguugucucucugcuucagagacgauuuuuuauuucgaggcuagggggaggccacccuaaucuucaaugcaaaaggaccuaaaaguccacacacaguccacagcuggccuuucuacucuuugugaaaggcuaaacuuuuuuggauugguugcugcaacucuuccugcaucuguggcuuuuagccuuggucucccaauaauuuuauuagacuccuuuuagucuuugcuuaaaauaaaccauucuguugcuguaugccaagauaauuuaucucccuuuagcuucuuagugaccggcagcuauugucacauuuuaagugugcuuuggaaaauguuuuaaagcaucuucuuuguacuuguauucuacaaguagagaggcuuuguagucucucuauugaagugcauauaacagcugcucaggugaacuccaucuauucaucaggugucuaugauagaauugcguuccuaagacuguuucguuguuaacucauggauuauauauucacagccugauuguuggugugauugcuccuuauaucaaauucauagcucacugguggccuuaauaaaaggagugaaaaaguucaguacagcagcuauguucuuguuacccuuuuauaaaaguuugaaacacuaccuuauagcugugacauguaguggaaacccacuacauguggguuuggcuuuggcucugucucugucucuaauucacuguggguggcuuugcaagucauuuagucccuuuauuauuauuauuauuuuuuuuuuauuagagaaaaugucuugcucugucacccaggcuguagugcacuagcaugauaauagcucaccgcagccuugaacgccugaaucuagccccuuuagaccucauuuuuuccaucuggaaaaucaaagaauugaauuagauuaaaauuccuguggcucuacucucaagucaaguaguugaugucagguagaccacacacucucagccuuccaaagaccauacagacuuuuuuuuuagcugcugaaaguaguaguuaccauuuauugaguguucaccccguacaaagcacuguauccagggcuuuauaugcauauuacauuuuucuuaguguagcacauuacugcuaagauagcauuuuauuuaaaauuugugguuuuauauuguuaaugaaaaucuuuaguuauucagaguguguccuuggggcaaccuaagguaugagccucucaguuuuuaguuuagggagaaccacaguuucuuucucugggcugcucuuuugucguaaagugaggggcugaacucuucuagaucccuuccagaucuaguauucuaugaugccugauauauuaauccaguuucccuaugcuggcucagcaaaccaguuuauaauuugcacaguguagauccucaacacauuuuguuaaauaaauaauagaguucuacuucuuaaaccuugaguguauggucauuguauaccucccaaguuacugucucaaggguuuugauguucauaucguguugaauaagaagaguuuucuguagguauaaacuaauaauaauaguauaauauauuguugaguguuuauauaucagacacugaauguagcaguuaauuuacauuauucuaauuaacccucaugaaaggaaacauuuuuuccaagucagcauuuuuuuuugucaguucagugcaguagcuuccuaaaugaucucccuguuuccacuuuugcccaccugcugugauccauuuccucacagaacugggagagugaacuuugaagacgaaucauagcauauacuuucuccacuuaagauccucuaaugacuuccuacuucacuuaaaaguaaaauucagacacuuuuauguggcccaguacacccuacauaaucuggccccuaccuuucucuccucuucucauacuauucuccuucucaccuacuaugccagccaaccuguccguguuugauggcuugauuuugccaugcucauuuccaccuuugggcuaaugugcucacguggaacccucuuccuccugauuuuuacauaagugacuccauguuauuucagguuucaccucaaauauucccuucugaaugaagccuucucugaucauccaauguaaaguaagcccugcacugggcuuuauucuucgguagugauuaucaucaucuaaaacuaccgcuuauugauuauuaauuaucucuucccauuaaaauaauagugucaugagggcagggaccuuaucuguuuuuugggggguuuucuugagacaggcucuuacucugucgcccuguugcccacacugaacugcaguggugugaucauggcucacuguagccucugacucccaggcccaagcaauccucccaccucagccccccaaguagcugggaccacaggcauguaccaccaugcccagcuaauuuuguuuauuuguagagacaaggccucacuauguuguccaggcucaucucaaacuccugggcucaagcaauccucccucagccuccuaaaguguugggauaacaggcaugagccacugugccuggcugaccuugucuguuuuguucacuuauauuccuggugcauaaaacagggccuaucucauacaagucucucaaaaaauauuucuugaagauuggauaaaguuuccucuuggaacuguaaccauaucuguguccauaucaauucauuugaguaauacaaacuugcauaauuuugguguccaggagcagugacucagggcaccagcaucucugucacaauuuuccugaguaaucaaauuacccugauaaauaguuucuaccacccguuaccacaaacgauaucaaaugcuuuuauagaguuuuaauauacuguagggauauuuauucauuaaacaauuauugaauauuauuuccaaucacucuuuuauuuauuuauuuauauuuuuuucugagauagucuuacucuguugcccaggcuggagugcaguggcgcaaucuuggcucacugcaaccucuuccucccagguuccagcgauucucaugucagccuccugaguagcugggauuacaaagugugugccaacauucccagcuaauuucuguauuuuuuguggagaugggguuucaccauguugaccaggcuggucucgaacuuuuggccucaagugauccacccaccucagccucccaaaguucugggauuacaggcaugagccaccgugccuggccccaggcacuguuuuagaaccuggguauaaaaagacuaauaagacauauugcuuuuuuuuuuuuuuugagacgaagucucacccuacugcccaggcuggagugcaguggugucaucaugguucacugcagccucaaccuccugggcucaagugauccucccaucucagccucccaaguagcugggaccacaggugugugccaccaugcccaauuaauuuuuauuuauuuacuuauuuauagagauggguucuccauauguugcccaggcuggucuuaaacuccugggcucaagugaucuuucugccucagccucccaaagugcugggauuacaggugugagccacucugccugggcaagacacauuccuugaccacaaagaaauuauacucuauuaggggaaauagacauaaucaaauaauuaucauauaauaauuauuaauauaauuaacuguaauaauagagauaugcaaaagguaugaugcagacacggaagggacaucugaucacauugggggagaccagaaaagaccucauuuguuguuauaaucaguaagagguagacagguaaagggaaguuugaugauaguggaggaggccacuuaagagcacaaugugaaugaaugcacagagaaauaaaacggucuaagaaguugacuaaacuguagagugaggaaggggcuagauuacagaaggauuugugggucaugcuuaggaguuuggacuuuguacuauguguagaugauaagauaccauugaaggguuuuuaauaagggagcagcauuguuauaacugcuuucaaaagagugaucuggcucuacagucuggaagaugguuugaggaggggcauaacuggaggccaggagaacagguaugagacguguaaugaauagguggaagauauggggcugaaucaccagagcaguggugguagaaauaaggauaggagaggagaaauuuggcaaguaugugggagauuaaauuggcuggaucuauugauuaguuuugggauuaagggagaagaaggccucuaggaugcuuucucguuuaguucugagugacugcaugaaugguauuuucaccccccuuccaaagaagagagaaguggaggggcagauuuugucaggagguauaaugaauucuguuauugacaaguucagaugcucgacuguggagacauuuuuauagugauuccugcuguuuuugcugcaacacauagccaugagauugucuguguuacuacgaggugaacuaaaguuacauugggauucuggaaguaacccacuuaauaauauugcacaacguccagacuaaagagacuaguugagauuucaccagcaaugaggggugguacugugucuauuacagucuuuuaaauuagccacuugcuuaugugagauuugauuaguuaaaacuagugguguagaauuauguagccaauauauggcuaucugaucacuuucuaaaacaaauuuaugucaugguuuugaauaaauuaaauuaucugugccucaguuucuuuauuuguaaaaagggagaugauacuaauugccaucuaucacaaaaagucuuggaagauuauucagguagcacaauuaauuacauguuaauaauuuugauuacagugaaagaaauuauuguuuuagucguucuuugcuuucucgaugucacuccuuuggaaauaauuccuggucccaugguggcaacaguucccaaagggacugaaagaaugucaucuugguaauuuaugaaaacugauuguaacaguuauuuuucugauugaacaugugaaauauauucuguugaaaguauuuuaugacugcaguguggcaaaaucugcaaaugacaacguccugcagucugucagagcaagauuuuaaaaauaaagcacugaauuuaaacccaacauugguuaccaccuguuacugagaagucuuucagaauuaaaugucuauauuuagagaaaguaauacuuggcacugguuuaagauaacuagguucuaaaauuuuguuauguuuauuuuuaggugauugcucaugcuuuucaccaaauguaaaaacguaguaaacucuuuguggggcucuugaggggaauuguaguaauuguagagcauuagcuacuuaaccauaaacaaacuugaaacuauuuuuuuucuguuaaaaacagaaacaauuucuugaaaacuacuuuuuaaaaauggauauaauuuacaugauuuauauccccaaauccacaucuugccuuaagaauucuauuaaguaucauauauucuaauuccuuugcagcagcuguuuuaagcaguugucuaguaucaucugucuucuguugagaucaguagucuauagauagaagaaucccuagaguuugaaauaaguucccuuguagggggaaaaguguauacuacauuuuucacccuuuaaucucucacugauaauacugaauuuauuguguucuuggugaccuuaugccuaauaugggguacagaaauguuuuaauaauaaaauugauugaaaaugcugauuuucuuuuguaucaguuucuuuaauuuguuuuuuggagacggagucucacucuguugcccaggcuggagugcaguggcgcaaucuuggcucacugcaaccuccgccucccaggcucaagcaguaccccgcaauaucagccucccaaguagcugugacuaaaggcauacaucaccacacccagccaauuuuuauauuuuuuguagagauggaguuucaccaugucguccaggcuggucucaaacuccugggcuuaagggauccaaccaccuuggccuccccaagugcugugauuauaggcaugagccacagugccuggccuuguaucaguuucuaauaguccagcgggcccagugacuuuguuagcaacuucuuuaaaagugauuauuauuaggcugggugcaguggcucaugccuguccuagcacuuuaggaggccaaggcaggaggauuacuugaacucaggaguuugagaccagccugggcaacauugagaccucaucucuuaaaaaaaaaagugaucauuauuaguguuugucuagggcuagauggguuggggggaaauugggagugacuaccacuggguacuggguuucuuaauguaaaugaauaaaguugguugcuauaaagggacuaggagcaggcaggaccaugggguguauuagaagaguauaugcccuucuaaaggggacagccacuacucuguuuuggucuacuacuuccuuaucuaauugcaggcccgauauaacuacaucuuuuaauuuucaggaaaagcaggaacuggguauuuuuaauugcuccuaauuuuuuaaacaguacaacaaauuaaaaaaaaauuuaaacacuuugcaagccagacugcaaaauaugaagauaauccuucauggaccaaauauuauaggcuagaucagcuacagauuagauuaucucuguugaccuggcuagcuguaggacuccuuuuaaaaaaaucuuacaaaaauauaauguaggacaggcacaguggcucaugccuguaaucccaacacuuugggggcugaggcaagaggaucgcuugagcccaggaguuccagaccagccugggcaacauagggagaccucaucucuacaaaaaauaaaaaaauuagucagguuugguggcaugcaccuguagucccagcuacuugggagacugaagcaggaggauugguugagcccaggaguuugugacuacagugagccgugauugcaccacuguacuccagccugggcgacagagugagacgcuuucucuaaaaaaaaaaaaaaaaaaaagaagaaguauguauguauguauagcuuuuuuuuuuuuuuuaaugcuaucgguagaucacugugccuguuuuguuccagacacuuagugggugcguuacagaaccugucuccugcaaaugcguaaucaguacacuuguagagaguacuuuaacauaucuaauuuuacugucaaugccuguauacauuauuucaauuuuaaacuugaagaagcagagacucauagauguuaaauaauuugaccauguaucacaccugguucuuagcagagacugacugaguccucgguuuuuuuuugccuccuaaucuaguaaucugcuauacuaguuacuacugcgcaaacacuuugguagucuacugacagauauuugaaauaaaaaucuuauuuaacaucuugaaauagaaaaaauaaaccauguagguauuuugcucccuguucaauuccaucucccucccuacagaauaagaauguguuugguggcagugguaguuuaagggccuauguuuauuggaugucucugauguguuauaccagugcuuuaguguuaguuaccuucugaaucuagugacaugucaauaauuauguuaaucuauuucuaagaaggauggagggaggucuuacaauaaaauacguaacuacaaagaaaacagugaauaaaaauaaaagcacacauuugaacaaugcagauauagcuaaguacauggagaagggucauuauccugguaagccugucuaaagagaucuagagcaaaaauccugggguacagguaaaauaaaggucauuucaguaacauuuuggcaaccugaauucaaacauacuuaaauuuguggaaagagaaaaauuaguuuagguccuccccucuccccuccuucccaagggagaucuguagcuauuuguagguuauagccuuuuucuuuuuuuccuuuuuuuuuuuuuuuuuuuuuuugagaaggaguuugauucuugucacccaggcugaagugcaguggugcaaucuuggcucacugcaaccuccgccuccuggguucaagagauucuccugccucggccucccgaguagcugggauuacaggugcccgccaccaugcccagcuaauuuuuguauuuuuaguagagaugggguuucgccauguuggccaggcuggucucgaaccccugaucucaggugauccgcuugccucugcuucccaaagugcugggauuacaggcacgagccacccugccuggcugguuauagccuauuucuuuucuuuuucuuuuuuuuuuuuuuuuguuggaacauuuuauugaaaagaaaaacuguauaaauaaguucuugguuugauaguaacaaaggcuuauguucccccuucccuccccaucuuugaagaacuaaaaaagaaacaaaaaguucauccccaugacgccauucuugaccagagucugcccagaagccuguccugugagcucuuucucgaucugccucaauggggccaggucauucuggggaugccuggucccaggggcugcagcaccuaguuuuguaguugggagagacugggauagagcuggggagguggcugaggugguuuagugucaggagaagagggcuggcugaccccccuagcuccauuuggucucacaggugagaagguacuuggcuauaaauaugaacacugauugaggcaggcuugaucugggacuuugagggcaggcaggaugauuauggcccagguaccacaggauguggaguuucugggcucagcaucaugguaucuggggcccacguccaaguggaguaaauucuagcugggaagggccguucaagcacacgggaacccugguuuguuuguccacccccacccauggaguauccaagcugguaccucaccucccccgaaucccaguagcacccaugugucucagaagccuuuggcugccuccugccauccugugugcacccugaggcccuaaaacucgucuugcaucuugucaaccuuaggccggaccaggugcccagugaacagcagggagccgcucugggugucccacaccaggaagaugaagggguggucggaguagaacagcuuggggcugcgcagcuccuugcucccauagauguccuggucaaaggaguugccgucuguguccaacucaaaggcgguggcguggaacacgcuggucagguacagguccuucuuguguggcaugcgugacaaguuugccuuguucuugucaauggccucagucaggccaagccuagccaggaguuucugcaggucaugggaacuuccaccacccgcuugggcaaggagauggcgacaggcuucugcuucuuccccauccagaucuucagcugcucuuugguuaccagcuuuuuaaggccucgaggggcuccacgugguggggcaugaggaugaugaggcuggagagcuugugggccaggggcaucuccacgauuugcagcuuuuccuucucauugucauaguaguuguagaggccugucuggugcaucaccaugacacccacgguauagaaccgagucaccaugaagccacgguuuuccaccaucuugugguggaauuucucauuccaguguggcuugaagaacaugguguugacaagcagggcgccauccaugcacuccauguccuuggugaccuugggcagcuugccgucgguggucugcacggcccacucguggauggacugcagcgcacugcgcuugucauggaaauugaucuuggagugcucgcaguuguagugcugcuugcugcugcgcacgaagucaucagcgaaacucacugagcugggucccuacaggcgacugcacagcuuccaggucacguugcgcgcgguggaguugcugagugaacgcagcggcucgcccacgccggcgugcaccuccucgucgcucagcugcuuggcacucagcacugccuuggccuccgacgccguggucgccuugccgcccagcgacacgagccccaacgacgaggccaccaccacgggcgacaccaggauguucuccaccgccugguccuuggccauggccugguacaggcugaaggccaggccggcgcuguguucggccagcguggcugccuuggggcucagcuucucugcggugccaggagcugcuguggcugcagguuucuucaccucggucgccaaggccaccgccaggaggcagaaggcgcugaggagcaggagggagcgcguggcugggaggugguuugcgugcaccacgauggaccugucagggcuaggucaagcuggguugggcuggguugggcugggcuggcuccaagacgggagucucgcucucgagccgcgacacgauucuacucuucuauagccuauuucuauguaacuuuuacaacuuauagcugaggguuaccuauauguucauuauucaugucuuuuuuuuaggggcggggucucacuauguugcccaggcugcauuauucauguauuuaucuuguuaaaccaccagcuuuagacuuguuuguucuccucccuaauuuucuaaucaggcuucuacauguugaggaaaggauucuuaaagcaauccuuugcucccaugcuccccuaacuacugaaaaauaaauccaauaauacaauuugaauuaaaaaaaauuaagauuuuaaggguaugguaguaugcccccuuauucaaggaggauauauuccaagacccccgguggaugccugaaaccauggauaguaccaaccccuauuauagguuaugcauuuuccuaagucuagaacuuucauucuuucacuuaaaggaagcacuauggcuucucuuuggcauaucugaauugccaacauuacuacucuuuugcuuuggggccguuauuuaaguaaaauaagguuacaugaacacaagcauugcaauaccccacaguugaucugguaaccaaaauggcuacuaagugacuaaugaguggguaguuuaugcaguguggauaggcuggacagugggaugauugacauuccaggaaaggggagccaguauugugagagauuuuaaucgugcuacucagaauggugcacaauuuaaaucuuacaaauuguuccuuucuggaauuuuucacuuaauauuuuuggacugguugucuaaggguaacugaaauggcagaaagcuaaauuggaggacagguacuacuguaacuuacauugaaauugucaaucuaaaaacaacaaccaguaaauaagcacuuuuuuuuuuuuuuaagacagucuccuucugucgcccaggcuggagugcaguggcgugaucuuggcucacugcaauguccgccucccacggucaagugauucuccuaccucagccuccagaguagcugggauuacaggcgcgugccaccaugccuggccaauuuuuuuuucuuuuuuuuuuuugagacagaguuucacucuuguugcccagacuggagugcaauggcgcgaucucagcucaccgcaaccuccacuuucccgguacaagugauucuccugccucagccucccgaguagcugggauuaugggugucugccaaccacgcccagcuaauuguuuuguauuuuuagcagagacggcguuucacuauuuuggccaggcuggucuugaacuccugaccucagaugauccacccgccucagccucccaaagugcugggauuacaagcgugagccaccgugcucagccgcccggccaauuuuuguauuuuuaauagagacgggggguuucaccaggcuggccaggcuggucucgaacuccugaccuugugauccacucgccucagccucccaaagugcugggauuacaggcaugagccaccgcgcccagccaguaagcacuauuuuuacuuuaggaguuugcuucaacagaguuuuuaaaaacagaauucugacuuaacaauaaauaacauuuuuuauauaaagcaucuaacauagugcuuggcauaaaacagaacucaauacauuuuaguuuaaucagaucaucaaaguaguauggauguggacuaucugcugacauaauggaauuagccuuuuauauaaaaugcuuuuuuaaaccauaugaaguguucagagugaaguugguaacauuguggauauuuggcuucuuaaagucguaagggcccugaggauguugccauuacuuugggugaugggacucguaaagaauuaggaaacucagagaaaauggcucuauggccacauaagcaggugucauggaaucuuuuaaucacuucguugccuugggcaaaacaguagacauaauggaacuuuuuuuuuuuuuuaauagagucucgcucuauugccagacuggagugcagugacacgaucucggcuuacugcacccuccaccucccagguucaggugaaacucagccuccugaguagcugggauuacaggcacuugccaccacacccagcuaauuuuuguauuuuuaguagagacgguuucaccauguuggccaggauggucucgaucuccugaccucgugauccacccaccuuggccugccaaagugcugggauuauaggcaugagcccccacgcccggccgauaauggaacauuucuaaaaaaauuuuuuuuuuugggggggugacagagucuugcucugucacccagguuggagugcaauggcacaaucucagcucacugcacccucugccuccuggguucaagugauucuccuaccucagccuccugaguagcugggauuacaggcgcacaccaccaugccugacuacuuuuugcguuuuuaguagagacaggguuuugccauguuggccagacuguucucaaacuccugaccucaagugauccccuggccuuggccucccaaagugcugggauuacaggcaugagccacugugccaggcccauuucuaaauauuuuaaaugaacagaaucuaagcagauacuauucacuuaaaauauuuguugcacaccuaucuagcacaaugcuugacugagugggaucauacugcuuuugucuuuaauaauucacacaguaguacaaggcagaaccaucuuacauuaucucuggaacaagacuggcaauaauuuuuuuuaaaaaugaguauguaugucauaaaugccguaucaguuuuaucaucaaaacucugcaggaguuuagagagaagucacauuucccugagguauuaaucuagucaaauauuuauaauaguauggauuguuuuuauggcuguaacauauagcauaugaaaauguuuauguuaaauuaaaacauagauugcaauauaguuaugaguacaguguuauauacaauuuuuuaaaaggcuagaaagacaccaagaucuuaagaaacaauuguaucaggucaauuuggggaggcugagagggaggaagggaggugaaauuagaaauauauauaauuuuuuauuuagaaauauauguuuaaaauaaauaauacagucacauaguuucaaaauuuaaaaaauaaacuguuuuaggucuugcccugggugauagagacaccagugacauagaaaugacaauaggaaagguaauaauaacuaccagcauuuaaaaguauacaguaguuuccuucccauaaucacccucuaccaccuacuuccccucaccuccucaagaccacuauuauugugcauccugcaagugacguuuuuugucugauaagcaaagauauagauuuauuauagaucauuuaucucucucuuuuacaaacuguucuguaccuugcuuuauuaacaauauauuggacagcuuucuuuuuuaaauaacauuuuacaguuuacuuacucuuuguaauugucucauagcauuauuucauuaaauggacuaucauaauuuauuucaccagucucuauuccaugacuuugcuauuacaagcugugcuguaaugaauaacauuauaguuaacgucauuuuguacuuguacguauuaucugaaggauaaggauagguuccuagagguagaauugcuggaucagugcauuugcauuuguaauuuugauagauauaaaucaguggcaugcaaucauaaucaccuagggaacuuuucugaaguuguuaugucugccuuuccuaaaaccugggaguuauuucuuguuguuuuuugguuuucuauagaucugggauggggcucagguaucuauauauuuuaaagugucuaaacugggcugggcaugguggcucaugccuguaaccccagcgcuuugggagucugagguggguggaucacucgaggucaggaguucgagaccaaccuggccaacauggugaaaccuccucucuacuaaacauacaaaaaaauuagccgggcgugguggcgcgcgccuguacucccagcuauuugggaggcugaggcaugggaauugcuugaacucgggaggcggagguugcagugagccaagauugcaccacugcacuccagccugagcaacagagcgagacugucucaaaaaacaaacaauaaacaacaacaacaaaaaaacccaagugucuagagugauucugauguuuaucucagaagaaagaggagaggcucaacauuguaaaauggaaugugguacgcagaagcauauuuaggcuuggcucgguggcuuauaccuguaaucccaccgcuuugggaggcugaggcaggagggucacuugagccccagggguuugagacuagcccgggcaacacagggagacccuuucucuacaaaaaaaaaaaaauguaaaaauuagccacaugugguggugcgcaccuguagucccagcuaguugggaggcugaggugggaggaucacuugagcccagcagguugaggcugcagugaaccaugaucacaccacugcacuccagccugggcaacagagcaagaccaucccucaaaaaaaaaaaaacaaaaaaaaaaaaacagauaacgggggaagcuauacaugugagaggcaggggauauaugggaaguuuuuauaccuuucacuuauuuuugcugugaaccuaaaauugcucuagaaaauagaguuuaauaaaaaauaauuuuaaucugggcaugguggcucacaccuauagucccaguuacuugggaggcugagaugagaggaucacuugugccuacaaguuugaguccaaagacccuaucucuaaaaauaauaauaauaauaauaauaauaauuucuaaaaaacuuguuuuaaaaaauuauuauuauuuaaagagagauauugcaguuaucuacugcuguguagcaaauuacccucaaaacuuaguggcuuaaaacaauuaucauuuuauuugcucagaguucugugagucagauauuugggcugggcuuugcccagauauuuggguuguuuuuuccugaucucaccuggggucacucaugugguugcagucaucuaguggugccacugggccuggauagucuaagaugacuucuuucacaugucuggcuuuggugauggcuguuggcugggcccuugaggccuaggcauggaagucgcauagcauuacuccuaccauauuguauugggcaaaacaagucacaaggcuagccuagaugaaaugagggaagaaauagacuucacuucuucauggaaggaccugcaaaaaauuuuuggucuuuaaaaaacaaaucugccuucacaaaacaaaucuaccagccagugugguggcucacgccuguaaucccagcacuuugcgaggcugagguggguggaucaccugaggucaggaguucgagaccagccuggccaacauggcgaaacuccuucucuacuaaaaauacaaaaauuagccgggugugguggcacgcaccugugaauccuagcuacucaggaggcugagacaggagaauugcuugaaccuggaggcggaaguugcagugagccaagauaccaccacugcacuccagccugggcaacagagugaaacuccaucucaaaaaaaacaaaucuaccacaaauagaaggccaggauuaguuuaggauguguuacucagcccauuuagccuuuuagccuaaguaguauuucccccaaagcuaauuauucaacguucuuugguuaucuuuauuaccuugcccucaccucuuucucuguuucugcuagaaagaagaugaaauagaaauuaaaacgaaaacaggaaaguuguaccacuaguuaccuaacugaauuuuugaaaacucugaauuaugaaaccauuuuaaaaaagaaaauguacuguauuuacuuuuggauauucucaugaacuugauuaacagugauauagagagcucaggauccugacuuuuaauaauagaccaggauuauguguuauuaccacauuauuuguuaguauuuaauuaaauaucuugauauuaaaauuuuuuaaaagauacaacuauuuaaaaucuugaccuuaguauuaauuuccugggcaaauuauuugauucauauucuguacagguagagaucgaugaccaccuuuuggaaugaucugaaauccugaauuggcugaugcugaauugaugaugucuuuacuucuauuuaacuaacuuuugccaguacucagcaaaugcaaaugcuaucuuccuuugaguuacauuaguuuauaauccucugugguaugccauuuaauucugcuuuucauucugaaagaguucuuagccccuguucauuauucaugggaaacaguugugcagcaugccuugacauuaaguugagcaucuaaaauuaguccugcuacaaucaguuguugggaacaagguuucaauaguuguggcauguguuaaguagacauugcaagguuggaaggaacucccuagaaauaaguaaguuauguguuauguauguguucauuuguguaucuauguguauauauauauguguguguauauauauguguauauauauguauauauacacauauauacguauauauguauauauauacguguauauacauauauacguauauauguacauauauacguauauauauacauauacacguauauauguauauacacguauauauacacauauguaaaauggaaugucucuuuuuauuaagcaaauuaacaaauuauauguuaccacaaauucuucauaugcaauacaaagcaucuuuguucaugcacuaugcuauuuaaucaauaauuucagaagaaaaauauguuauugagaacuugacagauaaaacauuuuuugcauguuuguuuugugguuuugugguuuucaauuuuuaaaauaaauaauuguauuacauguacucuauuucaagcgaauggcuuuucuuucucucuucagaguuuauagaaaccuauucaccaaaauggcauccugguuauaugaaugucuuugugaagcugaacuugcacaguauuauucucauuucacugcccuuggccuucagaaaauagaugaauuagccaagauuacaaugaaggacuacuccaaauuaggaguccaugacaugaacgaccgcaaacgucucuuccaacuuaucaaaauuauuaagauuaugcaagaagaagauaaagcagucaguaucccagagcgucaucuucagacaagcagccugcgcaucaaaucucaggaauuaagaucuggcccucgcagacagcugaauuuugauucuccugcugacaauaaagacagaaaugccagcaaugauggguuugaaaugugcaguuuaucagauuucucugcaaaugaacagaaguccacuuaccuaaaagugcuagaacacaugcuaccagaugauucccaguaccauacaaaaacaggaauucugaaugccacagcuggugauuccuaugugcaaacagaaaucagcacuucacucuuuucaccaaauuaccuuucugcaauacugggggauugugauauucccauuauucaaagaaucucucauguuucaggguauaacuauggaaucccucauucuuguaucagguaauaaauuuuaucuuucuuucuuuugagggaaaguagccucaggcaagggcaggccucuccuucauguccagcagacagcaucuacuccuuauuuauaguaaaugaauauaacagaaauuaucaugaacagcauuugcaucaauaauaggaauaccuggaugugggaaaauuaaugagaaauugggacuuucuaggugggagaaagaugauauuguucauguacaucagaacagcugcuacuugccaggaucuguagcagaucuguuucuauuguuuauuauagcguaacaugauacaucuaguacaucugugaaagugaaauaguuaacccuucuacaguggagaaaaaaauuacacaauccacaggacuuuuuuaagguuaucaaauucacuuaacccaaccaggagacuuaaagaugcuuuguuaaaaaacaagggcauguaguuuaauuaaguaggucuuuggggcaguuaguucaccuacacacauugaaauaugauccuaauuuugagugcuuucuacaauuucaaccccggaaaaaacagauaauuuuggugauuacaaacaguaagacauuguugguggagaugagaguuugagagucagggugacaauaaguuauuuucaccuagugcuucgaguuagaauuugaaauaaggucccuaagaggugaaauaacaaguaaucccuaguacuaacaaugguauaauaggaaauauguucuuuuaaucuuguaaaaaaaaaaaaaaaguacuccuuguuuuauuuuaaacauuauauaugugaguuaugggcaaacaaaauucauucuugagccauauuuucuuuuuaaaaauacuguuauucauaccuuaagauaaagaauuuauaucuggucuuacauuggcuaagguuucagaagaucucauaaucaguuauuuuacuccauaaaaauagaagacucaguuuuaacaguaaaaauaucuuuaauaauuugaaauacauaagugaauuuuuauuauaauauuucugaaaacauuuuguuuggucuaggagaucacagagcauguaauacuguuuucuucuuuuaauucugagaggaauagauuguuccuugacuaugaaggcagauuguugcuauugcauugguuaccucagcggugaaggaguaaauauuuucuuuuuuuuuuuuuuuuuuuugagacggagucucgcacugucgcccaggcuggagugcaguggugcaaucucugcucacugcaagcuccgccucccggguucaugccauucuccugccucagccuuccgaguagcugggacuacaggcgcccgccacuaugccuggcuaauuuuuuguauuuuuaguagaggugggguuucaccauguuagccaggauggucuugaucuccugaccuugugauccacccgccucagccucccaaaaugcugggauuacaggcgugagccaccacgccuggccuauuuucuugaauauuacuuuuuuacugaacaguacauaaaaaucuaaauuggaauuacuuauaaguaaaaauaccacuuuauuuaacaccaucaaggauaggauggauauuuuaguuuaaccauuaccauuucauuuauuugacucuuuuguuuauuuguuuguuuguuugauuuguagagacagggucuugcucugucacccaggcuggagugcaguggugcagucauaguccacuggggccucaaacuccugaggucaagugauccuccugccucagccacccaaguagcuaggacuacagguaugcaccacuguccccagcuaauuuuucaauuuuuuguagaguuggggaucucacuauguuacccaggcuggucuugaacuccuggccucaagugauccucccaccucagcuucccaaagcacugggauuacaggugagagccacucugcccugcccaaacuagagcuuuuuaaaaaaacaugcaugucuuuuugcuccuugaacuugaaacuaugggccuuuuguucauaugagucauccuagagcccugaacaauuuuaaaaaggaccaaacauuuucuauccucuuugaucagcuuuauaugauuagguuauugauauccaacaacuaaagauuuuaacacaaaacccuuauuaaaaugaugcauuaggccaggcacaguggcucacaccucuaaucccagcacuuugggaggccaaggcggguggaucaccugaggucaggaguucaaggucagccuggccaacauggcuaaaccccaucucuacuaaaaauacaaaaauuagcagagcgucauggcaggugccugcagucccagcuauucuagaggcugagguaggaaaaucgcuugaacccaggaggcagagguugcagugagccaagauugugccacugcacuccagccugggugacacaaugaaacucugucucaaaaaaaaaaaaaagcauuaaaaauuuucauuuuugaugagcacaguggcucaugccugcaauccuggcauuuugggaggccaaggcaggcagauugcuugagcccaggaguucgaggccagccugggcaacauggugagacccuguuucuacaaaaauacaaaaauuagccagacaugauggugugcaccuguaguuccagcuacuauuggcugaagugggaggauggcuucagcccaggagguugaggcuucagugagcuaugcucgcaccacugcacuccagucugggugauagagcaagacccugucucaaaacaaaaaauucccuuuucuugugaaaaaucaaacauaugcaaaagaagaaaaaaauagaacacugaaucccaauauguccaucauccaauuucuuuuucuuuuuucuuuuuuuuuuuuuuuuuuucagacagagucuugcucuguugcccaggcuggaaugcaauggcacuaucucaccugugaacuccaccuccuggguuuaagugagcaugcccagcuaaguuuuauauuuuuaguagagaugggguuucaccauguuggccaggcuggucucgaacuccugaccucaagugaucugcccgccucagccucucgaagugcuaggauuacaggcgugagccaccgcaccuggcccgucauccaguuucaaugauugucacgauuuucccacaguaccucaaaaugguacauuucauuuauucugucauuuauuuauuccaucugcaguuucaugcaaaaaugaugcauuuuaaagucccuaaauguugguuaagaaaauaaaauuugcuuuaaaacaugccauaaaauuagugcuuuaugcauucauuauauuagaaaauuauuugcugguuuuuuuuuuuuuaaaccaauucagaucccaguaaaaaaauuauucuccaggcugagcgugaugacugaugcuuguaaucccagcacuuugacaggccaaaaugggaggauugcuugaggccauaaguugaagaccagccugggcaagauagugggacccugucccuacaaaaauuacaaaaauuagccagcugcgguguuguaugcuauaguccuagcuacuuaggaggcugagguagaauuucuugaacccuggagguugaggcugcaaugagccauggcugugccacuguacuccagucugggugacagagugagauccuaucucaaaaaaaauuuuuuuucagcagccaguuggagggcuaaggaaaucagaauugauaugaaacaauuguauaaaauaguauucuauauaugaucucuuagggguuuuuuguuuguugguugguuuuuuguuguuguucuguuauuuguguuuuugcaaggaaaagggcggagcaggguggggauggagauagaagaacuuucucaggguugacacuuuacuuuguaacuuuaagaaauauauuaugccuaauauacagcaaaauguaccaauacuuuuuuuuuuuuugagacagaaucuggcucugucgcccaggcuggagugcaguggcgcaaucucggcucacugcaagcucugccucccggguucacgccauucuccugccucagccucccaaguagcugggauuacaggcgcacgccacuaugccuggcuaauuuuuuguauuuuuaguagagaugggguuucaccguguuagccaggauggucuugaucuccugacaucgugauccgcccaccucggccucucaaagugcugggauuacaggcguaagccaccgcgcccggcuaaaagguaccaauacuuugaccuguuaaguaaucuuguccuauuauuaaaaauuaaaagccuguuuauaaacauauuagacagaacacuucagagaaacagaauccuuggacugagauggagaaaaucagaguuuguguucgaaaacgcccccugggcaugagggagguacgucguggagaaauuaauauuauuacuguagaagacaaagaaacucuacuugugcaugagaagaaagaagcaguugaccucacucaauauauucugcagguaugauguuuucguuuuauguuuggaacuaauauuaucaaguaugucauuuuuuuuugcuuuuuguuugagugguggcauacaaguuucuguuagaacacugaaaaucaaguuucugguucggguguugacauucauuccugaugugacacuguauuaagucauugauauccagggccuucauuuuuucaaaagacggugcaauaggggauacaaaaacaauuucucuugugcaguggagcuacaucauauauucacuuaacaugcuuugugugaauuuaauuauacauauucagcaaaaaaaaggaggaaugaaggaauaaaaauaauuuaaauaaugaaguggggccaggugugguggcucacgccuauaaucccagugcuuugggaggcugcagugggaggaucacuugagcccaagaguuugagaccacccugggcaccauagcgagauccugucucuccagaaaagaucuuaaaacuagcccagcauggugguguguaccuguagucuuaacuacucaggaggcugaggcaggaggaucacuugagcccaggaguucugcauuacagugagcuaugauugcaccacugcacuccagccugggcaacagagggaggaucugccucuaaaagaauauaaaaauaaaaaacaaauaaauaauuaaguaguugucaacaggaccagucacugaauauaugacuaugagaugucacacaguugauuuccauucuugcuugcaucucacagugugaacuucucauucugcugacuuugagacuuggguuuaaugauggacaauaucuuuuugggcaacaggaccgacaauugccagccacgugcuuauuuugauucucagcugucuugggcuuauacuuaauuggcgaaaauugggcucugagcagaccacuuuauacaggguagauugcaguggguaaauaaaauccagagauaugauuucacaucuaacauauaaggguuuaaauaaaacacuaauaacucagccauguaaauaauguucacugccugcuagagugauuaugaagaguccaaggagaaagaguuugguauugaaagaaacuuauuccaagcugaagguaccuugcaauaauucuuuagucucauagggaaacagcaaacuccacagauggaaagaaucaucauuuagguacuccuaaaauugugaaaaauugugaguaaucuaaaaccagauaauccauuggauguuaagauuugagaguacacaguuucucuuacucugaaucuacuucccuaaacauucauauuauauuuauucuuucucucucucuuguucucuugccucaaaacccagugacugguaggaagaaaaaaaaaucugguaugcuagcaauucaccuuagucagcugagaucuuacauuaguggaauaaauccuuuaaugcugaagugauuuguuaacacuuucacccuuuuucaaacuuguauuguucuucuuuuucuuugguuaccaaaauuguguuucacagagauauucagaguaauccacugagucuuucuacugguacuaaauuacuaggccacuguaaaaccaacccaaucacuuuaacagccuuaucgauugcugaucaaugcacggucuauuaguucucagugggagauauuuauuuugaaaauggacuaaaugaccaauuaguuguaaugcuaucuaguuccauggcuacuuauagccaucguaauagcccuauccaaucacugucuaccuaagacuuccuuaaugaugcuucugucacaguaauuccaucaaggaggcaucaucuuaucuuucguauuuuucuguuauccccaaacacaauaaccuuacuuuuuuugucauuaccacuggucaauacuuauugaauacccauaguuuccauggcacuuucucugcuguuugaacuuuggaccuuugcucucauagguccgaauccuuaccugucaaugcuaugauauaaaaaugcugggaagacuucuuuuucuuuuuucuuccucaaauagaaagaagaaaagguagguuuauagcaaacugagugcuaaauaaauauugaucguagauucuuugggcuuuauuuuuaaacauauuuagagauaauagguuuuuguguuuguuuuauuaaauguccuaucuuuucaaaucuuguuacuuaguaaauaugaucauauacauguaguaugcuauccuaccaaaccauuaaacuuuauaucaauauaaugagugaaacaaggaaacaaaccauauuguuucauucuaguuuuuugaaauuggcaguaagugaauacaaguuuaauauggaagcuaaugcagauguuauauuacaaagugaguaagauuggccaacaaacacacaaauaagcuauggaccaaugguuuuugucugucuguuugagacaggaucugucuccaucgcccaggcuggagugcagugguaugauccuggcucacugcuaccuccaucuccugagcucaaaugauccucccaccucagccucuugaguagcugggacuacagguacaugccaccacgccuggcuaauuuuuguauuuuuuguagagaugagguuuugccguguugcccagcuggucucgaacuccugagcucaagcaauccaccugccuuagccucccaaaguguugggauuauaggcaugagccaccacgccuggccugaccaaucuuauuuauaaauaugaguacaaaagccuacauaagacauuaacaaguuaguuucaguacuuuauacuggcaggcaagcauaauccaaguucaguacuaggaaagcuauuaacugugauaggcacuauaaaagcaucuguuuaauaaugcaacaaccauacuugauuauuaaaauacuguugguaaaauacagaaggauaguugcuaaauaauacacauacuuuuuuacuuaaaauccuuuaagacucuuuauugcacuuagaauaaaauuuuaaaguuuuaacaagacucuacguggucuggccucugcuugccuguacaaccaauuucuucagaaaaaauacaggcuggguaugguaacucaugccuagcaucccagcauuuugggaggccaaagcaggaggaucacuugagcccagggguucaaaaccagccuggguaacauggugaaagccugucucuguaaaaauuaaaaaaaaaaaauuaggcugggcacgguggcucacgccuguaaucccagcacuuugggaggcugaggcaggugggucacaaagucaggagaucgagaccauccuggcuaacacggugaaacuccaucucacuaaaaauacaaaaaauuagccagacguguuggcagucaccuguagucccagcuacuugggaggcugaggcaggagaauggcgugaacccgggaggcggagcuugcagugagccgagaucgcaccacugcacuccagacugggagagagagggagacuccgucucagaaaaaaaaaaaaaaaauuagcugguggugaggcacagcggcuuacaccuguaaucccagcacuuugggaggaugaggggggcagaucacuugaagucaggaguuuuaagaccagccuagccaauguggugaaacuccgucucuuuuaaaaauacaaaaauuagcugggccugguggcacacaccuguaaucccagcuacuugggaggcugaggcaggagaaucacuugaaucugggaguuagaguucacagugagcugagauugcgccacugcacuccagccugggcaacagagugagacucugucucaaaaaaaaaaaaaauugccaagcguggugacauguaccuguaguuucagcuacucgggaggcugaggugggaggaucacuugagccugggagguugagacuauaguaagcugugauugugccacugcacuccaaccugggugacagaguaagacucugucuuaaaaauaauaauaaagaaaaagaggccaggcaccgcgcuggcauuacucaugccuguaaucagcacuuugggaggccgaggccguggaucacaaggucaggagaucaagaccauccuggcuaacacagugaaaccucgucucuacuaaaaauacaaaaaauuagucaggcaugguggcaggcgccuguagucccagcuacuagggaggcugaggcaggagaauggcgugaacccaggaggcagagcuugcagugagccgagaucacgccacugcaccccagccugggcgacagagugagacucugucucaaaaaaaaaaaaaaagaaaaaaaaauacauauauagaaaaaauaagaugacacugaaaucugaaauacaucaaaaaguuaacaguggcugaacaccuagauuuaaggauacuuuuauuuucuucucuauucucuauauuuuguucucuauuguaauuuugguuuuuuaauuuuucugagacagggucuuguucuguugcccaggcugagguacaguggugcagucauggcacacugcagccucaaccuccugggcucaagugauccucccaccucagccucccgaguagcugggauuacaggcaucacaccaccaugccaggcuaauuuuuguauuuuuuguaaagacuggguuucuccauguugccucggcuggucucaaacuccugaauucaggugauccacccuccucagccuuucaaggugcugggauuacaagugccuggcccacauguuacuuuuauaaucugaagaaaaacuuacuuaaaaaauaaacugcacuuugggaguccgagguggacagaucacuugggggcagcaauuugagaccagccuggcuaucauagcgaaaccccaucucuacuaaaaauacaaaaaauuaguugggcgugguggcugcaugccuguaaucccagcuacucgggaggcugaggcaugagaaucgcuugaaccugggagguggagguugcaguaagccgagaucacaccccugcacuccagccugggugacaaagggagacugugucucaaaauaaauaaacuguggaacucugauucugucaagguuaguaaggucaacguagguguuacuccagccucacugauaaagugugagcaaaugaaagugugugugaugcaaaggacguuaugaauuguguauauacauuaacuauaauaaucuugcauguuuacauaucuuucaugaaagauauuuacaaaaguacugggaaaaccaauaucuaaaccuuauuggaaggaaagauacuaauucccuuaaucaauaaaugcuuucuaaggucuuuacucaaaagcuaaagcuauccaugagcacuuuuagaaggagagacagaauugccauauacucgcuguaauaaaaggaaacaaaaaaauguauucccacuuuaguuguggguuuuuucuuuuuuuuuuuuuuuuuuuuuuuugagaaaugccgaauauauccacaucuauagauaacuauagaucuaguggguuucuuuguuuuggauuucauacuuaacuauaaaaaccuauggugauaauuugagcaacgaauuauuuugucuccuugccuagaaacuguguaugaaauagauauaaauaauguucauuaaaaccagauuuuaggcugggcacaguggcucacaccuguaaucccagcacuuugguaggccgaggcaggcggaucaccuucgggagcucuugagaccagccuggccaacauggugaaacccugucucuacuaacaauacaaaaaaauuagcugggcaugguggugggcacuguaaucccagcuacuugggaggcugaggcaggagaaucgcuugaagcagggagugggagguugcagugagccaagaucacgccacugcacuccaaccugggcaacaaagugagacucugucucaaaaaaaaaaaaauaccaccagauuuuaaaaauauguuuaacuauuauugaccuuuuuaagcuuaaucaaaaguuuaaugaccucucuaugugccugucacccaacuucaguaguuauuaauauuuuaguguucuuaaaaucuuaccacauuuuucaaagcacuaaaaguucacacaucuauuauucuucagauucauuauuuucuuacuuuguaacuuuuucucuaacuuguagauuuggauuuguguucucacuuucuucuuagacaaucuaacaaguuuccauucuaauguaauguaaugguacacacaacagauucaaacuggggguagagugacccacaguaaauuggcccaaguccaguuuucuggaucuguccauaaaauuuuuucuugacuagauauuuagagcaggcccaaaaaguagaagauaaggccuuaucugucauucaugguguauggacugucauuaugcuauacucaggcuugaaauuacuaggauuucucauauauauauucuuacauauuagaccaacuauacacacacacacacacacacacacgcacacacacacacacacaucuugguagcccagcuauauauauauaaaagaauauauauuauugcauguuaguuuuauaugaaaaaguaaauaucucugaauaggauagauucaccuauuuugaaauagaaagguacaaaaguguaaaauacaagugucccucuaauccuguuuccuccaugaaggcaauugggguuaccuauucuaaguguaucuuuccagagauauucuauaaauacauguuacuuuuauuuuuuuuuuaauuuuuuuauuuuuugagacugggucucaucuguggcccaggcuagaaugcgguggugcaaauaauauauuagaauauauaucagccagcaugggcucacaccuguaaucccagcacuuugggaggcugaagcagacggaucacuugaggucaggaguucgagaccagccuggccaacaugaugagacccccgucuuuacuaaaacuacaaaaaucagccaggcgugguggcgggcgccuguaaucccagcuacucaggagacugaagcaggagaguugcuuaaacccaagagauggagguugcagugagccaagaucaugccacugcacuccagccugggcaacagagugagacuccaucucagaaaaaaaaucaaugaacaaaauauauauuacuauuauauacguauaguugggcuauauguauauaagaauauauauguauguauauuuuuauauauguguguauauauacuauauauacgagcuaccaacauaagaaugauauauauucauacauauauauauguaguuguaccuaccaacaugguaagccccuaaauuauggaaauaauuacagcugcugaauuaaugcuuuucagacccaauguaauggggucuuuuuucugucuuuuuccaaauuacugugauuuuucauuuggaagucgucuuggaccccuuucucuccccagcuccccaccucuagucaguuaucaaauuucuucuguauccaucucuuuauuuccaugguugucaaauaauuuagaugcuuuuuaccucaccacugaauuacuagugucucuguucucaaaccauucauagugugaagccagauuaaucuuccaguaaagacugaaaucauccuucuugccuauaaaguuaguuuuucauuguuuccccacuauuuacugaauuaaauaugagcauccugccccccaguuaagacuggugucccaagaccccuacaacacaguccuaacucauuauucuaguauucugucucuuuuuuuuuuuuuugagauggaguuuugcucguugcccaggcuggagugcaauggugcgaucucagcucacugcaaccucugccucccggguuccagcgauuuuccugccuuagccucccaaguagcugggauuacaggcgcccaccaccacgccuggcuaauuuuuuguaauuuaaguagagauggguuucaccauguuggccaggcuggucucaaacuccugaccucaggugauccaccugccucggccucccaaagugcugagauuacagguguggagccacugcgcccggccucuguuucacuuuucuacuuacugugauacuguauuucaaucacauugaauccuugcuauucccuaaacauuaauuaauuaaacaguuaauuccuugugcuucuaugcuuugacucuguucauacuuccccugugccuggaauaccuuccccccuuccaucacucccuuucaaauuccucuucuuccccugugguccauucucaguauagucuuuuucauaaucagagagaauauguuuuccuuugaaaucgacacguacuuuaucuuaagauucuucuaccuuccagucauuugcauacuuguguagauuaacauuuuuaggagguaagauagggaaaugcuaggguaaugucuauauccuugggccccuucaagugccuacugcaauguaugugcuaccagcugagcauaaauauuuauggaauuaaaaguuaagcuguguaaucuacagaauugagaucuuccccuagaauuccuccaaaauucuuuuuuuuuuuuuuuaaauggaaucucgcucugucacucaggcuggagugcaguggugccaucucggcucacugcaagcuccaccuccuggguucacgccauucuccugccucagccucccgaguagcugggauuacaagugcccaccaccaugcccggcuaaauuuuuguauuuuuaguagagaugggguuucaccguguuagccaggauggucucgaucuccugaccuugugaucugcuggccucggccucccaaaauguugggauuacaggcgugagccacugcgccagaucacaaauuccuccaaaauucuaaauauacuagcuuuaguuggaauacgaggauaauccccauagaauucacuuucucuccuagaccuaaggaggauugacucacucuuguguuuaucaauuuacuucucuuaagagaaaacaaaaaauguaugccuuaguuuuuaccuuguaagaacaugucuacagagaucucaaguaagaggaggcccugucauuuaauagugauugcuuauuuaccucuaaguuugauauggucaguuacuguuacuuaaagacauauuuuggcauuuaucaucuguuaacuagaauagugauuaagaaaauccagaaugugucucuuuccauaaaaucaaauuuauuuuucagcauguuuuuuauuuugaugaagucuuuggugaggcgugcaccaaucaggauguauacaugaagacuacucacccacuuauucagcauauuuucaauggguacgauaaugauuauuugcuuuuuuugcuuuuuauuuucuauuuuccauuaggccauauuucuuuauaaauaucacaugcuuuucaguacuuuugacuuaaacaugaauuuguguuuugagcuaauaaauuuagauucuucugaaaacaugcaguaucucuauaggauuuaccaaggauuuagaaauuugcaguaaaauuuccucuuacauugaugauauuauuucucugugucuaguggaaaaauauauugugauagauagugaaaggguguuaaaaaaaaaagaaaaauuaagcuuuuaacaauauuaucccaucaaaguccucagaagaaaaagguucaggugguuggaguuagucugaacuuugaugauaggaauuauguauucuggcuauaguuuaguuaauuuuuucuuuggaaucagauagauaagugaauaucacuuaucaauuuuucauagauguauuuuuuuuuuuuuugagauggagucuugcucugucgcccaggcuggagugcaguggcgugaucucagcucacugcaagcucugccucccacauucacgccauucuccuaccucagccugccucagccucccaaguagcugggacuacaggcgcccgccaccacgcccggcuaauuuuuuuguauuuuuaguagagaugggguuucaccguguuagccaggauggucuccaucuccugaccucgugauccgcccgccucggccucccaaaguacugggauuacaggcgugagccaccacgcccggccucauagauguuuuuuuuuuuuuuuuugagacagagucucacucugucgcccaggcuggagugcaguggcgccaccucggugcacugcaagcucugccucccggguucacgccauucuccugccucagccuccugaguagcugggacuacaggcgcccaccaccaugccuggcuaauuuuuuguauuuuuaguagagacgggguuucacuguguuagucaggauggucucgaucuccugaccucgugauccgcccgccucggccucccaaagugcugggauuacaggugugagccaucgcgcccggccagauguauuuuuaaguuauuauucacacuuaauaaacguugaaugggacaggaaugauaguaagggccucuguugcauaaguauuuaaaauauaggcaugggccacaugugguggcuugcaccuguaauccaagcacuuugggaggccaagacaggaggauagcuugagcccaagaguuugagaccagucugggcaacauaaggagacccuaucuccacacacaccaaaaaauauuuauuuuauuuuauuuuauauuuuugagacagggucucacucugucacccaggccaaagugcaguggugcaaucuuggcucacugcaacuucugccucucagguucaagcaauccucccaucucagccuccugaguagcugggacugcaggugccugccaccacgcccagcuaauauuucuguauuuuuuuagagaugggguuuugccauguuacccaggcuagucuugaauuucugggcucaagcaauccuccugcuucagucucccaaagugcuaggauuauaggugugagccaccaugccuggucuauaaaauuuuuuuuuuuaauuagccaggcauggugaugugcaccuguggucccagcuacuugggaggcugaggugggaggauugcuugagcccaggaggucaaggcuguaggagcuguggucuugcacuguacuccagccugggcaacagagcaagacccugccucugucugucugucugucugucugucugucugucuauccauccauccaauccaccuaccuagcuaucuaccuaccuaucuaaucuaccuaccuaccuaucuaccuaccuaucuauuaaaauuguaggcauguaugauagaaaaugccaaguagccugcuaguguugcugauuccagagaauuuugacuguuuuuucaaacaacuuuuuaaaaauugagggauaauuuacauacaauaagaugcacagaucuuaaguauucacauuugaugaguuuugagaguuuuauauacgugaguaacaaauaucuguaacaagacauggaacauuuucaucaccccagaaaguucucuugugucccuauuuaguuaauccuccacccucacccccaggucuuagguaaccacugacuuacuuucugucaguauagauuaguuuuaucuguucuacaauaucauagagauagaaucauuauacuuauaugcuuaacauaauguuugcuuagcauaaugguguuuuauauuaguacauguuguuacacguaucugugguuuucauugcugaguaauauucccuucuaugaaauuaucacacuuuguuuugucuauucuccuguugacagauauuugcauuguuuccggcuuuggacuuuaugaauaaaguaugaacauucuuuuuuuuuugagacggaguuucacucuuguugcccaggcuggagugcaauggugcgaucucagcucaccgcaaccucugcuucccggguucaagugauucuccugccucagccucccaaguagcugggauuguaaucccacacccggcuaauuuuuuauuuuuuaguagagaugggguuucuccaugauggccagaacauucuuguauaauuuuuuuuaugagcauguuuucauuuacuuuggguaacaaccuagaaauggaauugcuggcucauaggauagguuuauauuuauaagaaagugucagucgggcacagugguucacgcuuguaauuucacacugugggaggccgagaugggagaaucauuugagccaggaguucaagaccagccugggcaauauagugagacccuaucucuaaaaaaaauuuuuuuaauuagcuggguuugguggcauaugccuguagucccagcuacuuggaagguuguugcuugagcccaagagaucaaggcugcaauaaucugugaucacuacacuccagccugggcaacagagcaagacccugucucaaagaagagaaaaaagggaaaaugucaaacaacuuuucaaaguguaccauuuuauacucccaacaguaacaugagaauuguaguucugcaauaucugcuaucgucaggcuuucuuauuuuagccaaucuaauggguauuaaauaaucucauuguagguuuaauuugaguuucuccaaugccugaugauacugagcuucuuuucauguucuuuuuuuugagacggagucucgcagcccaggcuggagugcaguggcgcgauguuggcuuacugcaagcuccgccuccuggguucacgccauucuccugccucagccucccgaguagcugggacugcaggugcccgccaccacgcccagcuaauuuuuucuauuuuuuaguagagacggggguuucaccauguuagccaggauggucucgaucuccugaccucaugauucaccugccucggccucccaaagugcugggauuacaggccugagccaccgcguccggccuuuuuuuuuuuuuuugagauagagucucacugacacucaggcuggagugcaguggugcgaucucagcucacugcaacuuccgccucccgggcucaggcuauucucgugccucagccacccuaguagcugggauuguaggcgugugccaccacaccuggcaaauuuuuguauuuuuaguagagauggggucuugccauguugaccaggcugaucucgaacuccuggccucaagugauccgccugccucagccucccaaagugcugggauugcaggugugagccaccgugccuggcccuuuucauguccuuacugaccauuuggauaucuucauuugcccauuuuuuugugcuuuguuguuuuguaaaagcuauuuaauuuuuuaaauuuuaugagaaggcuaaaaaugugaaauaucucuuagguucaauuucuuaguaagggcaccaaaucuagggaaugcuuuuugaggaguaaguuucuaaaauaaguuagaauuugaauguuaagacuuuaguaauaacaagaguugcaaguuaaguguauccauucuuuaaaguauaauaggguuuuucacuccuguauuguugcuuuuugaaaaagcucaucccuaaacuguucagaaaguaaaguagauauuauucuuuccucuugcucugcuggaucuuccuuaguguguucaaauuuuucuccuguaauucauuucccaacuccgccucugccgguauuuauaguacccacacugcugggagccaggguucaaaaggcaaagaguagcuggucucugcuccaagcagcuuacaucuaauuaacucccaugucuugauucucacauuucuaugguucccuugcuuuugucauuuuacucuuucuuuguuuucuaccuggcuucaaauccuuuucuguguacucaucucucugcccaccuccagccucccccaucccuguccaugcuauaaaucaaagaagaugacccaggcaagucucaaucauuguagauuuauuugccaaaguuaagaacgcaagcccaggagacaggucuauaccuuucuccaaagacgauuuugagggcuucaguauuuaaaggguaagaucugagagcaaauaaaaggggaaaaaauaauaaaaggaaaaggaaaaaaaauuuacaggggaaaggguggauauuggaggaaaagaaauauguuuuaaauguuucaauagauaaaaagacaaaacaguugcauccuuucgagucuuugaucagucuuucacugaauacucaauuuucauauuggggauuggagaaaauaguucuucauguuucaccuggcccagugaacugcauuuuacauuagauaauguagacaacaguagggcagaggaagcaucaaauaugcauuuauuucaggugagcagagggaugacuuagaguucuguccuguguccuccaugugugaagauaagcuaucaauugacauugccagggugaaauucaacacaacuguuuuaaggugaagaccaugagcccacaaggaauuuccuagugggcaaaaugugagggagauauguagcuuuuuaucuuuguagccaucuuauuuaggaaccaaaugggaggcagguuugcgggacccauuucccagcuugacuuuuccauuuggcuuagugaguucgggguccugagauuuauuuuccugucacaaugcauagacuuuuuuuuuuuugcugcaagcagcuauuuuuaucauuaauccaugagauucauguuuaagagucugcaacagcucuaagauuauguucauucucuacuuagcacugugugggugaaucccacaacacucagauaaucuuggucuccaacuccucguaaaacauacugugauugacaggcuggucucccaacuccauucuccaccucuuauucugcaguucuucacacucauaaaggguguguacgcacacauguaaccacauacaagagcaaugauucucacuuagaaucauagggcaucacaacuggaagggaucuuagaaaccaaucuacuacuacuuagaaacuaaucuacugauaaaagugaaaacugaggcacagagaaaagugaagggacuugccuaaggucauaugguuaguuaaugguagggcagaaaccagagcccaggcuuuuuuuuuccccucaagauuuggugugccugcugccaucuuuacuacuguggccucuguucacgcuauuccuauuccacaguggaagcucucugcuuuucagcuucugccuucaaggcccagcccaauuccuacucuugugaguccuuccucaaauacuuugcuuacaucaauuuccccuuuaucuaaacuuccuuaauuaugaguggucacuaccaucuugcuuaucacaugaucuccuguuauuucucguauuuaauucucuauucuuucacuaaauuuaacuuuucagauuaauaguagaucaucucuaggauccucuaaagcaccuagcaugggguaggaauucaguaaaugcuuauuggcuaagugguuucuuuaaagcccuuguuucuuuaucuucuagaguuguuucucuuacugguucuguaagaaaauuacuauaagaaaacucaggcugggugugguggcucaugucuguaaucccagcacuuugaguggccgaggugggcagaucauuugaggucaggaguucgagacgagcuuggccaacauggugaaaccccaucucuacuaaaaauacaaaaauuagcccgguaugguggcgcacaccuguacuuccagcuacucaggaagcugaggcaggagaaucacuugaacccgggagacagagguugcagugaguggagaucacaccacugcacuccagccugguugacagugagacuccauuucaaaaaacaaaaaaaaaaaaaaaggaaaacuuguguaguaguuugagaauuuuuuuuccucuuccuguguucuuauaauguaaaguccucuucuccuuaaagguuuauguguuuauagcugaauuuucucuaagauucuauguuuacauuugaccuuugucauuaaaaaucuauggguaaacuaauacuucucuuaauaugcauaaguaaugcaaauuauccuuuccccagaggcaaugccacuugcuuugcuuauggacagacaggugcuggaaagaccuacaccaugauaggaacucaugagaacccaggauuguaugcucuagcugccaaagauaucuucaggcaacuagaagugucccagccaagaaagcaccucuuuguguggaucagcuucuaugaaauuuacuguggacagcuuuaugaccuccuaaauagaagaaaaagguacugaauaugagugggaagcgauaaaucuguucaucgcuauuuuaagccagagucccggagaaucacugaaucauaggcuuuaaugagaugcuuugguacauuagugcccuuuugugaaaugaggcuccugcaucagauacauauuuucuagcugucaauucagcuauaggaaaauguaaauuagcuuuucauuaauauuuuuuaaaguguucaauauucuaaugucuaucaaaagacuuucccuuuuauuuuggucuaugaagaaggucauaauuucaggaagucaggaaaucaacacguacuuaaaccccuuccuguucuuuugaccuauuauuauacuggaaaaacuauaaauaauguuuucuacuuucucuuguuuuuccucuaaauaaucuuaggguaaacaccaugauaguuuucugaaaucaauaagaagaaaagaaaaucuucucuuuagaguuuuaacccuuguuaggcuuaaacuauugcucuugcaacauaauauaguaauuuagaaauguauucaguaacucugcuuuuaaacaccuauuauauuuuucuugcaugaaguuuuguuuagguugaaacagaugacuuaaacugaguaggaggcaaaagaaguuguggaggaaaugggagaauagagguuagagggaaugggggagguggaaggauuaaaggcugucauaacagaauuaaccagauuugagauguuggaggagugaauugaggcugagccuccuggaagacuagggaaaccuaaucagcuugagacuagcccggcaacaaagguaucuaagccucuauggagcuguccaaaaggaugcacaaguuuugcaugcuccaagcaagcaauggaauggggagugggggagcaguuccaguucaauagggagaccaugauagggcaggcccccauuguagagggucaguaggguacugaguagcauaacuggagaagccagcgagugggcuuaggcaggccucucuccuauaacuauuccagugaaaaggggaccuucagauaugccacuugagauuguauagguguucagaauucaguccugaccaaacaacugcgaaauaaaagagggugcuacucuggggaugcuugaggaagaguugccuuucuuuuuuaccuucuugguguugaagucucgaauuagcucaaucacagcuucuccaucaagcuccaaugcccucauuaggagcccuuuccagucagaaugcccacuucccuuaaagaacaauugccauggaauaaaagccacugugcugugugugugugugugugugugugugugugugugugugugugugugguuuauuugggugaagggagguuaggauaucuagcucuuucugaacgcauuucuuuaaugaauugcccagauuauuuuauugcccuguauauuugcauuccucaguuguagcaggggaauaggcauauauuaacucuuggguuugaugcuucucugaggcucacuagggaagaccuaugcuuacucuacaagugucauggccugugggguucauguauauauauauauauccauuuaauugucuaaucuaaucuauuuccuaccuuucuggggcuucugaaauguucugguccauugauggcacccuuuccuguuuaugcuguuaugcuuuacccuguugauuuuuuuuuuuucuuuuucugaggcaagguauugcucugucgcccaggcuggaguacaguggugccaccacagcucacugcagcuucauccuccugggcugaagugauccucccaucccagccucccagguaacugggacuacagguacaugcuaccaugcccugcuaauuuuuauuuuuuguagacacagggucucccuauguuacuuacccaggcuguucucaaacuccugggcucaaacaauccuccucucuaggccucccaaaguguuaggauuacagguuucagccacugugccugaccaauuuuuaaauaagauuuauuuucuauaauaguggggcuuugacaaggguagacaaaaguauguauguucagugugccucuuaaacuggaaaacaaagcuuaaggaucuugaaauuaauuccuagaaguagaggauaaauuguuuuuauaccuugcauaaaagcugaaguacauuuuaggcuguccaugaggaaucuuucuggggugggcucagagauuaaggccugggaaauauguucaggaaugacagcagggcucuaaaaguuagaucuuccuuuuuuuuuuuuuuuuuuaaacagagaugggcucuugcuguguuacgcggcuguaacauagugacuauucacaggcgcaaucauagcguacuacagccucaaacuccugagcucaagcaauccuccugccucagccuucugaauagcugggacuacagacacacaccacugcauccaacggcuagauucuuuuacucuagaaggcugacuguuuuaauagauuuguuuucagagagaugaugggcauuggugaggcuguuucccuccaauccuucuguagagaucuggaaaacugggaugaagcauagacugagaaaaaaauuauuuuugagaaaaucauucuuguauuuuaaguuaugaaguggaauuccguucuuaacccuaaucaguaucuuauuaagagggaaaaauaaucuuagagucuuugauagauucaacauaugccucucaguggaucugguuuaaugaugaugguagaccauaaccauuuauuaccuugaaugcaguccuaaggcauucagaugcagcccagcucuuccuugcuccuuuauaagauguaucaggucucuuuacauugcaaauaaaagaaaaccccauguguacuagcuuaagcauuuagggaaaucauuggcucaaauaacuggaaagcuuagaggacagucaggcuucagcauugguuuacuccagcagcucagggaugcaauaaggacccaguuuauuugcaucucuucauucugucuucuguguuauuaguuucauccugaagccaacucucuuuguagauacaaaauggcuuccacugcucccagggccacagggccauaugcuuucacauccagggacagagagagagcaucacuucaccaggcaucuaacaaccagagaccaggacuuuacuuugauuggaccagcagagaucccauauccaccucugaacaaaucacaguauagccagguguacaucauccacugauuagcauaguuuagauaugugcucauucuuuuaauuguagccagaguuguugauuuauuuuacaacaaucaacaaccaccccugaaucgggcugaggucaggagggugggguugggaggaggauaagcauccaucccacucaaacagaaaacugcuacuuaauagaggaaugguggaaugguuucuggggaggcaagaacaaagucuguuuuaguagcaccaucauaccaaccacuuucuugcaucugcaggcucuuugcaagagaagauagcaagcacauggugcagauagugggacugcaagagcuucagguggacaguguggagcuccucuuagagguaauuaauucuuccuucuuuauuaccccaccacaacaguguaaguacagggaacaaauucauuuugcuacuaagcaaguacuguggacuuauauuuaggcaaagggcaaugacaagcccaccacuucccaucuguaaaaugugaauucuuuucugagaggauagcuuguuucucuauaggguuucucccacgauuagugggagguagggcaugugggagaacuuaauucauugggaggauacuacugggccaguuucuuuuuguuguuguuguuguuguuuugagauggagucucgcucugucacccaaccuggagugcaauggcacaaucucugcucacugcaaccucugccucguggguucaagcaauucuccugccucagccuccugaguagcugagauuacaggcucccaccaccacaccuggcuaauuuuuguauuuuuaguagagacaggguuucaccauguuggccaggcuggucuugaacuccugaccucaggugauccacccgccucgaccucccaaagugcugggauuacagccgugagccaccgcacccagccuuauugggccaguuucaaaugcugcuaauguguuucucuauggcagugggcucugggaaaagcugcuggagacaaauauuugcacuuuaaauucuuuuuacuuuuuuuuuuuuuuuuuuuuaagcaacagggucuugcucuguugcccaggcuggaguauagagguguagucauagcucaccgcagccucccacuucagccucccaaguagcuggggacugcaggcacaugccaccacaccuggcuaauuuuuuuuuaauuuuuuuuuuuuuuuuuugagauggagucucacuuugucaccuaggcuggagugcaguggcgcaaucucugcucauugcaagcucugccucccggguucaugccauucuccugucucagccucccaaguagcugggacuacaggcacccgccaccacgcccagcuaauuuuuuguauuuuuuaguagaaacgggguuucaccguguuugccagaauggucucgaucuccugaccucaugauccgcccaccuuggccucccaaagugcugggauuacaggcgugagccaccacgcccugccagaccuggcuaauuuuuaaaaauuuuuuguagagauggugucuugcugugucgccuaggguggucucgaacuccugaccucaagcaguccucucaccuuggccucuuaaagugcuaggauuacaggcgugagccaccgcaccuggcccuuauuuuaaauacaauuuuuaauaaguaauacuaucacaugaguucagaauucaaaagugaaaauacccacuuccauuuccuuuuccagagcaacuaauuuuauuaguuuuuuguguguccuuccaaaggaauuuuucaaucugcuucuuuuauuaaguuauucuuuuauuguaauaaaagucauacuuaucauuaaguuuaaacauuacagaaauauguaagaagauaguaaaggccccucuaacuuacuauacauaccccacuuccccuguuccccacugagcuauccacuguccacgguaaaauauuuaauuuuuuuuuccuguucugggcauuuauuaacguaaguacaaauagauuucuguugaaccuuccuuuaaugcaguguuccucaacccuggcuuuacauuagauuguuuggagccuuuuuuuccuuacuuaaaaaaugauuuaaccuuuuuuauugugaaaaauagcacuauacagaaaaaugcauaaaaccuaaguauguacaguauaaagaaacaagcacccuuguaaucagcuacucagaucaagaaauagaacauuguagcacccuacaaacccccugugugacuuuccaauaacaccccccuauuauccugacuuuugugcugaucacuuucuuguuauuuguuauaguuuuaccaccuauguauuuauccccaaaccaucuaaguuaguuuucaucuguuuuugaacuuugcuugaguagaacuacacuguguauuuuuugguguuuuguuucuuuugcucaauauuaugcuuuucaguuccauugagguuuuugcauuuggcuuuaguuuucuucauuuuuauuuucuguagaguguuuuaucauaggaauauaccacaauuuauccauucuccuguuaauaaacaacugggguuguuucuauuuuagaguuauuuggagcauugcagcugugagugugcuuauacauguauuucuguacagagcacauggguugucuaggauauauaccuagcugugaaaugauuaggucagaugauaugcuuuuucuuuuuuuauuauuuuuauuuuuuucuagagacagggucuugcucuguccagcccaggcuggaguccaguggcaugaacacauggcucacugcagccuugaccuccugggcucaagcaauccuccuaccucagcuucccaaguagcugggaccacaagcauaugccaccacacuuggcuaauuuuuuuauucuuuguagagacaggguccuaccauguugcccaggcuggucucaaguuccugggcucaagcaauccucucaccucagccucccaaaguguuaggaugacaggcacaguggcccauauuuucagcuacacuaaaugcugccgacuguuucccagaguggugugcauuccuacaagcaguauaugagcaaucccguugcucuucaucuugcagacacuuucaauugauagauauuuugaauuuuugccagucuggaguguuuaauuauauuuuauugugggguuuuaauuugcauuucccugauugagaauaaaauugaauauuuucucauauuuuuaacuuguaauuuggaguuccucuuuugggaaugccaguuugggucuuuuccucaucuuggguuaucugucuuuuccuugucgauuuguauauuccggauaugagucuuguugguuauuuguaucauaagcauguugucucauucuguggcuuguuuucccaguuucaucauaaugucuuuuaaugcuugcuugugucguccucaagucaauuaaaucagaaucccucaggaguggggcccagguguggguauuauuauuauuuuaaauuaaaauguaguucauauaccguaacauucaccuuuuuuaaaguguaugauccacuaguuuucuuaauauaauuuucuuauugagauauaauuuacauaccauaauauucauucuuuuuuuauuuuuuauuuuugagacagggucucacuccuauugcccaggcuggagugcauuggcgcgauuucagcucacugcagucucagucucccugggcucaggugauccuucccaccucagucuccugaguagcugggacuacaggugugugccacuacacccggcuaauuuuuuuggcauuuuuaguagagaugggguuucaccauguugcacaggcuggucucaaucuccuggacucaagcaauccucucaccuugaccucccgaagugcugggauuacaggcaugagccaccauguccggccauaauauucuuuuuuuuuuuuuuuuuuuuuuugagacggaguuuugcucuugucgcccacgcuggagugcaauggcucgaucuggguucacugcaaccucugcuucccagguucaugugauucuccugccucaaccuccugaguggcugggauuacaggcuccugccaccaugcccaccuaauuuuuguauuuuuaguagagacgggguuucaccauguuguccaagcuagucucgaauuccugaccucaagugauccaccagccuuggccucccaaagugcugggauuagaggcaugaugcacugcgucccgcucaguuuuuuaaagcauacaauucauuguuucucagucuuuuggcuaagaucaaauguaguaucuuuuuuuuuuuuaagaccagugguucagaauagaaaguguaguaucuuuucucagcaguuuaacauguucuauucaaggacaaccuauuaaauggauuuuuggaacagggagauggaguaggagcuugcucuguccgcuccaugcauugacuugguagugcaagaccuccaggaauggugcauccucccugagggauuuuuuuuuuaaguauacaauucagugauuuuuuaaaaguauauucaugaaguuaugcaaccauugucacuaucuaauugcagaaaacuuucaucaccccaaaaugaaacuccauuagcaguuacucccuauuucuccugcccccagugccuggcaaccacuaauuucuaucucuguggauuugccaauucuguccguaucauauaaacagaauuauacaauaugcaaccuuuugucuggcuucuuucacuuaguuuauuuucagaguucauucauguugcagcauguaucaggacuucauuccuuuuuguggcugaauaauauuacauuguauggauaccucauuuuauuuauccauucaucaguugauagacauuuggguuguuuccacuuuuggucauuaugaauaauguugcugugaacauucauguacaaagguuuuuguguggacaaguguguuccauuuucuuggguguaugccuaggagugaaaucgcugggccauacuuuuuuuaggaaaugccacacuguuuuccaaagugacuuuaccauuuuauacucccaccagcaguaugaggauggguauuauuuuaaaagcuccccaggugauucuaacaugcagccaucgcagucuuucuucuaguacauccaacaagccuggcuagaguaaaagggagaggacuagaaggauaggccaggcacuuaacaagacuuagcuuaguauagcuucaugguacacuccuccagggagaaguaucugagucuucaaccaagcuuaagagaccagggaaagcagucagguuuggcauuguagaaaugccuccagcgaaugccaaaguucaagccucucuagcugauucuacucuugaucuuuccugccuuccuuuucacuguguucuaauaauaauugcaaauguuuagugagcacuaucuaccaaaugcuuuguuagagguuuuugcaaauauuaccccauuuagucaucacaaaaucaagguaaauauuguaaacuucucuaagaggugaaaauacugagguuaaaaucaagugauaacccagaaucacauagcuaacagcuggcagagcaagauuucagcuuggauugaucucacucugaagccuuuuucacgauacucuacuaccuauaguguauaauuagaaaucaguuuuucuuaagaaauuaagagaggccaggcaugguggcuuacgccuguaauuccagcacuuugggaggccgaggcuggaaggucauuugaggucaggaguuugaaaccagccuggccaacaugaugaaaccccaccucuacuaaaaauacaaaaaugagccggguaugguggugggcgcuuguaaucccagcuacuugggaggcugaggcaggagaauugcuugagcccggaaggcagagguugcagugaccagagaucgugccauugcacuccagccuaggcaacagagcaagacuccaucucaaaaaagaaagaagagaaaagacacucacugaaugaauuaauacauugauaacaaugucuucuguuaucauuugccuaaaacuagguguuuaaaggacuguuuaaucuucaaauaacaggguuuguggaaaauuuuguuguugcuuuuucaaaauuaauacuugggacuugggugugugcaguggcaugguggcccaucauugguauauaucuuuuucuaaguuucuuuuuccugagacaaauacuguaguuaaauuuugcuuaagggaugacacuucacguuugcguuauuagauuccuggguccugggauccaaaaccugaguauagcgcccgagugugucuguuuuagugcaaucacuaagagccucuuucuagugauugcaaagguagguacagaacaaaaguguguggggcaugcugaagggcugcccuggggcugugaccauucuccccagagcuuccucugcuguggaguccuaaggaaauuguuucucauacucuguucccugugguccucuugccccuaccuccagccacucccacauuuggccaggagcaucaggugagucugguccucaggauuccuuugucacugaagauuagaccaauuaaaggcgaaagaagcaaacacucagaagaagacucuucauugccuuuagacuguaaaugcuggcagucugguguugagucaaccccugcauccuggaagaguuuauggcacuguucuuuuuuuuuuuuuuuuuuuuuuuuuuuuuuuugagacggagucucgcccugucgcccagguuggagugcaguggcgggaucuuggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgccugccucggccucccaaagugcugggauuacaggcgugagccaccgcgcccggccggcacuguucuauucuaaaguaugguuccuaagaaaaucagaaaaaaaguuccuuguuagucaacauauuaucgccauugauacccucagucugcaggacauaugguguuguacaaggaggaagccagcugagaucaagguggaaagcuuauauaauuuauggauaccugacacaguuauccucauaaauaaauauuuauugacuugaaacaacagcacuugcuaacucaggugucacauuucacucucaggugucacuguucauacucgcucagguaucacccauguguuugcucaagugucaucuuggaguauuacccucucagaucacccucaggauuacucaggcauggccugccugcacaacugguagcuucauuauucaaaugggauuguccuuccuccaggaaguuucuccuucccaguguauuugauuucuugccaacgcaggcaccagaacuuccugccuuuacagaggacucacugccucaucacauuucccagauuuggaaucgagauuuugucagacaauuaaugggcauguuuuucaguuuuagagauucacaauuuuuuacagucauuccuauacccauuuuauauagucagagguauucauuccuaggaauuuugauaaacuuguuucauguuuuaucauugccuuggcuguaaugggcagccaguuacagugccauguauccuuaagcacauccuuuaucucucugagccugaaacauguagauaaugauagaugauuggguuggaugauggggagaaggaagugagaugacauacauaaaauuuauaguaugaugcuggcucaacuuuccacauguauuauucuuauuaagucccugaaugauguuucccagcaccaccacaguuuuucguuuuguuuuuuugagguagagucucacucugucaccuaggcaggagugcaguggugcaaucacgggucacugcaaccucaaccuucugggcucaagcgauccucccacuucagccuuugaguagcuaggaccacagguguucaccacuacaccuggcuaauguuuuuaaaaaauuuguguagguguugcccagauuggucuugaacuucugggcucaagugauccucuaucucagccucccaaagugcugggauuacaggcaugagccaccacaccaggcccaguuaucauuacuuccuauuguagcagauucccauuuuacuauucacguaauauguucucucuagagaaccuagauuuagaaacuugcccaacagaguuuaguuagggaaggaguuugagaaggaggaggcagugagaggaaaagggagcuuaguaguuuuaaaggugauugcauuaauuuugcucaccuccuacaguugcauuucccccaaauagauucucucuuucucuuaucugcuuccuuccuuuuuuuuuuuuuuugguuugcucuagggagcccaugauauuucauguugaucucuaaagcuauauuuuuccaugaaacugauuguuuuacauuuaugaaaaaaagaaauaguuuaaguuuuagaaguuuacacaaagauguuaguucguuaguaucuuuucuuuuuguuuuguuuuugagauggaauuuugcugucuuguccaggcuggagugcaguggcaugaucuugacucaccgcaaccucugccucccagguucaagggauucuccugccucaaccuccugaguagcugggauuauaggugcccacuacccacgccuggcuaauuuuuguauuuuuaguagagaugggguuucaccagguuggccaggcuggucucgaacuccugaccucaggugauccacucaccucggccucccaaagugcugggauuacagacgugagccaccgugcccggccaauuuuuguauuuuuaauagagaugggguuucaccauguuggcaaggcuggugucaaacuccugaccucaggugaccgcccuucucagccucccagagugcugggaguacaggcgugagccucugugcccggccauaauucccauuuuauagauaagaaacugagacccuuaaaaguuaagugacuugcgguagucuacacaaccacaugguagagcuggcaugugaacccuggcaaccugacuccagauuucaccguuuuaacugcuauacuucaguuguguaugucauuuacaaaaaugugaugacuuugauauucacagacugccucauuuuuacucuucauagcucaggugcauuauuauauaguuucuggaaggcaugacuacagcaagcuguuauuggaaaaaauuggcccaaggaccagaaacuccucaugccuucucuaaaauauauuuaaccaggaaagggcaucucaacauguuaggucucugagaugcacuuagagauacccaguacauuaugguguacaagaugcagugaaaacccaaguucaaaagucuguaacacaaucucagaagccaaucuuuuuugacacucuugaggaagaaccacagggccgcccuuugcauuuccuguucauauccacguuuccuugugaaguauggucuugaggccucucugagcucucacuaggucucaguggacuagcaucauuaguaacaucauuacucacauguagaagaggauaucuggcuucuauuccuggccugacaauauucuaccuaugugaccuuguauaagucacuuagcuucucuguguuccuuauuagucagacauauugcuuuuacaaauguaaagguuuaagaccucccuugucuuuucauaggauuuguaaaugacaaaaaaaaagaccuguaagaaaucuaaaacucuaaaaggaaauauaccagaauuuuauaaucacugggauuaugagagauauauauucucuucuuuauccuuuuccuauauuuuccaaguuuuccacaguaaguuugucuuuucuaaugaagaaaaaaaagaguuugagaaaggaacgauaccaaucuaugaugauccaucagcaucgcaucccagccuguguaaacaugaagugaaagggacagggagaagccagggccagaaagugcauuuaaaccagaugguucagucacagcgcuggccuuaagugucuuacccagcaucugagcuuaguuagcagugcuuuuuucucagcacuugccauauccaguauaagagauuaccacuguagcucuuaugauuucauuagcuuaaaggugguagccauauaguugaugaucuagcuuuauaaauuagcagucuucucuuuacaaaaggauucaucauguugucucuuuaaauuuuuagcaaacuuuuuacaaaauggguguauuuaaguaugauucugaauuuugauuuuacaucucacauacagauaaucuuuagaaacauacuauugcuuagaucauggaaaaaauauuuuuaguuaauuaaauuucuaaaaagcaaccacuacuacuuguuaagauauuuuaugucuuauuguugaaguuuggcucugucaacuuuuggauucuuaauuuggaaacugugacuauguucaauaugauauaaauuaaaauggugagagauugagaaaaaaugaaauaggacuuucuuauucuuuuuuuuuuuuuuuuuuugagaugcaguuucacucuugucccccaggcuggagugcaauggcacgaucucagcucacugcaaccuccgccuccuggguucaagcaauucugcugccucagccuccugaguagcugggauuacaggugcgcaccaccaucccuggcuaauuuuuuguauuuuuaguagagacggaguuuaaccacauuggucaggcuggucucgaacuccugaccuugugauccucccaccucagccucccaaagugcucggauuauaggcgugagccaccgugcccagccucauuauucuuaauucacugcaaaauaaaugaauuuauuguaagugccccacaguguagugaaaaauacauggacuuuggagucagauguacuggauguggaauuuggcucugccacacagcagauguuugacuaugaauaaaucaaccugaguuuguuccucaacuggagauguugaacaaacucagaggaacaaacucaagagguuguuagguggagauaaucuuuguauucgccuaacauuaggcuguggugaggauucuaucaaauaauuuuuuuuuuuagacagacacucgcucugucaccaggauggagugcagugguacaaucuuggcucacugcaaccuccgccuccuggguucaagcuauuccccugccucagccucccaaguagcugggacuacaggcgugcaucaccaugcccagcuaguuuuuuguauuuuuaguagaaaugggguuucaccauguuagccaggacggucucgaucuccugaccucgugauccacccgccuuggccucccaaagugcugggauuacaggugggagccacugugccuggcccaguuauucuuuuuuuaauuuguagagaugaggucuugcuuuguugcgcaggcuggucucaaacuccugggcccaagcgaucccuaccucagccucccaaaguucugggauuacaggcauaagccaccaggccuggccucaaauaacacuguuguuguuguuuuugagacagagucuugcuuuguuuccuaggcuggagugcaguggugcgauaucaguucacuacaaccuccaccucccggguucaagcaauucucaugccucagccuccugaguagcugggacuacaaguguacaucaccauaccuggcuaauuuuuguauuuuuaguagagaugggguuucaccguguuggccaggcuggucucaaaggccugcacuaaagugauccaccugccuuagccucccagacugcugggauuacagguguaagccaccaugcccagccaauaaaauauuguugacuauagucacccuguuguauugucaaauaguaggucuuauucauuauuucuuuuuuuuguguaccuauuaaccaccccuacauccccacuacccuucccagccucugugguaaccauccuucuagugucuauguccauggguucaauugcuuugauuuuuagaucacacacauaagugagaacaugugauguuugucuuucuaugccuggcuuauuucacuuaacauaaugaucuccaguuccauccauguuguugcaaaugacaggaucucauucuuuuucauggcugaacgguacuccauuguguacgagcaccacauuuuuuuaauccauccuuguuuaaguucuuucacuuuacucuuuuuuuuuuucuuuggagacagauuuugcucuuguuguucaagcuggcgugcaauguugcgaucucggcucacugcaaccuccgccucccggguucaagugauucuccugccucagccucccauguagcugggauuacaggcaugugccaccacgccuggcuaauuguucuauuuuuaguacagacgggguuucaucauauuggucaggcuggucucaaacucuugaccucaggugaugcaccugccucggccucccaaagugcugggauuauaggugugagccacugcaccuggccuauccauucaucucuugauggacacuuagguugcuuccaaaucuuggcuauugugaacagggcugcaacaaacaugagagugcagaucuuguuuauguuuuacuuucugggacauauccuuaacuuacaacuucaaaaaaaaacuacuaaaucuuacaaccuuuuauuuuauuuaauuuauuuuucccccugaacuugauaguaggugauuauuuuuuaagagaugggauuuuuguccccuaggcuggggugcagcuuacugccucagccuccugucugggacuacaggugugcaccacuaugcccagcugauuuuuguagaguugggggucucacuguuugcccaggcuggucuugaacuccugggcucaagugauccuccugccucagccucccaaaguguugggauuacaagcaugagccaccaugcccagccuaaaucuuacuaccuuuuaaauacaauuuuuacuuuaucauauuuuaaauuuccaagugcuuugucuauucccucuuuugguuugguguuuucaugcugguggcuuuggcuuucuauucacguuuaaguaugaggcacuaaaaaaauaacagucacaaaguuugugugucagaggugugcuugcugaucauuaagcuucacuauagguugaaaguuaauuggcuuugccggggaaguccccaaaauguaaacaugugaagggcuugggugaggguuucuccagagaauucuggcugaggacugauguuggggaaugcugguguguugcuuuuacuuaauccuuguuuaaguucuuucacuucacucugccccacacugugccuggugcuuaguccucuuuggucucugguucccauuuucuggagacuauaccuucugccuccugcacaggguggggaugaauggggacuguuucaccaagggcuuuacugcucugaucacugacuguguguaucuuugccuuaucccaacaguaccuggugcuuccagagucugagccccucuuagggauccuaaugggcugauagacugacuccccccuuuccuacuuacuuacuuaguuuauaacuucauugcuggcaauuaccaucccuucauuaucuuuccacauucuaaaauuucauugaaauauaucacaccaguaaucccagcauuuugggaggccgaggugggaggauugcuugagcccaggacuucgagaucagccugggcagcauagcaagaccccaucucuguuuuuuuauuagaaaaaaaaaagaaaaaauacauuguccacugcuacccccuuuucuuuuacuggcuuuaaaagugaauacaguuuuaaaucuuuauuuuuaaauuuuuauuuauuuauuuuuuugagacagggucuugcucuguaaucacagcucacugcagccucgaccuccugggcucaagugauccuccugccucauaaguucugagaacuucugagaagcugggauuacaggugugagccaccaugcccggcccaaauaauguuuuuaaaguucuuuguggcugggugagguggcucaugcccauaauccuaccacuuugagggaccgaggagagaggacugcuugaacucaggaguucaagaccagccugggcaacauaguaagaccaugucucuacaaaaaauuuuuaaaauuagccagguguggcgaugcacaccuauaaucccagcuacucaggaggcugagccgggaguaccucucaaacccaggaagucauggcugcagugagcuaugaucauaccacugcacuccagccuggguaacagaguaagccccuauuucaaaaaaauuuuguuuugccuuuuuuauucucaguaacuaacacucauaccccuguccaaacuaagggcagcauguucuuaaauggcuguguuuucaguggcugcaggccaauccugacgcuucaccuccccugccccauuccaugauggccggaaggacuccuguuagucuuuacucccagucuagggugagugaggauuagucucaagggaaaucaugggcuuaugguaauuacaguaacucaucacuuccauauuucuacaucgggccugcccuccuuuaugacugcauccugguagaacagguggaugugauuagucauucuuuaaugcacauuuauguccuuugccuugguuacuaagauagauggguauuaggaguccuugcuuuggagccaaguuaugcccuggggauuuuaguuaggcuaaauccaucaaagauacuaaaaaaaguauaugagaucaagaaguaaauuagcucuugagcuauggaauguucuuccacaggauuaguauuucacauuguuuucauugucauuggguacuaacuagguauaauuuaguguuugagcaguuuuccaccuggacagaaaaaacugcagugcacugacacaauuauaugucugcugucuacugcucuuagccaacucuuaguagccagaggcuuuuguuuacuccuuggggaagucauccuguggauuuuauuuucaggugaucuuaaagggcagcaaggagcgcagcacuggggccacuggaguuaaugcagacuccucccgcucccaugccgucauccaaauucagaucaaagauucagccaagaggacauuuggcaggugagcuggaaauaucagggaguuacauugucugccuuuccuuuaaugugacuuugaaguauguuuucucaacaacaggauacccugcuaccauggaguucuucauugcagggauacagaguagaguuguuagcccugaaauaaaucauuguacuaaagugucaacaguugauuaaccaugaaguaaugaccuauuguuggucaacccuaaguuauuaaaagggacauugauugcuucuaacaugaaacacaguuucagcagagaaacaguagggaaugcaucucagagagcuuacacgccaaaaaaagguagggggagaagauuaauccauucuucuugaaagaagccauaagacaauuggauacauucauugccucucuggugcucucuuagcaaauaaucugccacacugauggaugagccuauuucaccucugaguaaugaauguuuuucuuuucuuuuucuuuuuuuuuuuuuuuuuugcuggauugcuguccgcaaaaguuucuauguaauuaccuaagugguuacuuaagugauuagcauuguggucauuuagccuuuugggaagaauguuuuauuaauuuuagucauacuuucucauaaauuauuaaaaccaauagacauguuugaguggacaguaccagcaucaacugacagaucagaaucuugugauacucuuggaaagcugacacucauguuucuuuguuuguaagauagggcuucacucugucacccaggcuggagugcaguggcaugaucauaguuuacuacagccuggaacuccugggcucaagcauuccuccugccucagccuccugaguagcugggacuacagguauggaccaccacaccuagcuauuuuuuuuuuuuaagagacaggguggaugugagggagaucuggcugcgacaucugucaccccauugaucuccaggguugagacggggucucucuguuuugcccaggcuggucucgaacuccuaggcucaagagucuggcaacagagcgagacuccgucucaaaaaaaaaaaaaagguaaaaauuaagugguaggcugaugguggcugacaucuguaaucucagcacuuugggagggcaaggugagagaaucucuugagccuaggaguuagaucaauggggugacagaugucgcagccagaucgcccucacauccaccccgucucuuaaaaaaaaacauagcuagguauggugguccacacuuguagucccagcuacucagccuaccagcuaauuuuuacaauuuuuuuucuuuucuuuuuuuuuuuuuuuugagacggagucucgcucuauugcccaggcuggagugcaguagcacaaucucggcucacugcaagcuccgccucccggguucacgccauuuuccugccucagccuccugaguagcugggacuacaggcacccgccaccacgccuggcuaauuuuuuguauuuuuaguagagacaggguuucaccauuuuagccaggagggucucgaucuccugaccucaugauccgcccgccucagccucccaaagugcugggauuacaggcaugagccaccaugcccagccaauuuuuuuuuuuucuugagauggagucuugcugucgccaggcuggaguguaguggcgugaucuuggcucacugcaaccuccgccucccggguucaagugauucuccugccucagcucccaaguagcugggacuacaggcaugcaccaccauacccagcuaauuuuuguauuuuuaguagagacgggguuucaccauguuggccaggguggucuugaucucuucaccucgugaucugccugccucggcuucccaaagugcugggauuacaggcaugagccaccacacccagccaguuuuuagaauuuuuuaagagauggggucuugcuguguugcuuaggcuggccuagaacuccuggccucaagcagugcuccaccucagccucccaaguagcuggguuuauaggugugagccaccacacccagcucaguaauguauuuucuuuccagaggaugggccaauguuaauuucuuccaguggucacagaaugcuggcugauacaaaaauaaagcuucuggccaggcgcgguggcucaugccuguaaucccagcacuuugggaggccaaggcgggcggaucacgaggucaggagauggagaccauccuggcuaacacggugaaauccugacucuacuaaaaauaccaaaaauuagccgggcgugguggcgggcgccuguagucccagcuacucgggaggcugaggcaggagaauggcgugaacccgggaggcagagguugcagugagccaaaaucgcgccacugcacuccagccugggcgacagagugagacuccgucucaaaaaauaauaauaaaaauaaaauaaaauaaaauaaagcuucacagaagucacuccugcugugucuuuucucuaggaucucuuuuauugacuuggcuggcagugaaagagcagcagaugcaagggacucagauagacagacaaagauggaaggugcagaaauaaaucagagucuacuggcuguaaguuguucaaaaucuuuaaucuaaaaauccuucuugaaagacugcccauuacauacaggcagaguggaugaaugugggauggaaucagcaaagcaacugcccuguucuuauguaguaauagaaugccaggguuggagauagagggcugaccagacagacucucacaauucuaggcaacuauuuucuucucuccuugccuucuuuuccccuggucaauccaugccaauuaggaacagaaguauuucugcaguugcugaaugguuaacuccgcuaagcuuucucucuuuccccaagcuuuaaaauuauauuaauuuuucaaacauagaaaaguagaacaaauaguaucaugaucucccauauaccugucagauucaacaguuaccaacauaugaaaaaucuaagcaaccccuucccucccccugguuggauuauuuuaaagaaaauccagcugggagcgguggcucacgccuauaaucccagcacuuugggaggccagggcagguggauaacuugaggucaggaguucgagacaagacuggccaacauggugaaacucugucucuauuaaaaauacaaaaguuagcugggcguggugccgagcgccuguaauuccagcuacucaggaggcugaggcaggagaaucgcuugaacccaggagguggagguuguagugagccgagaucgugccauugcaccccagccugggugacagagugagacucagucucaaaaaaaaaaaaaaaagaaagaaaauccuagucaucaugucauuuauuccauaaauauuguauauaucucagcugggcgcaguggcucacgccuguaaucccaacacuuuuggaggccgaggcagguggaucacuugagguagaucagccuggccaacauggugaaaccuugucucuacuaaaaauaaccaaaaauuaguugggcaugguggcaggcuguuacaaccccagcuacucgggaggcuguggcaggaaaaucucuugaacccaggagguggagguugcagugagcugagaucaugccacugcacuccagccugggcaacaacagagcaagacuccaucucaaaaaaaaauuuuuuuaaauguaucucaaagagauacuuuuuaauguagccauaaugccauuaucuuaccuaaagaaguaauucuuuauuauccaauaaguauuauaauuccucuaauugucccauaagugucuuuuuauaguuaacuuguucaaaucaaggugccaauaaaauccuaugugaguucuuauucccucuuucauuuuuucuauaucaguguauugguugaagaaaacugggucacuuguccuguaagauuugccacauucuguacuuggccaccugcaucuuuguguugauguuuaacauguuacucauuauccuuuauguuuccugucagguggcuaagcucuauagccguguuguucacuauggcagccaccagccacauguggcaauugagcacuugaaauguggcuggucugaauuaagauaugcucuaaguguaaaauacacacuggauuuugauuaccaaaaaagcuuguagaauaucucauuuauuuuuuucauauugacuacaugcugaaauaauauuuuggauauauugaguuaaauaaaauauauaauuaacauuaauuuuaucuguuucuuuuucuuuuuuaaaaaaagauaugacuauuagaaauuuagaauuacauauguguuuugcauuuguggcucauguauuauuucuguugggacaguccugaauuagagaugugaucagauuuagguucuauauuuuuuggcaaaaacaauucauagguaguucuuagauuuucuguagcaauacauuaggagauagagaaugucuaguugucucucuuugugauuuuaagauugaaaagagauucaaguguugucagccuaauuucucuauuauaaaguuuccuuucagccuuuauuuuuuauuuuauuuuauuuauuuuuacuuuucuuuccccuuagucucuguuaaggacaugccauucagccguuuuuaaccuaagaauuuuaucagccauugaagaaucucaucuauaucuauuauuuuauuaagaguuccagaauggugauauucuaauucuaauauuccuucuguauguauuagcugaaaagaauaauuuucccucaacuaucugauuuuccugacauacaguuuguaguggaagcaagaugauucuuuaauuuauucaccacuuuucagaaugaguuggaguucauguuaccuaaacauaauaugaguuuguuuuauuguuguuguuuaccuuuuuuucuauuauuauaaacugaaaucauuauaucuuuuuuugcugcuuaaauucaacauauuuagccaauaggagcuguuucaagaauguuccugugucuuuuugguacaacccuacucguucuugauagcuuccuggcuuucugauaugacaagagccuauguucuaggcucauuuuauacauuucccucuccagaccucgaaucagccauuucuucaaugagucuugguuucuuuuucuuucuuuuucuuucuuuuuuuuuuuuuuuucugagauggagucucacacuguugcccaggcaggaguacaguggcacaaucuuggcucacugcaaccucugccugcuagguucaagcgauucuccugccucagccucccgaguagcugggauuacaggcaccugccaccacaaccagcuaauuuuuuguauuuuuaguagagacccgguuucaccauguuggccaugcuggucuugaacuccuaaccucgugauucgccugcuucggccuuccaaagugcugggauuacaggcaugagccaccgcgccugguugagccuugguuuuuuugagacggaaaugguguuuagagacuucagucuguguauuaggggugcuuaucacuacuguguuagcccuugcuucugggccuuuucuguggacagagcuaauaaauaagguguuauuuuuuguuuugaaaaggaaaaauauaugugguauaugugggauuuauaguaauaaauuaguuuaagauugcaggccaggcccaguggcucacacauauaaucccagcacuuugggagguuaagguggacagaucacucgagcccaggaguuugagaccagcuugagcaacauaaugagacccugucucugcaaaaaacuuaaaaauuagcugggcgugguggcacacgccuguagucacagcuacuugggaggcugaggugggaggauugcuugagcccaggagguugaggcugcagugagccaugauuguaccacugcacuccagccuaggcaacaaagcaagacccugucucaaaaaauaaacugucucgucugaagaaagccaaugaauaauaauauuaaaaaaauaaauaaaauuaaaauuacacaguuuuuauuuaauuuauuuaaauguuuauuugucucuuuuuucuguuaugcuagaaaucuuaguuccuagcaacauuuauuugcucuacuuuaauauauauguauuucaaaauaaugcuaauauuauuuauaauaugauuaauucaguucaagauuuuuaucgcaguuuucuuuuuaauuggguuguaucccacuaaggauguacagucauaauauuaugcugucaaaucaccugaaauaauucuucucuguguguuuaagccugccaauuucauaguguuagguucauuuguuugguuuugguuuuacgaauugccuuauuuauuuugauuuaaccuuauuuuguaauuauuuuaaaacauuuaggccaggagcuguggcucacaccuguaaucccagcauuuugggaggccaaggaaggaggaucacuugagcccaggaguucaggaccagccugggcaucacagggagaccccugucuuuacaaaacauuuacaaauuagcugggugugguggugcgcaccuguaacccaagcuacuugggaggcugaggugagaggaucacuugaguccagguauucaaggcagcagugagcugugauugugcuacugcacuccagccugagauacaaagugagaccccaucucuuaaacaaacagcaaaaagcaaaaaaaauuaugugguuuuaaaguaaaaauuguaaaauaagccacauucaaagaaguauaguuuccaucccuguacucucaaccuuguuaccuuccuccccuuguaaaaucauuuuucugucuauauauauguuugcacucaccccuuuucuuagaaaaaaugcuaacauacucucaacacuauuuugcacuucgcuuuugucacuuaacggcauccucaagaucacugcaugacuguacauagagcucuuccucauuccuuuuuccaguuguauaugcugccuugugcugcuccacauuauuuacuuauuuuuuaucagaacugaagucuccagguagguacauucuuuccagacuucaugagggguaaguugggagggugagagagggagccaaacuuuuuuuauuuaaaaaaagaaaaaaagcuuguagggauugguggccacgcuugaauuugagucugugaggaacaggguuugauuacuuguucguucucaguggagaaucuucucagugcuaaaguuggggaauacuggauagauuuuuaauaaaagaggaaauuuccucacaccuguuuauacccugcagcuucuuggauagagguagggcaguugcgggcaucuguggcugcugcuaagaacagccauagcacacucuggaggcaaacuaccuauucuugguggcaauuccaagggauugcuuccaccuucuucccucuuuuuuuuuuuuuucucuugagacggagucucgcucugucacccaggcuggaguacaguggcaugaucucagcucacugcaaccucuacuucccagguucaagcuuuucuccuuucucagccuccugaguaacugggauuacaggcaugugccaccaugcccggcuaauuuuuuuuuuuuuguauuuuuaguagagacaggguuucaccauguuggccaagcuggucucgaucuccugagcucaaauaaucugcccgccucagccucccaaagugcugggauuacaggcaugagccacugcacccagcuccuuuucuuuucuuuuacuaucuuuuagccuagaugcaucacucagaaauagaaggucucuccucccucaucuugccccccacgacccccaccacuguuucugaugggaguguuuccccuggagguccacauauccagaucucugcuguccuuaucauguccaaugagcgcuucucacugagggaguacagccaugagcaaggaacauuccuuugccuuugggccacagacccugcuguuuuuaaaugaagggucguuuuuaauuguguguggucaaagugcuggcuguaaucccagcacuccaggaggcugaggcaggaggaucauuugaggccaggaguuugagaccagccugggcaacaauauacagagacccccaucucuacaaaaaaaaaaaaaaauuaagaaaaaaauaaauaaaacgaggggguaggccuaggugauuucucaguuuccuucuagcucuggcucuagaauuucuccuaccccauucagauaguuuauaucugaaucuaugcuugacucuacgccaacgggugugcaugugugagcagggaguggggaaguggauauagauauuuugucuguuuaagugcaucaacaguugggaagaaugugaggagagaaagggagccagcaagccagaacuaccaccacaugagcuugaacucugggacuugaggguaggucccagcgucugucuguuccccgccgucaacucaggggcaguccuaggaucccagccucuaagcugggaggccuucagcuaggcagcacaggaugguguuucccaaucuagcuugguuucucuuguugaauggaaacuacaggccauuuugacuuccuuuuggaggauugucugagugugguuuauugaagaaaaacaagcuuccuguggaggcggcaucaggucuguuacucucccuuugcacuugauacuugaugugcuuguucucccacuuugcagcugaaggaauguauccgagcacuggaucaggaacacacccauacucccuucaggcaaagcaaacuaacucagguaaaguuaaaugugagccuugaguuuguucugauucauuccuuucuuccuuauuucauguauuuguucauucagucgagcauccacugucaguaagacaugaugcugggcacaguggggaaaagagaaggagaggagugaaauuccauccaggaacucugucuacaaguugaguaucauuaaucuaaaaaucugaaaucugaaaugcuucaaaaaucaaaacuuuuuguuguuguuuuugagacagggucuuacucugucacccaggcuagagugcaguggugugaucuuggcuuacuguggccucugccucccaggcucaagcaauccucccaccucagccucccagguagcugggacuacaggcauaugccaucaugccuggccauauauauauauauauauauauauauauauauauauauuuuuuuuuuuuuuuuuuuuuuuuuuuuuuuugguagagacaggguuucaccauguugccuaggcuggccucgaacuccugagcucaaacgauccgccugccucagccuuccaaaguacugggauuacaggcauaagccaccaugccuggccaaaauuaaaaacuuuuugagugccauuaugcucaaaggauuucagauuuuuggguuagggaugugcaaccagaaggauaaugcaaauauuccaaaaucugaaaaaaaaucugaaauccaaaacaacuuuucuucccaagcguuucggagaagggauacucagccugucauaggacuuuaggaaggggcagacucaggcagggauaucuucaggaugggguggcagggguuccuuggggagagcagugcuguucuggucaccaccuuucuguuuauuuccaguguaugguaacucugggcagggcacaguggcucaugccuguaaucccagcacuuugggaagcugaggcaauuggaucacuugagcccaggaguuccagaccagcccaaacaaccuuucuauaaaaaauuuaaaaauuaacugggugugguggcucgugccugugggcccauggucccagcuacuugggaggcugaggcgggaggauuacucgagcccuggagguugaggcugcagugaauugugagcacgccacugcacuccagccugggcgacaaaaagagaccucaucuuaaaaaagaaaagaaaauguugaauuagugaaaucucuaagccuuugcauugaauagggugacguagcuaccugauacuuucuuggcucuaagacuuagaccacuguuucggcacaaaaaaauaauggcuucaggcaguuaaaaugaaugagcuagauuuucuauauguacugauaggaaagaugaccaagaucuauugugaugugaaaaaagcaagcuguagaacaagguaauaaugugauugccuauaugauuucuacuauuacgcagccacacagggaaaaacguuuaaaaagaugcagaagaaacagcauuggaucuauuuggaaguaacaaugggaguaaaggugaaacugcaacuuuucauguuaaaagaucauguacuguaugaccacuuucuguuuuuaucauuuuuaaaaugugcgacauggaaaaaaacacuacacaaaaaaaugacauaaauguuaacuaugauuauucuuaguggaacaaauaggguuuuuguuuuguuuuguuuuucugucaugaaagugugccucuuuauuaacaaaaaacuccaguagauguuaaaucagcauucauaauggcugcggaagaguggcaugggaggguguaccuagguauaaacagcugugaagacaguuguggguguccuggguucuuuuucgccuuguguccugugcacaguggaagacagacaagguagagagaugucuaggagaagauuuuuuuguaugcugcaggaugaagccagccccgcacaugggcagaguuuuauucugugcagcuagaguagcggcuccauaguacuugggcagaaccuguaaaaacauaguuccuuacccaucacaguuggugaucuguagguuaggucuucucaaacaugauuuuaaccagggacccaggaaccuacuuauaggugguuaguccugauucuggcauuggcucuguugcuuuuuacuuauuuauuuauuuauuuuugagagggagucucacucugucgcccaggccggagugcaguggugugaucuuggcucacugcaaccuccaccuccuggguucaagcgauucuccugccacaagccccuggaguaucugggacuacaggugugugccaccaugccucacuaacuuuuguauuuuuaguagagacgggguuucgccauguuagcgaggcugguuuugaacuccugaccucaggugaucugcccgccuuggccucccaaagugcuaggauuacaggcaugagccaccguccccagccagcucuguuauuuuuuaagacaaguuccccauuuccagaaaauguguuucuuuuuaauuaaaacauaagaauuccaauuguacauacaaguauaaagaagaaaguaaaagauaaagucccagaccucagugauaaccacacacugcuacguuagugaacuuccuucuagucaucucucugcccgcauagccucauauggaucugcuuacggaguuauggagucauacaccuuuuucccucgaagauagaagcuuuagauaucuuucuguguuccuaaguacagguauaaucauuuuuaaugguuuuauuauauucaguguauaauuauuuaguuuguucccuguuuauagauaccuagauuuuuacuaaauauuacuauuauaaauaauguaaugaauaucauauauacuuuuuuuggucaauugggcaauuaucuccuuaggauaaaguccuagaagugugauugccaaaccaaaacauacuuuuuccuguuuuugagacagguucuugcuauguugcccaggcuagucuugaacuccugggcucaagcgauccuccugccucagccuuuugaguagcugggacuacagacaggugagugccacuguaccuggcuucuuuuuacauuuugauacauauugccaaacugcccucuggaaagcuuguccaguucaugguacaugcuagcguagaagaguacucauuucccuggacccucaccaaggaauggcaucguuagucucuuaaucuaaugaguuaaaaauauugguuuuuuuaaugguuuguuugcauuuuuuggauuagugauguggugaguaccuuuuucuguguuuauuggccauuuguauuuuuucuuuuguuaauguuaauuaccuuuuuguggacagaagggaacuauggcccagcauccugcaccuaguaaguagucaguaugcacuuuguuaauugacuucacucauugaccugccuucuguuuuggacagguccugaaggacucuuucaucggcaaugccaaaaccugcaugaucgccaacaucucaccaagccacguggccacugaacacacucucaacaccuugcgcuaugcugaccgguaagucagcucccagauggcagguuguguguaagugugcaugugcaugucugugcagcacgcgugugugagcaugugugcacgcgugugugugugcaagugcaugcacaugucucucccacucacacacacauagggaucugaccuugagcgccacagccuuguucuuggcaauuagucauuugaagacugugaccugguaggcccugucacuuugcaagcaugacaagaggaaaaugacacauucccuuguucaggaguuaauucugucaguggcuuuuaaauggcuagugagaagugaaauauuaauggguggaaggcucaguguuguuuucuuccugcuggccucagcccaaauuguaagagauagaagacauauuacuugucaaggcagaaucacuuagagcuaucuguguccagaagggcccaacccaaacauguuagaggauaaacugagguccagagaaggguaggaucuuuccaaaggcucacuaggaguuggugucagagccagcaacucuugacugccuggccaggccucuuugugggugacugugguaucugcugggaucccuuccaucucucacccuguggucacaugugcucuccuaguagguaagauguuuuugauugccaugacugggaagaagugcuacuggcaucuagugagcagaggccaaggaugcugcuaaacauccuucaagaaauaauuaucugguacaaaaugucaauagugcuaagguugagaaacccugggaauagacaagucauuuuuccuuucauggaaugagcacaagccuguguauuucuggagguuuugcuuccugaggucccagcagguuugagggaacucaucuuccuagagaagccugaaagggggugguuugcagaaaaagaggacucuguggaauugcagguaagugguggacacgaacuccugaguuggccucucuccaggaagcagugugggcccugcauaaacacagugcacuucugagacuggcgucucuggccugucccuuacauggggcuguggugauuuccaaaaggcuucuucugaucauggaauguugggugcaugcuuacauccucagagaagacacuguucuuucucguuuguuuuuuaaagacagagucucacccugucacccaggcuggaguguaauagugugaucauggcucacugcagccuugaacuccagggcucaagcaauauuccccgccucagccucccaaguagcugggccuacagacacgcaucaccaugucuggcuaauuuuuuuauuucuaguagagaugaggucuugcucuguugcccagguuggucuugaauuccugggcucaaacaguccuccugccucaaccucccaaagugcugagauuacagaugugagccacuacaaccagccaacacugcucuuuuucauucagguacagagggauaucucaugcugaaacagaauguucccuuuuccucuuauucuaucccagauaaagaaauaacucccaauccuuguaauacuuuucuuugguuuuuguuuucccagaaagcuauagaaaaggaauugcagaacaugugaaaauacacauuuaacauaaaaugauuauuuacagggucaaagaacuaaagaaaggcauuaaguguugcacuucaguuaccagucgaaaucggacaucuggaaacuccucuccaaaacgaauucagagcuccccuggggcuuugucagaggacaaauguucucccaaaaaagucaagcugggauuucagcagucacucacaguggcagccccugguuccacgagagggaagguccauccucugaccagccacccacccaacauuccuuuuacuucugcaccuaaggucucugguaaaagggguggcuccagagggaguccuucacaagagugggucauucaugcuagcccugugaaaggaacugugcgcucuggacauguggccaaaaaaaagccagaagagucagcaccauugugcucugagaaaaaucgaaugggcaacaaaacuguccuugggugggaaagcagggccucaggcccaggagaaggccuagugcgugguaagcuguccaccaagugcaagaaagugcagacagugcagccaguacagaagcagcuugugucucgaguugagcucuccuuuggcaacgcccaccacagggcugaguacagucaagacagccagaggggcacgccugcuaggccugccucugaagcuuggacaaacaucccgccacaucagaaggagagggaggaacaucugcguuucuaucaccagcaguuccaacagccaccucuccuccaacagaaguuaaaauaccaaccacugaaaaggucuuuacgccaguacaggcccccagagggucagcucacgaaugagacuccgccucuguuccacucuuacucugaaaaccaugauggagcccaaguagaggaacuugaugacagugauuucagugaagauucuuuuucacacaucucuagucagagggccacaaagcaaaggaacacccuggagaauagcgaagacucauucuuccugcaccagacguggggacaggguccugagaagcagguggcagaaagacagcagagucuguuuucuagccccaggacaggugacaagaaagaucuaacuaaaagcuggguggacuccagggaccccauaaaccacagaagagcagcacucgaucacagcugcagcccaaguaaggggcccguggacuggagcagagagaacucuacuuccucagggccuucucccagagacagccuggcagagaagccauacuguucacagguagauuucauauauagacaggaaagagguggaggcucuuccuuugaucucagaaaggaugccucccaaagugagguuucuggggagaaugagggcaacuugccauccccagaggaagaugguuucacuaucucauugucccacguugcaguuccuggauccccagaccaaagagacacagucaccacaccucugagagaagucagugcagacggcccaauccaggugaccagcacugugaaaaacggucaugcugucccaggagaggauccuagggggcaguuaggcacgcaugcugaauaugcuucuggacucaugucuccccucaccaugucccuccuggagaacccagacaacgaagggucuccucccucggagcagcugguccaggauggggcuacgcacagucuaguggcagagagcacagggggcccaguugugagccacacagugccaucuggugaucaagaggcagccuugccagugucuucagcaacuaggcaccuguggcuguccucaucucccccugauaauaagccugguggugaucuuccagcucuguccccaucacccauccgucagcacccagcugacaagcugcccagcagggaggcagaccuaggagaggccugccagagcagagagacuguacuuuucucccacgaacacauggguagugagcaguaugaugcugaugcagaggagacggggcuggauggcuccugggguuucccaggaaagcccuucaccaccauacauauggggguaccccauucuggaccuacacucaccccacgaacaggaaguagugauguggcugaccagcucugggcccaggagagaaaacauccuacaaggcuugguuggcaggaguuugguuuguccacagaccccaucaaguugcccugcaacagugaaaaugucacauggcucaaacccaggccgaucucaaggugcuuagcaaggccaaguucucccuugguucccagcugcucucccaagacugcagggacacuccgucagcccacccuggagcaagcgcaguaaguuggacacuuucccuaagacuugagccccuuuggcacccacccuccacuccagcuuacuguuuugucauggacaaagagaagccaugcagggguacgcaggugagcuagucugcuucuagcuccaacccucugcuuuggucccgggcccuccacaggaaguagaaaugauagcagaccaggcaauaggcuccaucuugugccaaguaugccaguugcagucacagccuugagagccuuucugcagggaagcugugggaaaugggcagcuccuguggaagagcagcagcacccagcccugcccccucaguacagcuggggaggcaggagacaacuugggaagccccugucucccucccuguaucucguugguacuccguaauuccuuaccuaauccugagaaagagcaggugagggggagcugguugguaagcuggccuuggugaaaaccuugaccauuuucggcagaggcagcucucagcuuacaaaugagaucaccuccagaaagcuacccaggagaggcugggaggccaggaagaucacaguguucucucugguguucccaggcagguggucauccgagcacaccaggaacagcuggaugaaauggcugagcucggcuucaaggaggagacgcugaugagccagcuggcuucuaauguaaguagcccuggcuggacacucacaggcuguugggaauuagccugcagcuaauuugauggucauccuuguuugcuguggcuguguguggggaaagggucuccuggcacacacuaaccauaacugaggccucacaccuccucuugccacgccuuugagacaucuugaguauagguacaggugggagauggugcaacacucgccuuuuccaggcuaaaauguuuccagccucuauccucagcugcucugccuuccuagcgguuugucggggccccucccugugacuaacagugaccagucugcugccuaccacacguagguauuucuaccaaauacccuucugccuuacaaaauacuccucugcuuggaaagugucucgaaugcagagcagcaggccccacccugugccauagcaacuauccuacauguucucccgcuggaagaguggccuggguucugaaacuuuccugccagaggagggacugaaaaagcagaucuggcagagcgccagcaagagcaaaagcuguauucgucccuuguuuccuucucaggauuuugaagauuuugugacccagcuggaugaaaucaugguucugaaauccaaguguauccagagucugaggagccagcugcagcucuaucucaccugccacgggcccaccgcagccccugagggaacagugccgucuuagagccagacccugugccgagauggugggggcccugcaggagucugugcugggcucucaggcuggaggagccucugccagguccucccugcacacaccagaacccacacgcugguccugccuaugcuagcgucaccccagccccacguggcuucagauaggucccagcuucucccucagggacaggccccugucccucaguuccaugcacaggagugccuccaagggugggccaggccgaagaaccuaaugccuuucccuugugccuagagaauaugauuaacuaaccccuugccugugggaauauauuugggucuaauaacccugaaguuucuaaguuuggggaucagaggaugggguggucagugguagccuagaggucagaggucacaagacagagaagacaacaugcugagaccagaggcuucaccagcugaauucugugccuaacuuagaagacuaaacacuggcccaaacuuaaccauuggugcuagggggacagggguggggugagcucugccccaucagcccuuggagauugauuuggggauuuagaggcguuuuugaaaauguaaauagcauaaaccuugacuugaugugucacugacagcagcagaugugagacaggccuuauauuuacagcucccuucccuuccugcaauccaguguugaggcagaagagggugccugugucacacaucaauuuuucuccugacuuuugcucgggugaaaggccucuguacaaugcccgauacucucaugcuuccauggcagcuccuggcuccuaucugggacaccucacuacccagcccccucauggaauaguccaucuccuagccuggccuucauccaguucacccugcccagccacccugccucucaggggucuguguugggaaccuuggcaguugaacagagugcucuguucaacagucugaggccucugaaacagaauucacacacaaaccuucagccaaguucugccugcuguguaucuuuuuagcaggaagcagcucaggacagggaagacaaaguagccuccaggugccaauuacuuuaaagccacucugggucaaauggagauucaugagucacggccuuggcccgaacgcccauuacuaugugagccuuuauuuccuucagauaaaggauaacuuuuuacgguuuuaaaaggagggcuuaauuaaaaggccaagaagaggguuaaauggcucucuugagacacuagcagccugguccagucacccuuugucagccugacagugccucaucugaccgccagggggcauccuuauuggugcuucccggcugcagggcacugcggccccucccucacaugaucacuaaaaaccuucaaagacccagucuagccaaaagcucaagugggacaauggcacaguauuaaggucaaggacaaaaacuuacuuacuuuaggaaugaacccuauucuaucaucauauacaacagcaccacugagagcuggugaaacaguuuaaaucccauccucugcuuguggcaaaugaugcauaaaugccugcugcucacaguaaaagggcuucuuccucuuuuacugggugaucccccugaaggcccagccuaucccaacuccacagucaggaaggccuacguccuugguccacagacggagcugggccagguuuaaaagacucagucuaggcuugccuuugcaaaccaaaaacgaggacaggucugaagugggaagaaagcuccgaaauagaaaacgguuagguccuauucuauccccagcaaaucuaagcaagaaaucucuuuauacaccacauggcccccccacucccauaaaacagccuugguaauaaagaaguuaucacaccaagacauaccuuuuagauuuuuauuaguaguucucucugaagaaucaaaauaguuaguuagcaaauuauuuuagauucaagacuguauauccuuuguauuuagaucuuuaaugauguacaacauaauacaaaacaaaccagagagacuga

SEQ ID NO: 191365 - RNA, 3049 nt, Homo sapiens
ggaacagaucaacaaaucuuuauuaauagaaacagacagauggacagagaaugcagcaggggcugugugaaaacugugauauguguguguguguguguguguguauguguuguguguguguaaaaggccuucuccaggccaggaagggccccuuggaauuaggcccaccugucuagauccucuccucagugguggguccugggcugaaaccagcuuccacaucauacccccaaaggaagaaugggggucuuucuggaauggaagacgcugacuucaagcauucuucaaauuacucucguuccccagcugagcuuuguugcugaggggguuggggacaagccacaggggcacuugcauagcaggggaguagaauggggauaaggcauauggugaggacaggggagaaggggaagggcaucauagcugcaggugaagggggccuccaaaaggcagcuccucuucccccucauccccucaaauugcugcuggguugaggagucagacugaggcaguauaauacccucccccauccuuaacucuagaaccccgguuugguggggaggaggugggaagcuguggagcuauggaaaggccucaguuagugagucaagcugugaugugugugucugaacacaacuggcucccuugguauaccgggggcucccucuccagaugggugugagugcaugguccuacuguacacacaggucucaguaucuauaugugucucauuuguucccaugggucucuguguuuggauacauaagcauggauaucccugcucauacagcaggaacucaggaucugcaugguguaugucccugucuguaaacaugggcuccagcaaguggauaugugcgggccugcccgcuccugucuauccgcaggucuuccuucaggccuggcuggucaaggguccuggccaaagagguagguggugagcucaagccggaggccccgagcauaggagcgaagaguauagaagagggugaggaaguccugggugcugaagacagugucggccagcgcgaaggccaggguggaugggaugacgccccggccguacuccaccauccauguguuuggcccccacuccacagcuguugccucaccaggcccguguacuaccgucuccccugggggacagggagcacccaagugaaaagccagcucugcccugcccuuccauggcugcugcuucccuggcccauggacuaacuagggguggggaauggagagggagcuucagaaaaacaaaaagcccuaccucacugggcuggcccagauggccacuccuaaauguucuguggcaucaucugacccacguccucucuuuggagaagccauggacggcuaccucgcuuggccauggacccacuguauggaagucugcacucccaagccucacucgaaucaagcagaaauuuagcuaaaccugggcugggcuuguagcuaggaaagggguaguuccaggacuugugaggcuuuaucugaaaaguguagcuguucaaccaccaugccugcgaugcauacacccaaccucaaauauacugggaaguccagugcucuauuucuuaaguaaauuguuucacuauuaaaaaaaaaaaaaaaaaaaaaaggcaggggagcggccgggcgcgguggcucacaccuguaaucccagaacuuugggaggccgaggcggguggaucacgaggucaggagaucgagaccauccuggcugguauggugaaaccccgucucuacuaaaaauacaaaaaaaauuagccgggcgugguggcgggcgccuguagucccagcuacucgggaggcugaggcaggagaauggcgugaacccgggaagcggagcuugcagugagccgagaucgcgccacugcacgccagccugggcgacugagcaagacuccaucucaaaaaacaaacaaauaaaaagauaacugucugucuugucuuuugggguauugagagcauuucugauuacccauugucuccccaacaguuguuggaauacugucugggcaaaauugugccugggcagauaaaaaucagacauguuuaauaggaaguuguuauguuuuguuuccccuugacagaggaaagcaagagucccucagcucugccccaaccaaucaccuguggcuuaugggaggguggaggaagggaaccaugaggagggcccccccaacacacuccuuuuccaugccaugcuccccgcaauugugggcaccccccgcgugaagggacccacuucucugacagagccuucuuacccaccuggguagaagaccucacuuuugguggugcccucucuccacugguggaaggugccagagaugaugguauccgagaucucagcccaguagcgcccugagugacaaucgcacaugacacuaucaggguauucgcgccauugcauggcccagccaaacaucagaaaggagggcaugggccccuuuacaaccccagccucccagucuggcccgccgcuagcacugacccgaguggccgcgggagcccaaggcggugccgaagagcagcacauacucggacagcgaggcgugcagaaggcacauggcgcccauccagccacccgcauucacgaacacccacugcagcuccucgucgggcagcacguggccugggugcagccgccgcagcuccacgaucagacgagagaaggccagcucgugguccagcccuggcggaggcagaggggcggcggagucagggcuggcaccgguccuagguccggggauggcgccuucggaacccuaggcuccgcucccaggccggccgcuccccucccugcccucugcccgcucaccagcguacugccgcgccaacugcgcuaucucuucgcgcuggaagacgaagcucugcguacccagccagagccagacgaccugggucagcaccgcugcgacagccaggagcagcgcggcccacgcccaccgccggcccacggcccacugcaucccggcgggcggccuggcacggcgcagcucaggagggagccggggccugaggcuuugcgcucacggccucggag

SEQ ID NO: 191366 - RNA, 21207 nt, Homo sapiens
gauugguuguucccuuuucggcucugcaacaccgccuagaccgaccggauacacggguagggcuuccgcuuuacccgucucccuccuggcgcuuguccuccucucccagucggcaccacagcgguggcugccgggcguggugucggugggucgguugguuuuugucucaccguugguguccgugccguucaguugcccgccauggcugagcuggauccguucggcgccccugccggcgccccuggcggucccgcgcuggggaacggaguggccggcgccggcgaagaagacccggcugcggccuucuuggcgcagcaagagagcgagauugcgggcaucgagaacgacgaggccuucgccauccuggacggcggcgcccccgggccccagccgcacggcgagccgccgggggguccgggugagagugcgggcgcguuuggggcgagaggacuugucuggaaacucgguccacaguggguccgagagcuucugugugacucgugcuccuugcugaauuaggagguuagggagcagugcaaacaggaaacgagacccuggcccggucuuucagaaaccuaggcucgagaagccuguucgguucucagcauguuugagugcuucugggcgcgggcggagcgagaaagcaaguguaggguggcaggcuccggagccggaagaagcccguucaauucagcaacuuuucauuaagcauuugcugugccuuuaguccggucucugaagcaaccgcauuggcgcaguuuuuccagacuuauaagcuuauaagucugagccgagcacagaacucguuauuagaaaaggagggcggaaaaaaauaagaauggaaauaucguuuuugagagauacaaacaaaaguagcaaugcaguucagcauuuaagcacuuaagguguacagaguguuggauuacgaggaggaaggagggaguagggaacucgaaagaugaucuaggucuggagaaagaacugccaagcgcgguaggaguuugcuaucguugagcgauugauuuacagcuaggacuucuggagcucuuccucugggaacagcuuugguaggcaauauugccuaagcagaacccaagauuagccuaaaccaaucagggagggaugaagaggugaauagagaauguucucagccaaacucaaguaaaaauggggcagguaggauggcaguuugaccuuuggaugccuuaaccugugugugaugcuuaggaucaugaguggaaaagaccuacuuaauaauacaaagaaguaggaaauuuagcuagaagaaaugaaauacggcuuuucauucacuuaaaaaauuccaacuaagggagaauagggcacuacuggggcauauaggaguagugucuacccuaaauucaaaccuuaaggagccagguagguaacauauacgagagaagcuggcuugacaugagacaguagaaguguuggagacugaggcuuugcugcacuauaguagugcucuguguaaaggcauucagauccagcagucucaaguuacugugccagccaggcggaaccuuuugauggauggguuggugggugugcugcuaguuugcagccucuugaguuuuugacugcaccauguugcuuccuaaacaaaucagucccccaauaagaacuuagugggaacauguaauaugcccgaauaugcaacuuuauagcggguagguuggacuaaacuaggcugugauugugagaugaaguuggccuuaagugauuaggggauauuuucauuggguggucucuaacauuugucugagaauuuuaaaauugacuucuuagacccuuaguuuaaccuuccucauuuaauagaagagaagcaauccuagagagaaacgacuugcuuaaaaaagcacgaguuaauagcugagccccaagucuacccacucuuagaauauaccacauucuguugcaguguuuaguuguuuuagcagggguguagugcgauaacagacaggcagcuguggcugucccagguggaacagauuugggagaagcagaacccaagaucuguaguuggaagauuguccugauucaaggacaguguuacccuuacuguuuuaucuccacugccuagcagugugucugacauguaguagaugcucacguuugacaaagaaaugggcaaaaaugucagauccaaggguccuauguagaacugacagaucuuggugacgggcaguuagggaagguaaaagggagagaauagaguuggaugcucgguccuuugugcaucaagccuucggcaaagggaaggaaagaaaugguugcugacuuaguuccuaggagggacuuucuuagugaacuaagcauuuggugacuuaaagccagauuccugacaguguaauugaaguugguaauaugcaguggucagcauuuccuuuggaguuuagagaacugauuggacacuuuuucucucuuaguuuucuuuuuccuucuuuuuuuuuuuuuuuaaagauaugcucuagugguuaagauucuaugcuauccuaaacugcuugagugugaguuuagcuuugugaucucagacaauguauauaacuaccaccacugcccggccucaguuuucuccuuuguaaaaguugcauaauauaauuuauaaugcuauguggcaucuuuaggauuacauuaaagagugucuauaaagugcuuacaguuauauuaaguaucuagugaauuccagcuacuauuagugggagaaaggaguuacaaggccuuuaggcuuugaaguguacugaguaaauugagguuuuaggcgggagcucucuuucugauguauuauacagagauauauaggcagucagcuaugacagauugaugagaggaaaauaaacuggccccagccuugcggaaagcgucuauggaggaugggcacaggcaaaaaccagagggguuagggcuaagccuuggaugacuccuuugguuguuaagagauccagaaaagagacguagguuuagaggcaggaagaaaccagcugggugaagugauauugagguaaccagcugugggggauauugaggaagaacagguggucaugaaggaggcagcacaaguggagcuguugaaaagcucucaaucaugagggcugagucggggaagagaacaggagagacaagccacagagagaguacagcaguaaggcacuauuaugguguuuuguuguuuuugagacagucgcucugucacccaggcuggagugcaguggugcgaucucgguucacugcaaccuccgccuccuggguucaagcaguuauccugccucagccucccgaguagcugggauuacaggcgcccaccaccgugcccagcuaacuuuuuguauuuuuaguagagacgggguuucaccauguuggccagacuggucugaaacuccugaccucaggugagccacccgccuuggccucccaaagugcuggaauuacaggugugaaccaccgcacccggugacaaguuauuucuuguaggagaagaaagagacaugggugaauuaaagggaagcuuucuggagaaguaauuuuauugguagcagugguggagggaaguuuagggaaaucucaugcaugauaguuaauuguacugcacauuugcuguauaccagguacacuuucagaucccagcaguagcuccacagguuaagugguagugucauauuucagaugagaauggaucgguguggaaguugagcagugucacuaagguagcaagguaauaaauggcucaagugcagcuucaaacguaggucugcuugacuucaaauguuucuggaauguggaaaguugaaaguggguuugggacagucuuucacuuuugaaaacuggcccuuuuucugucuggaguuccugaaaggcccuagaaaguuuccuucugaagcaucguguugcuuaguuuaguuguuguaguaagucaaggcccuacauguccuuucugcauguuuccacagcaacagacgaucccuuggcuugagccaguugauucuuguaagaauguuagugcaguaauacaguaacuaauaaagaggaaagcagaugccagugggucuggaggagccuucagacagcaugugauuuuuaaggagaugugggaugaggauugcuucuuguuuuguauauggaguagugaucaaagucucucauauuccagcccagggcuggacuauauuaguggauaguugguaugucaauuguacuauauuaaccauaauguaggccuggccagacuagccacuguaggaucuaggauuuaaaacuaucucacucuucugucuuacacaaaaauaaauuccagguggauuaaagagagacauuuaaaaaguaaaagaagaaaagugaguauuugucuaucucauaauaggaaaggccuucagcauaaaagcagauacagaaaucaugaagaaaaagucgaucaugucuacauacacaaauuaaguuguuccaaguguuaaauaccauaaaccaaaucaaaagagaaacuagggaaaauauuugacuauuagagagcaaauacuuagagaucaaaaaauagcaggaaaauaggcaaacucagaaaauucaguaaagaagaaaaucaggugucggguaugugauuaccucacuggaaauaagauuggcacaacaaagccaccaugaguuuguuuuuuuuuuccauuaucaaauuagcaaaaauuuuaaaacaugaucaagcacagucccuaguaucagggaaggucuaagaaauggggcacuugugcugcuaguaguaauauaaacugguagacuaauaggaacaaguggguagaauuuuagaagucuuugaaauacauauccugggccaggugcgguggcucacgccugaaaucccagcacuuucggaggcugaagugggcggaucaccugaggucaggaguuugagaccagccugaccaacauagugaaaccucgucucuacuaaaaaauacaaaaauuagccgggcaugguggcacgugccuguaaucccagcuauucgggaggcugaggcaggagaaucacuugaaccugggaggcggagguugcagcaagccgagaucgcgccaguguacucuagccuggccaacagcgugagacuccgucucaaaaaaaauaaaaaaauacauauccuggcugggcgcaguggcucaugccuguaaucccagcacuuugggaggcugagguggguggaucgucugaggucaggaguucgagaccauccuggccaacguggugaaacccccgucucuacuaaaacuacaaaaaaaauuaggugggcaugauagcucacgccuguagucccagcuacucaggaggcugaggcaagagaaucacuugaacaacccaggagguggagguugcagugagccaagauugcaccacuguacucuagccugggcaacagagcaagacucucucucaaaaaaaaauaaaauacauauccugugauccagcaauuccuuuuuuuucuuucuuuuuucuuuuuuuuuuuuuuuauuuuuugagauggagucucgcuccgucacccaggcuggagugcaguggcgcgaucuuggcucacugcaaccucugccucccgaguucaagcaauucuccucuuucagccuccugaguagcugggauuacaggcucaugccaccacccuggcuaauuuuuguauuuuuaguauauggagguggguuucaccauguuggccaggcaggucuugaacuccugaccucgagugauccucccaccuuggccucucaaagugcugggauuauaggugugagccaccgcgcccagcuguaacccagcaauucuacaccaagaaauuuauuacagaggcgaaauugaauaugcuucccccaugcuuucacuaguuugauaaacuucauauuuccaaaacuuuauagagugcuuaaaaaacuacauagguagguggcacaugccuuaaagugguaaaaggccacugacaaacuauaagaaacucauuuuuguacugacauauaggaguaaaagucaacuaggaaaauuaagaaaaauaugagaggccaggcaugguggcucaugccuguaauccaauacuuugggagaccgaggcggguggaucgcuugaguccaggaaaucgauagcagccugggcagcauggcgaaacccccuuccuacaaaaaaauagaaaaauuauccaggcgugguggcgcaugccugcaaucccagcuccuguggggacugaggugggagguucgcuugagcccaaaaggucgaggcuacaguaagccaugauugggccacuuugcuccagccugggcgacagagcaagacugucucaaagaugaagcugcaggucucugcucacuaugggugauuccaggccacacuuuuuuuuuucccucaugcagaauuuucauagagaaacacuguucucuuucugcuagucuuccauuuguuaccacuguaaaauagaaaacagaaaauaaaaucaaaagcuuuuggacuugggagcuuaaggacagauguguacacauuuuggugaaauuuguauauaagcacaucuugguuuuauuuguuguauauagcaccuaccacagggauagcauuuaguagcucaagguucauacagcauaugaugcuguauucuacuguacaacccuuuggcccaguguuugaccaguccuuauugauagaccaaaaucuuaugucuugcagaugcuguugauggaguaaugaauggugaauacuaccagguacagaguacucugauucuguucauugauagugauugagaaucuuccuuuccugugauuuuaauugacugaccuagaaagaaaccccaguccuuugacuuuccugaauguauuacuggcugguguguuaucuaccaaaguggaaagauuuaaagagagguagcauugauaaaaagagaacuguuuaaaaauguuauuuaccugccccuaguguuaucaccuuuauucuaaagaaaucaccauucaaaugauacuguguugagugcaguaaguuaauacuaauacuuuaaauaauucuccuuccaucuuuguuuauagucugauuagguuaaccugguaauauuaauauuccuuaguucagugaguggcauauggaauaauuuuguaaagauuaacauuuauuugagucuuuuuuuuuuuuuuuuuuuuugagacagucucacugucgcccaggcuagagugcaguggcacgaucuugucucauugcaaccuccaccuucuggguucaagcgauucauccacuucagccuccugaguagcuggaauuacaggcgcaugccaccacgcccggcuaauuuuuuguauuuuuaguagagaugggguuucgccauguuggccaggcaggucuugaacuccugggcucaagugaccaucccgccuuggccucccaaagugcugggauuacaggcgugagccaccgcaccccgccagagccaccgcaaccuuggcucacugcagaacccguuucuaacaacaauggcggcuuuuguaaaauguuaaaggauuaccuuaaaagcaacaacacaggccgggcacgguggcucacgccuguaauuccagcacuuugggaggcugggguggguggaucauuugaggucaagaguucgagaccagccuggccaacacagugaaacccgucucugcuaaaaauacaaaaauuaaccaggcgguaguggcaugugccuguaaucccagcuacuggggaggcugaggcaagaggagaauuugcuugaacccggggaguagagguugcaguuggccaagauugcgccacugcacuccagucugggugacagaguaagacccugucccguccccccuucccccaccccagaaaaaaaaaaaaaaaaaagcaaccacauaggccaggcgcaggcaccuguaaucucagcuacucgggaggcugaggcaggagaauugcuugaacccgggagguggagguugcagugagccgagaucgugccacugcacuccagccuuggcgacaagagugaaaacucugucucaaaaaaaaaaaaaaaaaacagaaccagggguucuaacucaggugaagugcauuuuaggaaggaauuuuugguauuaauauagcacaauuguguuuuguguuaaggaaaguaaugguccaacagacaguuaugcagcuauuucacaaguggaucgauugcagucagagccugaaaguauccguaaauggagagaagaacaaauggaacgcuuggaagcccuugguaaggaaucccuucuguguuuuggugucuguuuucaguggaguaguugagcuggacucuacuuuuauuccuuuuuagcucacauuaaccagugucauugucuggucuuugggaagauaucuucucagccugaagguuacaaggcuaccugcacagagaugccuaaucacaggccauugugugaggaguaggguagccggagauccccaagauccucucacaggaagagcauagugaugcugcuccugaccucaagaguagccucaggugguguuuauagagugcuuuauaaacuugaaggauucaaguuuccuauguccguggacuuuaacaguccauuuuucuuuuuucuuuuuucuuuuuuuuuuuuugagaugaagucucacucuguuacccaggguggagugcaguggugcgaucucggcucauugcaagcucugccucccggguucacaccauucuccugcccucagccuccugaguagcugggucuacaggcgcccgccacuacgucccgcucauuuuuuuuuuguauuuuuaguagagacaggguuucaccguguuagccagguuggucucgaucuccugaccuugugauccacacaccuuggccuccuaaaaugcugggauuacaggcgugagccaccgcgcccggccuccauuuuuuauuugaaggcuaaaugaauuuaaaguaacacgaggaaaaugagguauguuaggaaaaaauguacaauuuguuuuuccuaccuuaauaucucuguaagguaaguuuuacaauuuuacagguaagaaaaguggaggagagguagaauaaguauuuggaauacucagcuaaggaaugguaagagucacaauuucagcugaagucugccuugcuucaaagucacuacccauccccaucagccacauugcuuucuaaacauuuaaugugcguggccaucuagccacacagccuggccuuugauaaagagauguguacguggagugucaccuguugguucaugaucaggggagacuugugucuguacaugguggauuggagaaguaugcagagugugaggauauaauccacauuguggccuuuucuuuguuuuuucuuuuucuuuuuuuaaucagcugacuuuaagauucaucuuuucucaacuuuacagaacaauugaaaggaggaaaauaaacaugugcacccccagauucaguaauuaauggauuaucuuuauauaaaugauauguuuuagacauacacacacacaaauuguuuuggcugaccuacuuuaagauaaagacaucauauacuuugugucuaaauauuucaauguacaccuccuagaaauaaugacauucuccuauguaaccacaacgucagcaguauuauucccucuugggaacuguugaacuagugaaaacaugaguccuuauuuuucagaugggauaacugacacccagaaauaggaagggacaugacccagaugacacagccaauuagugccaaaucauuuaucucucuaguccaauuuagguggcuuucagaacaaagaaugcacuuaguauuugaaccuuuauagcaccauucauuagugauuucuuugguggaaauauucuguaucugugcugucucguaugguagccacuaaccacauguaacuguuaaguacuugaaguguggcuucacaauucaagugugacugagaaacugaauuuuaaauuuucuuuaauuuuaauaaauuuacauugaaguagccacauguagcuaguagcuaccauauuggacaguggagcuguaggaagaugaaaauagguccuaacagcuuugguccuugcuuguucuuugugucucuugaguaugcuuagaggcaagauuuagcuggucuuaguacugcuguaguauuuuucauguuacagaacccaaauuuaucuuuucuguuuuaccaagcucuagcaguuuuucuucuccauggagagagucuacuuuggugucuggaaagauuuaauuuuucaauuaugaaauuggguacuuggggaauacucuuaugagcuguuuucuuaauucaaagugcuuuuuuugagagaaguacaacauuuggccuugcauuccaacugaauugaauucacuugguucaugaacaagguguuccuucaauuucaccuuuuuuccuugcaaaaacugugagaaagcacgcgaugcuaaaaauagagaaccggugccagugguuuucagccuagcugcuggcuacauucucaaguaauuuucuuuucucugaccaguaacgaggguggccagaagggaaggcaccugugaaugugcuuugcucucuaaggggacucuuccucuucauccucugaggggaagaauucuaaauuaguauugcaguggcacuaaagcugcaaaagccagaagaccaauuuaaauguacuauuuuaugcaguaaccacagucuguucaggaggucaccauuuuuauuuaauuucauuuuucagagauaaauuuuauauuuuaguccuaauguauaguaaauguuaacaucaaaauacauugaaagaaaauacuguccaaucaaaaagguaauuauuuggaaguaauuucaccaugauugaaaagggggccuuacauuuugaauuagguauugucacauggcacuuccagcccacagcuucucauugcagcauagcuaaaucuugcauuccacaucuguacuucaugccauggauagacacauauuagauguuuacuguagaggcuaggugguguggcucaggucuguaaucccagcacuuuaggaggcugaggugggaggaucacuugagcucaggaguucaagaccagccugggcaccauagugagacccuaucucuacuaaaaaaaaaaaauuagcuggggguuguggugcacgcuuguggucccagcugcuuaggagauugaggugggaggaucacuugagccugggagauugaggcugcagugagcugugauagaacuacugcaguacagccugggcuacagagcgagacccuaucucaaauaaaacaaaaaaaaguuuacuguauauacuuuagagucaucagugaaaaaucugagaaaaugauucuucugaacgacagaucaccuuccgacaaauuagauaccgagaugaacguuccuacuaaccugaaacuugggggaguuucuagcugcuauuaggcuuuuucuuauaguuacacacagccuuuugcagguuguuacuauaagaccuuucuugcaaaggcccuaaaaaugcccaagaauacuucauuuuucaucccuucuaguaguuacuugacaccgcuacugcuaucuacucuccuucucaaagacacuaauuacaguuugggcucuuggucugcacuuucaaaacucuguccagaucacugguggucacguuuugugauuauuucuaggcuugccucccuuucugucccucccuuuggaggaagcauaaugagguaagcaaaguguaagcuuuacagccagaucuggguuugaaucuuggcucugucacuuacuauaaccuuuaggaaauucacucaaacuuucugagcuuuaguuuuucucacugcugaaaaugugaucagaguuuaccuucuugggauuguuguaaagauugaguuagaugucuauaaaacaccugccagacagaagaacuuguuuaaagugaaguaucagguuaacuucaagugucagcugccucaguagcuaugacauguauuucuuuuuuuuuuuuuucuuuuuugagacagagucucacuuuguugccuaggcuggagugcaguggugcgaucucagcucacugcaaccucugccucccagauucaagcgauucuccugccucagccuccccaguaauccccaguagcugggauuauaggcaugcaccaccacauccagcuaauuuuuuguauuuuuaguagagacgggauuuuaccauguuggccaggcuggucucgaacuccuaaccucagaugauccaccugccucggccucccaaaguguugggauuacaggcgugagccaccacaagcagccggcauguauuucuuuaucucucacuaucuacugauguaugucucuucagcuuagugucuuagagaaaaccauauuuaguccucagaaacuucauguuucauguuugagaauccaaucuagcaaaccugcuagguaugcauuuucuugcugucauuucuagaaccuuuagguuaacuguuagcaaugaucccauaccucuacccccugcacuucucuccaguggaguuucuuuuguagcucugcccuggcucugccacaaacacacugcagaccaaguaggaguagaugcuuugugguccucucuagugcuaauauucuguguucuaucauucucugguuccugaaucaucucuaccuuugguaauuguccuaauagcacccugccucacagaagugcuucuaccauauuuaguuaugagagugccaccuuguguuccacaaaaccauugucaaaccuggaauauggacuaguuugggagaagagguaaaagauuaagaugaauacccuacuaugaacuaauauuggcagcauugguaaagaaucaucuauaauuguuucucccccaauuggugcccagaaggcuuuuuuccuauuaauaauagaagucaguauuuccacauacacccuucucuuuugcucugcccaaaacaagacaaaacaaaacuaaugacccacuaagaugucaguggacugggauaagaccaggaauaggacugugggaaagaccaggcaggaauagaagcacugaaaucagaguugguugugcaaacagagaaaacagaaguuuaucuuccccucucuacucuucucccccaacaggcacacagacauggaccugcacccaccacaaguucagcaagaccaaaauaaacugaugaacuucaguuugcacuuugccucaauuguauugucuuucucuucucucccuucaaagaugccaauucucggaagcaagaagcagaguggaaagaaaaggcaauaaaggagcuagaagaaugguaugcaagacaggacgagcagcuacagaaaacaaaagcaaacaacaggucaguccguggugguuguagcacacuuuguuuuccaaaauugaaucaaauccauucucagcauccagucucgguuuuuggcuucugccuccuuuagugugaaaugucugcaguuuuuaaagaaagugcuugaaacagguugcaagucucucgggucuugugagcauaauucacccuauuguuuagccaucccaauuguagugagcuuagcucucugagaguuugguuaauaugcauaaccuguaauggugugauucagccaagggaaaaguuacuuuccauggaacccugaaacgaaagcugggugucaugaauacacccagaucuaguuacuuuggauaugauuauagacuuggucauguugagucuccucaauauagcccugcccccugaaagccacuucaugaagggguccguuggcaggaauaugugcuuuguaauuaggcagccaaggauguuccaacaugauuauuuuagaauugaggguucuguggguacuuauuugugccuuaaaaagucuugaauugacuucuuaaaaauguucuguuugaaauagauuuuauuuaguuacugaugguuaaggaguugugaggagaaaaacgcuuucauucucauaucacuacucaccagcagcugggcuuuaaugcccuacacuuagagcccuucuuggaagcagcaaagagaggauaugugguguugcuucccucagggcaggcagguucagagcccaacuuucacugaauagucaauccauucacuucaguguauaaacgggccagaccgagccuggggauauuuuuaauuuucaggguagagccuuggguucucguaugcagaggcaggaagcagguuggguuaagugcccuugucucuggcagcucuguuagacagagauguggcaggagagagagcuaacggcuuugccagccagccagugcuauuguggguccaguaugacagagcaguuggacucucuuuuauaugcuagcagcccuucagcucauuggauuccggcuugagccuguguccuggucacuuuccucugggggcggugugcucaaggagugccugucagguuccauguggaguccacaggacuccacagucccagucccacaggacugcucucuggugugcaggcuggguugccaguggugauggcuuccaucagcuacguggggcuguuguugagccuguggucaguagguggugcugacagguccaggcuccuguguccucugcucccucaagaugauuuucucccagguggaaguucagaucgguaaagccgaguggggacugugugcaagcacccugcgagcccugagaacucccccagccugcgaccccagcauuuaaguuuagucugaaguacuguagcugugccgacccuccccgcucugggucugugaugcgucaauaacuuaacacaaguuuucaaacuuagauaaugaauauguugguaacagccuuucuguugcagaaauuuuuuucaaggaaguuuugcugaacugucaagaaagggauauucucuguauacagaauccguuguucucagagggaguaaugacaccuguuuuuuuuuuuuuuuuuuuuuugagauggagucuugcucuguugcccaggcuggagugcgguggugcgaucucggcucacugcaagcuccaccuccuggauucacgccauucuccugccucagccucccgaguagcugggacuacaggugcccgccaccaugcccagcuaauuuuuuucuguuuuuaguagaaacaagguuucacuguguuagccaggauggucucgaucuccugaccucgugaucugccuuccuuggccucccaaagugcugggauuacaggcgugagccaccgcgccuggccaugacaccuguuuuuaggagcucagucuuaaaaguuuagucccuccaggcauugaauuugggccuugguaccuuucuguacuuggaacuguagaaugcuggguaagcuggucucacagaugaaccucuuaaguuccagagagaaggaacuuccccacugcucacugagaauguagagcugcuuaggaagcaggucacuugccuugugggaaccuugcagcacagggcugacucuugagagcauaacgcuaguggcacacuagccauugucaccagggcucuaggacagaagagaugguuuuuacaguuuauuccagugauucuucacugguuggaggugggauccauuugagagucacuuugggggacuucuuccaagggucuacacccuccccuggagauuuuuauauugcugacuacucccccucuccauccauguuugacucuaaacuuuagaguucaaaggaauaggucccauuuagauguauaaaguaauucauccuuguuaucugucuauggguaaagagugaauauuuuuagaaaagaaaaugggggccggacaccgugacucaacaucuguaauuccagcacauugggaggcugaggcgggcagaucacuugaggucaggaguuugagaccagccugcccaacauggugaaaccccaucucuacuaaaaaugcgaaaauuaacugggugugguggugugugccuguaaucccagcaacucgggagucugaggcaggagaaucacuagaacccgggaggcagagguugcagugagcugagauugcgccacugcacuccagccugggcaacagagcgagacucagucugaaaaaaagaaaagaaaaaagaaaacggggugcucauuucaagcaaguaugauucucucugggugacuucugcaguagcuagauguuaaggggacccgagagauaaggcagaaagaugagaaguuugaaagaggaaagucggagacaggaagggcauccaguuaauugugagagcauccucaggccuccugccuuccagcugccucaccacugggucaccaaagcacuaggagcacgucgcgccuggcacugcacugggggugggugugcuguacucuauugucaguccccagacugcaucucccuucuuuuaucccaaguugaggccuaagugucacaguacaagagcugugaauuauucagugacagccauggaaaagaauuuccuuuucauagccagccagccagagcagugacugacuccugcagcuggaugaguuugcucaucaagaacaaccccagaacauuuccccuauuacagguagcacuugugcuugucagcucuuucaaggcuugagaagguuuggggaacccacaguucucagagauggcaaacauuuuuuucugugcccacuuugaggcuguuuauggaaugaaguucugcauuguauucgugccuccagagcuuguccuaggucagguauuccucuucccuccccucuccuaagccucccugagccccuuccugccuuggcugaggauugcuacuuucaagugaaggacaaauaaggggagggccaccugugugugugucugauuuucuguuuguucugggccugcaaccuugacaggggaugugcuugucacugaggagcucuuuggucuugggcuagcugcaaaggagcaagagccugacauucaaacuuuuguugucuuagugaugauuugacaggagucaugaaaccucuacucuucuuguggagggaaacccaaguugaaaucgaucagguuuaguccuuuguguaaacuaaaaggguuauggguuuauaagccagccugccuugccuuuuccucccacucauucugcccacaaacaacucuguuuuccugcugagucacuuuaaguuauaaucagccugcucuuuuugcuuucuuuaaauuuccacaaaacaccuccuguguauaaaacaaaaugggaaagaaggaagggcaugugugagcuuaaaaauuaacuuaaaauuacuagaauuugccuucaaauaaguaugugagguuagcuuaaugaccaggcaugauuauccuugaaaaaugucuuuccccuugcccaccccaaaucgacuugacaaaggacaggguaagacuccaugagggagguuccauguccagccacaguggagaagagugggcuggcagagcccagggagucaguccaggacaacagagucaaagccagccuggccccugcugucaaaauuuauccacccagucugcccccuccuuccugucugagagcccugccauguugagaguuaagaagggaugaaguucuggauucugggcugcaccuuaucaaagccaauugagucugguguaaaaauauucagaaacuguacccgcuucuugaguagagagagagccauauucaggaacaacagaagccagggccaggauccuaguccaguguucuucccaccagaccacucaccuccagccguuuuuuccuguaagguugagauuuuaaaaugacgauauguguucccaggauucuggaaguguaucccacccagacaguguggggaagcaguaguuagauaauccaagauaaaacuggcuuuggguccuagcgcaucuggugucuggcagcauuccugcccagugcauuaacugaaacaggaagguggcguggcuuucugggcacauacagcagggaagaagcaugacuauacaguagaaagagcccuggacuuagggccaggcugccuugguugugaguccugaaugcugccacugugguguagcugagcaaguuguucaucucuaagccucaguuaccucaucuguacagugggggugagaacagucagggucauagguuguuaacaguuaaggauugaaucaacauaauguaugugaaagggcuuaguccaugauugggugcuuaauaaaugcccguguugcuggggugagccaaagggaugaaguuggcagugcuugcucugucguggagcaguccccacgugggaaggccagcgggaaaccaggccugcugaagucuccagcgcuggaagccucacggggguuaggaaggagccuugggagcagcuccucagagcacaguuguaccucaauuguggauuuuagauguuucugcuucucaauguucucucuuuuuuccugccugcuugccugccuuuuggaccucuugcugucuaggguggcagaugaagcuuucuacaaacaacccuucgcugacgugauugguuauguguauguugcaaaacuaauuccuuuuucuacaucugauucuuucuacuuuuguuuagaguuaaugcuccuuuuaugucacaaguugcuuugcuuuuuaaauuauuucaaauuggcacuuugggggcugccuaagaauugauaagcgggguaugaucuguugaugaaucuuccagauuugugacucccugcauccucugauggccauuuuucauauuugggguuuuggagggaagaaagcuaacucgcuuucaaaaugugucauuugcgaucuuaucugggaacgguuugaggcucgggggaacucugcucucuugcucuuggcugccaucacugcugccaugcccuguugccugccugccucaggugggaaggagguuuccccaccugggagcagguggcagucccaggagguuaggagccagugagcagcagcaccuugcauugccaaaaucagagcuguggggcagcauuuuccauacuugguucauucaaacaauguggggucguuugccucucccucaggcagaagaguccagagcagaggggguugucuccagugggugucuauaauuguuccucuguggucuugcaugucagaaauugcuauuuaguggucagcuucugauguccugucuccuagcacagggaagcccccagcuuugagaucaggauagucaaagugucuugauacgggccacuugggcuucucccccugacccccccaaaagaaaccugcaucuucucuggagaagguguuuuucuuauucuuuuuuuuuucuuuuuuucuuuuuucuuuuuuuuaaggauuucuuuuaucaaagcaguauugcugaagaguuggaaacaguucucauugucuccuccuuaaaaauuagggcuggcuuuacaugagaaguaaggguggaauggaagaggagaggaaccuguggaaggugggcgaugagcucaggucuguagagccucucagggccuaugaccuugagauguucauccccuuagaagauagaacuggguuuccugggcccccagaugcauuugcagugagacuugugaaaugcuggacuuacaggugguguuugauuugauuucugcacauucucucuggaguagaaauggagacuggaaaggucgagucugguuuugcugggcagcuggguggccagcaaagccagcugcacguccccaagcacagauagaguggcaagggcauguccagcuuacugaccaucugcauugagcucauucucauuuucuauaucugacuuaaaguuucucucguuucuuuucuucucuucaccuuuaagcacaaacauaaaccauccuugcuacagccuagaacaguuaaguaaaccuuucucacugccccuaacugugugugccaugaagucgcaguguuguaguggcucugggcuucagcgguguuugccacggccaucccugugauagugccaccccuccguccccacagaccagucaucuccauugcuuuugcuuugcccgugaugcuuguuggaguagaugaauauagugugucuuagcgcuguccuuuccggcuguagcucccaccaguuaauuccgaacugggggugggcugaccuugaugugaaagaauguuggagcagcauccugccaaaaagcaacucacguuggcucuccugccagugugcccugaguggccccaaggcaccuggcuggagggaaaauggcaaacuuuuggcugaacuggagaauguccuaacaaacccccuuccagaauggcuuuagucucuagugcuugcuagcaugggagcuuugucuugaauuccuuuugaucugccccguuucucuccagccuuaggaauaaaucuagaggcuauugugcaaugaucugugggcuuuuuagaagucucuaaauuuccuugaaauucaguacagcccagcauaaacuacucaaguucuugaucagccugcugcuuuguucuuauuaauaaaagcaguguguagcuggcuaaggacuuguuuuauuaaugcuccacaggagcagagacagacagagagacauagugagccuugaaccaaacaccuguauuccaacauuuuacacagcggucugggcacccugugccuaggagagccagcuacgugucuaccugagucugaccugggccaggggcuguuaucuugggaaagccagaaugucauuaagaaagggacaaauaggcaguugcuuguguagcaaggcagccaccagguugcucaaaggggguucugcauaaaccaacauauuuuguuguugcuuccagggcagcagaagaagccuuuguaaaugacauugacgagucguccccaggcacugagugggaacggguggcccggcugugugacuuuaaccccaagucuagcaagcaggccaaagaugucucccgcaugcgcucaguccucaucucccucaagcaggccccgcuggugcacugaagagccacccuguggaaacacuacaucugcaauaucuuaauccuacucagugaagcucuucacagucauuggauuaauuauguugaguucuuuuggaccaaaccuuuuugucuuuagaguuguucauuguuugugauugcauguuuccuuccuucaacuguguucucccuggcauucagagaggagggagaggaggaagaggaaggggagggaagcuucccaagaguagccucaaccugugcuucugugcauuauucugagaauaaauuucuguuucaaacuguauua

SEQ ID NO: 191367 - RNA, 21207 nt, Homo sapiens
uaauacaguuugaaacagaaauuuauucucagaauaaugcacagaagcacagguugaggcuacucuugggaagcuucccuccccuuccucuuccuccucucccuccucucugaaugccagggagaacacaguugaaggaaggaaacaugcaaucacaaacaaugaacaacucuaaagacaaaaagguuugguccaaaagaacucaacauaauuaauccaaugacugugaagagcuucacugaguaggauuaagauauugcagauguaguguuuccacaggguggcucuucagugcaccagcggggccugcuugagggagaugaggacugagcgcaugcgggagacaucuuuggccugcuugcuagacuugggguuaaagucacacagccgggccacccguucccacucagugccuggggacgacucgucaaugucauuuacaaaggcuucuucugcugcccuggaagcaacaacaaaauauguugguuuaugcagaacccccuuugagcaaccugguggcugccuugcuacacaagcaacugccuauuugucccuuucuuaaugacauucuggcuuucccaagauaacagccccuggcccaggucagacucagguagacacguagcuggcucuccuaggcacagggugcccagaccgcuguguaaaauguuggaauacagguguuugguucaaggcucacuaugucucucugucugucucugcuccuguggagcauuaauaaaacaaguccuuagccagcuacacacugcuuuuauuaauaagaacaaagcagcaggcugaucaagaacuugaguaguuuaugcugggcuguacugaauuucaaggaaauuuagagacuucuaaaaagcccacagaucauugcacaauagccucuagauuuauuccuaaggcuggagagaaacggggcagaucaaaaggaauucaagacaaagcucccaugcuagcaagcacuagagacuaaagccauucuggaaggggguuuguuaggacauucuccaguucagccaaaaguuugccauuuucccuccagccaggugccuuggggccacucagggcacacuggcaggagagccaacgugaguugcuuuuuggcaggaugcugcuccaacauucuuucacaucaaggucagcccacccccaguucggaauuaacuggugggagcuacagccggaaaggacagcgcuaagacacacuauauucaucuacuccaacaagcaucacgggcaaagcaaaagcaauggagaugacuggucuguggggacggagggguggcacuaucacagggauggccguggcaaacaccgcugaagcccagagccacuacaacacugcgacuucauggcacacacaguuaggggcagugagaaagguuuacuuaacuguucuaggcuguagcaaggaugguuuauguuugugcuuaaaggugaagagaagaaaagaaacgagagaaacuuuaagucagauauagaaaaugagaaugagcucaaugcagauggucaguaagcuggacaugcccuugccacucuaucugugcuuggggacgugcagcuggcuuugcuggccacccagcugcccagcaaaaccagacucgaccuuuccagucuccauuucuacuccagagagaaugugcagaaaucaaaucaaacaccaccuguaaguccagcauuucacaagucucacugcaaaugcaucugggggcccaggaaacccaguucuaucuucuaaggggaugaacaucucaaggucauaggcccugagaggcucuacagaccugagcucaucgcccaccuuccacagguuccucuccucuuccauuccacccuuacuucucauguaaagccagcccuaauuuuuaaggaggagacaaugagaacuguuuccaacucuucagcaauacugcuuugauaaaagaaauccuuaaaaaaaagaaaaaagaaaaaaagaaaaaaaaaagaauaagaaaaacaccuucuccagagaagaugcagguuucuuuugggggggucagggggagaagcccaaguggcccguaucaagacacuuugacuauccugaucucaaagcugggggcuucccugugcuaggagacaggacaucagaagcugaccacuaaauagcaauuucugacaugcaagaccacagaggaacaauuauagacacccacuggagacaacccccucugcucuggacucuucugccugagggagaggcaaacgaccccacauuguuugaaugaaccaaguauggaaaaugcugccccacagcucugauuuuggcaaugcaaggugcugcugcucacuggcuccuaaccuccugggacugccaccugcucccagguggggaaaccuccuucccaccugaggcaggcaggcaacagggcauggcagcagugauggcagccaagagcaagagagcagaguucccccgagccucaaaccguucccagauaagaucgcaaaugacacauuuugaaagcgaguuagcuuucuucccuccaaaaccccaaauaugaaaaauggccaucagaggaugcagggagucacaaaucuggaagauucaucaacagaucauaccccgcuuaucaauucuuaggcagcccccaaagugccaauuugaaauaauuuaaaaagcaaagcaacuugugacauaaaaggagcauuaacucuaaacaaaaguagaaagaaucagauguagaaaaaggaauuaguuuugcaacauacacauaaccaaucacgucagcgaaggguuguuuguagaaagcuucaucugccacccuagacagcaagagguccaaaaggcaggcaagcaggcaggaaaaaagagagaacauugagaagcagaaacaucuaaaauccacaauugagguacaacugugcucugaggagcugcucccaaggcuccuuccuaacccccgugaggcuuccagcgcuggagacuucagcaggccugguuucccgcuggccuucccacguggggacugcuccacgacagagcaagcacugccaacuucaucccuuuggcucaccccagcaacacgggcauuuauuaagcacccaaucauggacuaagcccuuucacauacauuauguugauucaauccuuaacuguuaacaaccuaugacccugacuguucucacccccacuguacagaugagguaacugaggcuuagagaugaacaacuugcucagcuacaccacaguggcagcauucaggacucacaaccaaggcagccuggcccuaaguccagggcucuuucuacuguauagucaugcuucuucccugcuguaugugcccagaaagccacgccaccuuccuguuucaguuaaugcacugggcaggaaugcugccagacaccagaugcgcuaggacccaaagccaguuuuaucuuggauuaucuaacuacugcuuccccacacugucugggugggauacacuuccagaauccugggaacacauaucgucauuuuaaaaucucaaccuuacaggaaaaaacggcuggaggugaguggucuggugggaagaacacuggacuaggauccuggcccuggcuucuguuguuccugaauauggcucucucucuacucaagaagcggguacaguuucugaauauuuuuacaccagacucaauuggcuuugauaaggugcagcccagaauccagaacuucaucccuucuuaacucucaacauggcagggcucucagacaggaaggagggggcagacuggguggauaaauuuugacagcaggggccaggcuggcuuugacucuguuguccuggacugacucccugggcucugccagcccacucuucuccacuguggcuggacauggaaccucccucauggagucuuacccuguccuuugucaagucgauuuggggugggcaaggggaaagacauuuuucaaggauaaucaugccuggucauuaagcuaaccucacauacuuauuugaaggcaaauucuaguaauuuuaaguuaauuuuuaagcucacacaugcccuuccuucuuucccauuuuguuuuauacacaggagguguuuuguggaaauuuaaagaaagcaaaaagagcaggcugauuauaacuuaaagugacucagcaggaaaacagaguuguuugugggcagaaugagugggaggaaaaggcaaggcaggcuggcuuauaaacccauaacccuuuuaguuuacacaaaggacuaaaccugaucgauuucaacuuggguuucccuccacaagaagaguagagguuucaugacuccugucaaaucaucacuaagacaacaaaaguuugaaugucaggcucuugcuccuuugcagcuagcccaagaccaaagagcuccucagugacaagcacauccccugucaagguugcaggcccagaacaaacagaaaaucagacacacacacagguggcccuccccuuauuuguccuucacuugaaaguagcaauccucagccaaggcaggaaggggcucagggaggcuuaggagaggggagggaagaggaauaccugaccuaggacaagcucuggaggcacgaauacaaugcagaacuucauuccauaaacagccucaaagugggcacagaaaaaaauguuugccaucucugagaacuguggguuccccaaaccuucucaagccuugaaagagcugacaagcacaagugcuaccuguaauaggggaaauguucugggguuguucuugaugagcaaacucauccagcugcaggagucagucacugcucuggcuggcuggcuaugaaaaggaaauucuuuuccauggcugucacugaauaauucacagcucuuguacugugacacuuaggccucaacuugggauaaaagaagggagaugcagucuggggacugacaauagaguacagcacacccacccccagugcagugccaggcgcgacgugcuccuagugcuuuggugacccaguggugaggcagcuggaaggcaggaggccugaggaugcucucacaauuaacuggaugcccuuccugucuccgacuuuccucuuucaaacuucucaucuuucugccuuaucucucggguccccuuaacaucuagcuacugcagaagucacccagagagaaucauacuugcuugaaaugagcaccccguuuucuuuuuucuuuucuuuuuuucagacugagucucgcucuguugcccaggcuggagugcaguggcgcaaucucagcucacugcaaccucugccucccggguucuagugauucuccugccucagacucccgaguugcugggauuacaggcacacaccaccacacccaguuaauuuucgcauuuuuaguagagaugggguuucaccauguugggcaggcuggucucaaacuccugaccucaagugaucugcccgccucagccucccaaugugcuggaauuacagauguugagucacgguguccggcccccauuuucuuuucuaaaaauauucacucuuuacccauagacagauaacaaggaugaauuacuuuauacaucuaaaugggaccuauuccuuugaacucuaaaguuuagagucaaacauggauggagagggggaguagucagcaauauaaaaaucuccaggggaggguguagacccuuggaagaagucccccaaagugacucucaaauggaucccaccuccaaccagugaagaaucacuggaauaaacuguaaaaaccaucucuucuguccuagagcccuggugacaauggcuagugugccacuagcguuaugcucucaagagucagcccugugcugcaagguucccacaaggcaagugaccugcuuccuaagcagcucuacauucucagugagcaguggggaaguuccuucucucuggaacuuaagagguucaucugugagaccagcuuacccagcauucuacaguuccaaguacagaaagguaccaaggcccaaauucaaugccuggagggacuaaacuuuuaagacugagcuccuaaaaacaggugucauggccaggcgcgguggcucacgccuguaaucccagcacuuugggaggccaaggaaggcagaucacgaggucaggagaucgagaccauccuggcuaacacagugaaaccuuguuucuacuaaaaacagaaaaaaauuagcugggcaugguggcgggcaccuguagucccagcuacucgggaggcugaggcaggagaauggcgugaauccaggagguggagcuugcagugagccgagaucgcaccaccgcacuccagccugggcaacagagcaagacuccaucucaaaaaaaaaaaaaaaaaaaaaacaggugucauuacucccucugagaacaacggauucuguauacagagaauaucccuuucuugacaguucagcaaaacuuccuugaaaaaaauuucugcaacagaaaggcuguuaccaacauauucauuaucuaaguuugaaaacuuguguuaaguuauugacgcaucacagacccagagcggggagggucggcacagcuacaguacuucagacuaaacuuaaaugcuggggucgcaggcugggggaguucucagggcucgcagggugcuugcacacaguccccacucggcuuuaccgaucugaacuuccaccugggagaaaaucaucuugagggagcagaggacacaggagccuggaccugucagcaccaccuacugaccacaggcucaacaacagccccacguagcugauggaagccaucaccacuggcaacccagccugcacaccagagagcaguccugugggacugggacuguggaguccuguggacuccacauggaaccugacaggcacuccuugagcacaccgcccccagaggaaagugaccaggacacaggcucaagccggaauccaaugagcugaagggcugcuagcauauaaaagagaguccaacugcucugucauacuggacccacaauagcacuggcuggcuggcaaagccguuagcucucucuccugccacaucucugucuaacagagcugccagagacaagggcacuuaacccaaccugcuuccugccucugcauacgagaacccaaggcucuacccugaaaauuaaaaauauccccaggcucggucuggcccguuuauacacugaagugaauggauugacuauucagugaaaguugggcucugaaccugccugcccugagggaagcaacaccacauauccucucuuugcugcuuccaagaagggcucuaaguguagggcauuaaagcccagcugcuggugaguagugauaugagaaugaaagcguuuuucuccucacaacuccuuaaccaucaguaacuaaauaaaaucuauuucaaacagaacauuuuuaagaagucaauucaagacuuuuuaaggcacaaauaaguacccacagaacccucaauucuaaaauaaucauguuggaacauccuuggcugccuaauuacaaagcacauauuccugccaacggaccccuucaugaaguggcuuucagggggcagggcuauauugaggagacucaacaugaccaagucuauaaucauauccaaaguaacuagaucuggguguauucaugacacccagcuuucguuucaggguuccauggaaaguaacuuuucccuuggcugaaucacaccauuacagguuaugcauauuaaccaaacucucagagagcuaagcucacuacaauugggauggcuaaacaauagggugaauuaugcucacaagacccgagagacuugcaaccuguuucaagcacuuucuuuaaaaacugcagacauuucacacuaaaggaggcagaagccaaaaaccgagacuggaugcugagaauggauuugauucaauuuuggaaaacaaagugugcuacaaccaccacggacugaccuguuguuugcuuuuguuuucuguagcugcucguccugucuugcauaccauucuucuagcuccuuuauugccuuuucuuuccacucugcuucuugcuuccgagaauuggcaucuuugaagggagagaagagaaagacaauacaauugaggcaaagugcaaacugaaguucaucaguuuauuuuggucuugcugaacuuguggugggugcagguccaugucugugugccuguugggggagaagaguagagaggggaagauaaacuucuguuuucucuguuugcacaaccaacucugauuucagugcuucuauuccugccuggucuuucccacaguccuauuccuggucuuaucccaguccacugacaucuuagugggucauuaguuuuguuuugucuuguuuugggcagagcaaaagagaaggguguauguggaaauacugacuucuauuauuaauaggaaaaaagccuucugggcaccaauugggggagaaacaauuauagaugauucuuuaccaaugcugccaauauuaguucauaguaggguauucaucuuaaucuuuuaccucuucucccaaacuaguccauauuccagguuugacaaugguuuuguggaacacaagguggcacucucauaacuaaauaugguagaagcacuucugugaggcagggugcuauuaggacaauuaccaaagguagagaugauucaggaaccagagaaugauagaacacagaauauuagcacuagagaggaccacaaagcaucuacuccuacuuggucugcaguguguuuguggcagagccagggcagagcuacaaaagaaacuccacuggagagaagugcaggggguagagguaugggaucauugcuaacaguuaaccuaaagguucuagaaaugacagcaagaaaaugcauaccuagcagguuugcuagauuggauucucaaacaugaaacaugaaguuucugaggacuaaauaugguuuucucuaagacacuaagcugaagagacauacaucaguagauagugagagauaaagaaauacaugccggcugcuugugguggcucacgccuguaaucccaacacuuugggaggccgaggcagguggaucaucugagguuaggaguucgagaccagccuggccaacaugguaaaaucccgucucuacuaaaaauacaaaaaauuagcuggaugugguggugcaugccuauaaucccagcuacuggggauuacuggggaggcugaggcaggagaaucgcuugaaucugggaggcagagguugcagugagcugagaucgcaccacugcacuccagccuaggcaacaaagugagacucugucucaaaaaagaaaaaaaaaaaaaagaaauacaugucauagcuacugaggcagcugacacuugaaguuaaccugauacuucacuuuaaacaaguucuucugucuggcagguguuuuauagacaucuaacucaaucuuuacaacaaucccaagaagguaaacucugaucacauuuucagcagugagaaaaacuaaagcucagaaaguuugagugaauuuccuaaagguuauaguaagugacagagccaagauucaaacccagaucuggcuguaaagcuuacacuuugcuuaccucauuaugcuuccuccaaagggagggacagaaagggaggcaagccuagaaauaaucacaaaacgugaccaccagugaucuggacagaguuuugaaagugcagaccaagagcccaaacuguaauuagugucuuugagaaggagaguagauagcaguagcggugucaaguaacuacuagaagggaugaaaaaugaaguauucuugggcauuuuuagggccuuugcaagaaaggucuuauaguaacaaccugcaaaaggcuguguguaacuauaagaaaaagccuaauagcagcuagaaacucccccaaguuucagguuaguaggaacguucaucucgguaucuaauuugucggaaggugaucugucguucagaagaaucauuuucucagauuuuucacugaugacucuaaaguauauacaguaaacuuuuuuuuguuuuauuugagauagggucucgcucuguagcccaggcuguacugcaguaguucuaucacagcucacugcagccucaaucucccaggcucaagugauccucccaccucaaucuccuaagcagcugggaccacaagcgugcaccacaacccccagcuaauuuuuuuuuuuuaguagagauagggucucacuauggugcccaggcuggucuugaacuccugagcucaagugauccucccaccucagccuccuaaagugcugggauuacagaccugagccacaccaccuagccucuacaguaaacaucuaauaugugucuauccauggcaugaaguacagauguggaaugcaagauuuagcuaugcugcaaugagaagcugugggcuggaagugccaugugacaauaccuaauucaaaauguaaggcccccuuuucaaucauggugaaauuacuuccaaauaauuaccuuuuugauuggacaguauuuucuuucaauguauuuugauguuaacauuuacuauacauuaggacuaaaauauaaaauuuaucucugaaaaaugaaauuaaauaaaaauggugaccuccugaacagacugugguuacugcauaaaauaguacauuuaaauuggucuucuggcuuuugcagcuuuagugccacugcaauacuaauuuagaauucuuccccucagaggaugaagaggaagaguccccuuagagagcaaagcacauucacaggugccuucccuucuggccacccucguuacuggucagagaaaagaaaauuacuugagaauguagccagcagcuaggcugaaaaccacuggcaccgguucucuauuuuuagcaucgcgugcuuucucacaguuuuugcaaggaaaaaaggugaaauugaaggaacaccuuguucaugaaccaagugaauucaauucaguuggaaugcaaggccaaauguuguacuucucucaaaaaaagcacuuugaauuaagaaaacagcucauaagaguauuccccaaguacccaauuucauaauugaaaaauuaaaucuuuccagacaccaaaguagacucucuccauggagaagaaaaacugcuagagcuugguaaaacagaaaagauaaauuuggguucuguaacaugaaaaauacuacagcaguacuaagaccagcuaaaucuugccucuaagcauacucaagagacacaaagaacaagcaaggaccaaagcuguuaggaccuauuuucaucuuccuacagcuccacuguccaauaugguagcuacuagcuacauguggcuacuucaauguaaauuuauuaaaauuaaagaaaauuuaaaauucaguuucucagucacacuugaauugugaagccacacuucaaguacuuaacaguuacaugugguuaguggcuaccauacgagacagcacagauacagaauauuuccaccaaagaaaucacuaaugaauggugcuauaaagguucaaauacuaagugcauucuuuguucugaaagccaccuaaauuggacuagagagauaaaugauuuggcacuaauuggcugugucaucugggucaugucccuuccuauuucugggugucaguuaucccaucugaaaaauaaggacucauguuuucacuaguucaacaguucccaagagggaauaauacugcugacguugugguuacauaggagaaugucauuauuucuaggagguguacauugaaauauuuagacacaaaguauaugaugucuuuaucuuaaaguaggucagccaaaacaauuuguguguguguaugucuaaaacauaucauuuauauaaagauaauccauuaauuacugaaucugggggugcacauguuuauuuuccuccuuucaauuguucuguaaaguugagaaaagaugaaucuuaaagucagcugauuaaaaaaagaaaaagaaaaaacaaagaaaaggccacaauguggauuauauccucacacucugcauacuucuccaauccaccauguacagacacaagucuccccugaucaugaaccaacaggugacacuccacguacacaucucuuuaucaaaggccaggcuguguggcuagauggccacgcacauuaaauguuuagaaagcaauguggcugauggggauggguagugacuuugaagcaaggcagacuucagcugaaauugugacucuuaccauuccuuagcugaguauuccaaauacuuauucuaccucuccuccacuuuucuuaccuguaaaauuguaaaacuuaccuuacagagauauuaagguaggaaaaacaaauuguacauuuuuuccuaacauaccucauuuuccucguguuacuuuaaauucauuuagccuucaaauaaaaaauggaggccgggcgcgguggcucacgccuguaaucccagcauuuuaggaggccaagguguguggaucacaaggucaggagaucgagaccaaccuggcuaacacggugaaacccugucucuacuaaaaauacaaaaaaaaaaugagcgggacguaguggcgggcgccuguagacccagcuacucaggaggcugagggcaggagaauggugugaacccgggaggcagagcuugcaaugagccgagaucgcaccacugcacuccacccuggguaacagagugagacuucaucucaaaaaaaaaaaaagaaaaaagaaaaaagaaaaauggacuguuaaaguccacggacauaggaaacuugaauccuucaaguuuauaaagcacucuauaaacaccaccugaggcuacucuugaggucaggagcagcaucacuaugcucuuccugugagaggaucuuggggaucuccggcuacccuacuccucacacaauggccugugauuaggcaucucugugcagguagccuuguaaccuucaggcugagaagauaucuucccaaagaccagacaaugacacugguuaaugugagcuaaaaaggaauaaaaguagaguccagcucaacuacuccacugaaaacagacaccaaaacacagaagggauuccuuaccaagggcuuccaagcguuccauuuguucuucucuccauuuacggauacuuucaggcucugacugcaaucgauccacuugugaaauagcugcauaacugucuguuggaccauuacuuuccuuaacacaaaacacaauugugcuauauuaauaccaaaaauuccuuccuaaaaugcacuucaccugaguuagaaccccugguucuguuuuuuuuuuuuuuuuuugagacagaguuuucacucuugucgccaaggcuggagugcaguggcacgaucucggcucacugcaaccuccaccucccggguucaagcaauucuccugccucagccucccgaguagcugagauuacaggugccugcgccuggccuaugugguugcuuuuuuuuuuuuuuuuuucuggggugggggaaggggggacgggacagggucuuacucugucacccagacuggagugcaguggcgcaaucuuggccaacugcaaccucuacuccccggguucaagcaaauucuccucuugccucagccuccccaguagcugggauuacaggcacaugccacuaccgccugguuaauuuuuguauuuuuagcagagacggguuucacuguguuggccaggcuggucucgaacucuugaccucaaaugauccacccaccccagccucccaaagugcuggaauuacaggcgugagccaccgugcccggccuguguuguugcuuuuaagguaauccuuuaacauuuuacaaaagccgccauuguuguuagaaacggguucugcagugagccaagguugcgguggcucuggcggggugcgguggcucacgccuguaaucccagcacuuugggaggccaaggcgggauggucacuugagcccaggaguucaagaccugccuggccaacauggcgaaaccccaucucuacuaaaaauacaaaaaauuagccgggcgugguggcaugcgccuguaauuccagcuacucaggaggcugaaguggaugaaucgcuugaacccagaagguggagguugcaaugagacaagaucgugccacugcacucuagccugggcgacagugagacugucucaaaaaaaaaaaaaaaaaaaaagacucaaauaaauguuaaucuuuacaaaauuauuccauaugccacucacugaacuaaggaauauuaauauuaccagguuaaccuaaucagacuauaaacaaagauggaaggagaauuauuuaaaguauuaguauuaacuuacugcacucaacacaguaucauuugaauggugauuucuuuagaauaaaggugauaacacuaggggcagguaaauaacauuuuuaaacaguucucuuuuuaucaaugcuaccucucuuuaaaucuuuccacuuugguagauaacacaccagccaguaauacauucaggaaagucaaaggacugggguuucuuucuaggucagucaauuaaaaucacaggaaaggaagauucucaaucacuaucaaugaacagaaucagaguacucuguaccugguaguauucaccauucauuacuccaucaacagcaucugcaagacauaagauuuuggucuaucaauaaggacuggucaaacacugggccaaaggguuguacaguagaauacagcaucauaugcuguaugaaccuugagcuacuaaaugcuaucccugugguaggugcuauauacaacaaauaaaaccaagaugugcuuauauacaaauuucaccaaaauguguacacaucuguccuuaagcucccaaguccaaaagcuuuugauuuuauuuucuguuuucuauuuuacagugguaacaaauggaagacuagcagaaagagaacaguguuucucuaugaaaauucugcaugagggaaaaaaaaaaguguggccuggaaucacccauagugagcagagaccugcagcuucaucuuugagacagucuugcucugucgcccaggcuggagcaaaguggcccaaucauggcuuacuguagccucgaccuuuugggcucaagcgaaccucccaccucaguccccacaggagcugggauugcaggcaugcgccaccacgccuggauaauuuuucuauuuuuuuguaggaaggggguuucgccaugcugcccaggcugcuaucgauuuccuggacucaagcgauccacccgccucggucucccaaaguauuggauuacaggcaugagccaccaugccuggccucucauauuuuucuuaauuuuccuaguugacuuuuacuccuauaugucaguacaaaaaugaguuucuuauaguuugucaguggccuuuuaccacuuuaaggcaugugccaccuaccuauguaguuuuuuaagcacucuauaaaguuuuggaaauaugaaguuuaucaaacuagugaaagcaugggggaagcauauucaauuucgccucuguaauaaauuucuugguguagaauugcuggguuacagcugggcgcgguggcucacaccuauaaucccagcacuuugagaggccaaggugggaggaucacucgaggucaggaguucaagaccugccuggccaacauggugaaacccaccuccauauacuaaaaauacaaaaauuagccagggugguggcaugagccuguaaucccagcuacucaggaggcugaaagaggagaauugcuugaacucgggaggcagagguugcagugagccaagaucgcgccacugcacuccagccugggugacggagcgagacuccaucucaaaaaauaaaaaaaaaaaaaaagaaaaaagaaagaaaaaaaaggaauugcuggaucacaggauauguauuuuauuuuuuuuugagagagagucuugcucuguugcccaggcuagaguacaguggugcaaucuuggcucacugcaaccuccaccuccuggguuguucaagugauucucuugccucagccuccugaguagcugggacuacaggcgugagcuaucaugcccaccuaauuuuuuuuguaguuuuaguagagacggggguuucaccacguuggccaggauggucucgaacuccugaccucagacgauccacccaccucagccucccaaagugcugggauuacaggcaugagccacugcgcccagccaggauauguauuuuuuuauuuuuuuugagacggagucucacgcuguuggccaggcuagaguacacuggcgcgaucucggcuugcugcaaccuccgccucccagguucaagugauucuccugccucagccucccgaauagcugggauuacaggcacgugccaccaugcccggcuaauuuuuguauuuuuuaguagagacgagguuucacuauguuggucaggcuggucucaaacuccugaccucaggugauccgcccacuucagccuccgaaagugcugggauuucaggcgugagccaccgcaccuggcccaggauauguauuucaaagacuucuaaaauucuacccacuuguuccuauuagucuaccaguuuauauuacuacuagcagcacaagugccccauuucuuagaccuucccugauacuagggacugugcuugaucauguuuuaaaauuuuugcuaauuugauaauggaaaaaaaaaacaaacucaugguggcuuuguugugccaaucuuauuuccagugagguaaucacauacccgacaccugauuuucuucuuuacugaauuuucugaguuugccuauuuuccugcuauuuuuugaucucuaaguauuugcucucuaauagucaaauauuuucccuaguuucucuuuugauuugguuuaugguauuuaacacuuggaacaacuuaauuuguguauguagacaugaucgacuuuuucuucaugauuucuguaucugcuuuuaugcugaaggccuuuccuauuaugagauagacaaauacucacuuuucuucuuuuacuuuuuaaaugucucucuuuaauccaccuggaauuuauuuuuguguaagacagaagagugagauaguuuuaaauccuagauccuacaguggcuagucuggccaggccuacauuaugguuaauauaguacaauugacauaccaacuauccacuaauauaguccagcccugggcuggaauaugagagacuuugaucacuacuccauauacaaaacaagaagcaauccucaucccacaucuccuuaaaaaucacaugcugucugaaggcuccuccagacccacuggcaucugcuuuccucuuuauuaguuacuguauuacugcacuaacauucuuacaagaaucaacuggcucaagccaagggaucgucuguugcuguggaaacaugcagaaaggacauguagggccuugacuuacuacaacaacuaaacuaagcaacacgaugcuucagaaggaaacuuucuagggccuuucaggaacuccagacagaaaaagggccaguuuucaaaagugaaagacugucccaaacccacuuucaacuuuccacauuccagaaacauuugaagucaagcagaccuacguuugaagcugcacuugagccauuuauuaccuugcuaccuuagugacacugcucaacuuccacaccgauccauucucaucugaaauaugacacuaccacuuaaccuguggagcuacugcugggaucugaaaguguaccugguauacagcaaaugugcaguacaauuaacuaucaugcaugagauuucccuaaacuucccuccaccacugcuaccaauaaaauuacuucuccagaaagcuucccuuuaauucacccaugucucuuucuucuccuacaagaaauaacuugucaccgggugcggugguucacaccuguaauuccagcacuuugggaggccaaggcggguggcucaccugaggucaggaguuucagaccagucuggccaacauggugaaaccccgucucuacuaaaaauacaaaaaguuagcugggcacgguggugggcgccuguaaucccagcuacucgggaggcugaggcaggauaacugcuugaacccaggaggcggagguugcagugaaccgagaucgcaccacugcacuccagccugggugacagagcgacugucucaaaaacaacaaaacaccauaauagugccuuacugcuguacucucucuguggcuugucucuccuguucucuuccccgacucagcccucaugauugagagcuuuucaacagcuccacuugugcugccuccuucaugaccaccuguucuuccucaauaucccccacagcugguuaccucaauaucacuucacccagcugguuucuuccugccucuaaaccuacgucucuuuucuggaucucuuaacaaccaaaggagucauccaaggcuuagcccuaaccccucugguuuuugccugugcccauccuccauagacgcuuuccgcaaggcuggggccaguuuauuuuccucucaucaaucugucauagcugacugccuauauaucucuguauaauacaucagaaagagagcucccgccuaaaaccucaauuuacucaguacacuucaaagccuaaaggccuuguaacuccuuucucccacuaauaguagcuggaauucacuagauacuuaauauaacuguaagcacuuuauagacacucuuuaauguaauccuaaagaugccacauagcauuauaaauuauauuaugcaacuuuuacaaaggagaaaacugaggccgggcaguggugguaguuauauacauugucugagaucacaaagcuaaacucacacucaagcaguuuaggauagcauagaaucuuaaccacuagagcauaucuuuaaaaaaaaaaaaaaagaaggaaaaagaaaacuaagagagaaaaaguguccaaucaguucucuaaacuccaaaggaaaugcugaccacugcauauuaccaacuucaauuacacugucaggaaucuggcuuuaagucaccaaaugcuuaguucacuaagaaagucccuccuaggaacuaagucagcaaccauuucuuuccuucccuuugccgaaggcuugaugcacaaaggaccgagcauccaacucuauucucucccuuuuaccuucccuaacugcccgucaccaagaucugucaguucuacauaggacccuuggaucugacauuuuugcccauuucuuugucaaacgugagcaucuacuacaugucagacacacugcuaggcaguggagauaaaacaguaaggguaacacuguccuugaaucaggacaaucuuccaacuacagaucuuggguucugcuucucccaaaucuguuccaccugggacagccacagcugccugucuguuaucgcacuacaccccugcuaaaacaacuaaacacugcaacagaaugugguauauucuaagaguggguagacuuggggcucagcuauuaacucgugcuuuuuuaagcaagucguuucucucuaggauugcuucucuucuauuaaaugaggaagguuaaacuaagggucuaagaagucaauuuuaaaauucucagacaaauguuagagaccacccaaugaaaauauccccuaaucacuuaaggccaacuucaucucacaaucacagccuaguuuaguccaaccuacccgcuauaaaguugcauauucgggcauauuacauguucccacuaaguucuuauugggggacugauuuguuuaggaagcaacauggugcagucaaaaacucaagaggcugcaaacuagcagcacacccaccaacccauccaucaaaagguuccgccuggcuggcacaguaacuugagacugcuggaucugaaugccuuuacacagagcacuacuauagugcagcaaagccucagucuccaacacuucuacugucucaugucaagccagcuucucucguauauguuaccuaccuggcuccuuaagguuugaauuuaggguagacacuacuccuauaugccccaguagugcccuauucucccuuaguuggaauuuuuuaagugaaugaaaagccguauuucauuucuucuagcuaaauuuccuacuucuuuguauuauuaaguaggucuuuuccacucaugauccuaagcaucacacacagguuaaggcauccaaaggucaaacugccauccuaccugccccauuuuuacuugaguuuggcugagaacauucucuauucaccucuucaucccucccugauugguuuaggcuaaucuuggguucugcuuaggcaauauugccuaccaaagcuguucccagaggaagagcuccagaaguccuagcuguaaaucaaucgcucaacgauagcaaacuccuaccgcgcuuggcaguucuuucuccagaccuagaucaucuuucgaguucccuacucccuccuuccuccucguaauccaacacucuguacaccuuaagugcuuaaaugcugaacugcauugcuacuuuuguuuguaucucucaaaaacgauauuuccauucuuauuuuuuuccgcccuccuuuucuaauaacgaguucugugcucggcucagacuuauaagcuuauaagucuggaaaaacugcgccaaugcgguugcuucagagaccggacuaaaggcacagcaaaugcuuaaugaaaaguugcugaauugaacgggcuucuuccggcuccggagccugccacccuacacuugcuuucucgcuccgcccgcgcccagaagcacucaaacaugcugagaaccgaacaggcuucucgagccuagguuucugaaagaccgggccagggucucguuuccuguuugcacugcucccuaaccuccuaauucagcaaggagcacgagucacacagaagcucucggacccacuguggaccgaguuuccagacaaguccucucgccccaaacgcgcccgcacucucacccggaccccccggcggcucgccgugcggcuggggcccgggggcgccgccguccaggauggcgaaggccucgucguucucgaugcccgcaaucucgcucucuugcugcgccaagaaggccgcagccgggucuucuucgccggcgccggccacuccguuccccagcgcgggaccgccaggggcgccggcaggggcgccgaacggauccagcucagccauggcgggcaacugaacggcacggacaccaacggugagacaaaaaccaaccgacccaccgacaccacgcccggcagccaccgcuguggugccgacugggagaggaggacaagcgccaggagggagacggguaaagcggaagcccuacccguguauccggucggucuaggcgguguugcagagccgaaaagggaacaaccaauc

SEQ ID NO: 191368 - RNA, 104775 nt, Homo sapiens
cgaaaagauucuuaggaacgccguaccagccgcgucucucaggacagcaggccccuguccuucugucgggcgccgcucagccgugcccuccgccccucaggucaguucucccgccugcccgccgcagucgcaguugauggcuggggucugggcugugcggggcgcagcggcccaaacccaguuugcuccuggcucucgggagacuggaggauuucaucggagccccgcgcuuuaccagcccuguucccuggauaagauauuugaccuuuccgacccgcgguuuucuucuccguaaguggggauaaugaccgugucuacuuaacaggguuauugaagagguguucaggcuaagcguuugccaccuaggaggcugcgauagacgugaauucccauuucccguuuccaguuuccgugacucuuccccgcgaaaaaaguugacagaaggguuucgaguuuuuucuguuuguacaacucaguuuacuggggcagugcaauaaaaaaggagauguguuaucacuaccuuuucagaguccaaauccauccucuccuaucaucuccccagaguaguggcuucagaggcucacacuaaaaggggaauuuuuuuucuuuuucuucaagacggaguuucgcucuuguugcccaggcuggagugcaauggcgcgaucucggcucaccgcaaccuccgccucccaaguucaagcgauucuucugccucagccucccgaguagcugagcuuacagacauccgccaccacgcccggcucauuuuuuguauuuuuaguagagacgggguuucaccacguuggccaggcuggucuccagcucguguccucaggugauccgcccgccuuggccucccagagugcugggauuacaggcgugagccaccacgcccggccuaaaaggggaauuuucaccgaaugcuguaucaguaauaggagcagcaggauugcucccaccaagaaaccugguguaggguugugggagcuggaaaggguagacucagggaaggcugcccaagagaggaaucaggucccuagcacuuaggacggguaauuaccuuugguauuucuccuuuguuaguggaaugaggugaguaucaggagccuggauuguuguuuagaggccaguguuccuaacuuugguuuaaauuuugguuucuguuucccauggagucuggcuagaaaaucagaaaaaucagaaaagcccuuacugggccuucgugggcuuguuucucccaagggucuguccuuucuguguaacuacuguggaccaacuagaugggcagaucaaucccaaugagugccucauuguuggugcucccagaagccuuugcaagggagcagggcaggaugcuaauuaaauguguuacaggccacauuauaaaccauucugagcccggcgugguggcucacgcuuguaaucccagcacuuggggaggccgaggugggcggaucacuugaggccaggaguucuagaccagccuggccaacauggcgaaaccccgucucuacuaaaaauacaaaaaaaaaaaaaaaaaaaaaaauuaaccgggcaugguggcgcaugccuguaaucccagcaacuggggaggcugaggcacgagcaucucuggaacccaggaggcggagguugcggugagccgagaucuagcuacugcacuccagccuaggugacagaacgagacccugucucaagcaaauaaacagacaaaacccaaaaaaccauucuguauucuacuuccuguuugaaauuauccucagcaucagugucuuuccaagcucuguagauaagguaaauguauuuaugcggcaaguaauagaauagcccaaauaauauuguuaaaaaaugcccccaauuuguugcuauccuuuaaaauuuaaccauaaacgucuucucauuaucccaauuccuugcucuucugagaaguuaaagaccccaauuauaggccgggcgcgguggcucacgccuguaaucccagcacuuugggaggccgaggcagauggauugugaggucaggaguucaagaccagccuggccaagauggugaaaccccaucuuuacuaaaaauacaaaaaauuagccgggcgugguggcgcacaccuguaaucccagcuacuugggaggcugaggcagaauugcuugaacucagagggcggagguugcagugagccgagauuacgccacugcacuccagccugggcaagagagcaagacuccgucucaaaaacaaaaacaaaaacaaaacccaauuauauauacccccaauucuucuauuuauuuagucaagcccagaagggcacucaggugucugauuggggucuaauuuccuucuucauuauucacaguugagaggcugucuuccgcguugacugauaauauaccuccuucagcagcuacaaaguuggguuacucuguucucaaggcuuuucuguauucuauauuaacaaacucuagaggauaaacagggcacaugagaauauuuagaaccagcuccacauucacaaagauuuacaaaucaaguauaaucugcuauuaguguaggaguuuguaauguaagcaccaguuuucucacauugcagcaacaacgauauucccuugauucaguagcuauaaucuaggcccacauugguauuacucauccaaagacaugauguaauuugagagaagcggguagauagagaaaauggaagaaagaaagaaaaaaaaaagugcauggcuucagucuuaccuuaguuguuaaauaaacaacuugcccaucucugcuaguuuuccagaggccaugacugggauguuuauaacucuuuugggagaagucuauuaaguuaauuaugacacucuuaaaucccuaaucugggaagugaauuccagcaucuuacaaauugcuuucucuuucugagugacaauuugaaauagcccaguccuuugcauggaauguaaacaugugcauucagauuuauaguccaguguuccuccauuuccauucuccugcucucuuuuuucuucuguaucaggauuccaaagauuucugagccuuagguugaccucuauacuuuuacuguuuuuauugccuuuuggaauuucuuaguccuaugguuccuguuuguuuuuaggaugagguuccaguuuauccccacauuugccccacugacaaaugcccuuuaaaauauuucugaauuaguguugcuguuuaaaguauuuaauccugugccuucaggugcccagugagaauaaauuuguccucugugauaucuccuugccuugaguaacuuuuucuacuccaguggaagcagaauguuucauuuucuaucaacaguuuucccucaguacugggaccugaccuugcuucuucuaauguuugccuacuguguucaugcagauuucguuagguuaaauguucaaccuacuuauuaaguuggguccagugugaucucuuccuaggaaauggcuuaauauuguuuauuuuaucagaaugucguuuugcauguuaucuuuuugugugcuauuucugcuuugauguugaagacugaaccuuguuuuuuaaagcugauuuaauuuuuuucuugagugucgauauuuuuccuucuaaagcuucugcucuaguuuucuauucauugaccaaauuuuuuuuguuuguuuuugagcuggagucucacuccugucgugcaggccagagugcaguggcgugaucgcgggucacugcaaccuccaccuccuggguucaagcgauucuccuuccucagccucccuagcagcugggauuacaggugugcaucaccacgcccggcuaauuuuuguauuuuuaguagagacgggguuucugcauguuggucaggcuggucucgaacuccugaccucaggugauccaccugccuuggccuaccaaagugcuaggauuacaggcgggagccauugugcccagccguuuuuuacuugcugauaauaauuuucuuuuucucuccaaguaaaaugauucauggaaucaguguuucaggcauagaaaaaugauauuuuuaaaauguccuuuguggcuuuugggguuuugauaaguucauucagaauuuuuuccaccucaauuuuaagaagacuacucaucauuguaugaagggccuucucuuauuaagcucugucuuccuuuauaagcucaccacacuucugagguugaacucacacucuaggucuuccaaauucauggccauuauuaaggcuuaguaacaugcuagucacucaguucuggauaagggcagggugaagaacagagaauuugaagguaguuuacguggcaccugccacucaucaguuugaggcuuaaacaggcuugcuuggccagggcgauggcucacgccuguaaucccagcacuuugggaggccaaggaggguggaucaccugaggucaggagucugagaccagccuggccaacauggcgaaaccccaucccuacuaaaaauacaaaaauuagccggguaugguguuguuguucgccuguagucccagcuacuugggaggcugaggcaggaaaauagcuugaaccugggaggcgcagguugcagugagcugagaucgcacuacugcacugcagccugggcaccagagcaagacuccaucucaaacaaacaaacaaacuagccaggagugguggcaugugacuccuggccucaagugauccacccaccucagccugccaaagugcugggauuacaggcgugagccacugcaccuggccucgacuagauuuuaauuuuuaauuuuuauuuauuuuuuugagacacagcuucgcuuguuacccaggcuggagugcaguggcaugaucucggcucaccgcaaccucugcuucccggguucaagugauucuccugccucagccucccuaguagcugggauuacaggcaugggccaccacgccuggcuaauuuuuuauauuuuuaguagagacgggguuucuccauguuggucaggcuggucuugaacucccgaccucaggugauccgccugccucagccucccaaagugccgggauuacaagugugagccacugcgccuggcuguuuuuuauuuuuaguagagacaaggucuugcuauauuguccuggcuugucuugaacuccaggccucaagcaauccuccugccuugaccucccaaauugcugggauuacagacaugagccaccaugcccagcuaucuuuacgcuucuuccuuuugccacuccuagcuguagguuugguauggggaagaccuuagcuaucuauguuuucaacauuucaaauauuugucuuuugcuuuuaagucuuuacaacuguuacugauuuuguauggugugagauagagauccaauguguuuuuuuuuuuccuucaccucauggcuaaucaauugucccagcuccagagcugcauuuccaucaccuguuaccucuaaaagcagccucaguucaguaccugucaacuuuuacuuccucuaggaucuuugcaccuaaauucccucuuucuggaauauucuccgucuauuucuuugugggcuaugacuguuaaggccuacagaccaaagaccacaucuguaguaaaaaucauuagauguauuuaguuugcugcgcaagagaaaccauacucuugagaauuuuggguagucucagagugaguugaaaggggcagaaugagggaagaaugaggugggccugaggaugucauugaagacaaugaagucagucaaauaaaggaucuuuauuuuaacagccuuguauggaaacauuguuuauaugguuauguucagauucuauugaaaccauuguucaaguuuugauaggaauaucacagucugauuacuggcagggcugauuuucucaauucucauccuuugaauuagagcuuggcuuaaauguuaccuucucagaaaccacuguugcuuauuuuuauuucaguauuuaguauagauaauaauaauaguaauuauuauuuuuugagacagaaucuugcuuugucucccaggcuggagugcaguggcacgaucuuggcucacugcaaccucugccuccuggguucaagcaauucuccugccucagccucccgaguagcugggauugcaggcgcacaccacaaggccuggcuaauuuauuuauauauuuauuuauuuauuuauuuuugugagauggaauuucgcucuuguugcccaggcuggagugcaguggcacgaucucggcucacugcaaccuccgucuccuggguucaagcaguucuccugccucagccucccgaguagcugggauuagaggcauguggcaccacaccuggcuaauuuuguauuuuuaguagagacgggguuucaccauguuggucaggcuggucucgaacucccgaccucaggugaucugcccgucuuggccucccaaagugcugggauuacaggcaugagccaccgcgcccagccuaauuuuuauauuuuuuaguagagaccggguuuuacuauguuggccaggcuggucccgaacuccugaccucgugauccgcccacccuggccucccaaagugcugggauuauaggcgugagccucugcacccggccuauaaauuauaaguauuaauuuguugucuacuuauuugccuuuugucuucuccacuagaauauacacuccaugagggcagaaucauauuucuucuccauuauagcccuagugccaagggcagguuuggcauaucauaggugcucaguaaauaucuguaugaauaaaugaauaagagcaaauucaagaguuuucuagaacugcauuagcaguuuuuccagacacacugcugaucucuaaaagucaaccacgagguuauuuuccacaaguaagauggagaugguaugagugugacuuuguauauuaaugugcauaacagggcccuacuuagcucuaugguuuuuaaaaaauaaacuacuuaauuuuaaaacucagggagacaaaaucaauaagaucuaccuaauuuuuuuuacaacuaauuuuuauuuauuauuugauguauaauuaacaguauauguaacccacauaaguugugaagcauaauaauaaaauacauaucauauacauaauaaaauuguguaugacuggggucuuaguuuggguuuuccugaugacuacugauaauuuuuucaugucuucuuuuuuuuuuuuuuuuuuuuuuauuuugagacagaaucucgcuccguugcccaggcuggagugcaguggcgugaucucggcucacugcaaccucugccuccugccucagccucccaaguagguggaacuacaggcgcgugccaccaccccuggcuaauuuuuuauagcuuuagcagagacaggguuuuaugauguuagccacaauggucuccauuuccugaccuugugauccacccgccucggccucccaaaguguggggguuacaggcgugagccaccgcacccggccuuuuuuuuugagacggaguuucacucuuguugcccgggcuggagugcaauggcacaaucucagcuuacugcaaccuccgccucccagguucaagugauucuccugucucacccucccaaguagcugggauuacaggcuccugccaccaugccuggcuaauuuguguauuuuuaguagagacggguuucgucauguuggucaggcuggucucgaacccugaccucaggugaucuacccuccucagccucccaaagugcugggauuacaggugugagccaccuugcccagcuucgugucuuuuuuuuuuaaauuauuuuuucuucagguagccucccgagccagaguaggcucagagacacccuuuuccauguuuuuguuggccauuuguguuucuuugagaaauuuuuuuuuuuuuuuuugagacaaagucuggcuguuucgcccaggcuagagugcaauggcacgaugucggcucacugcaaccuccaccucccggguucaagcgauucuccugcaucagccucccaaguagcugggauuacaggugaaugccaccccgcuuggcuaauguuuuguaucuuuaguagagaugggguuucaccauguuggccaggcuggucucgaacucaugaucucgugaucugccugccuuggccucccaaagugcugggauuacaggcguaagccaccaugcccggcugagaaaaguuuuuuguaucauuugcuuauuuugcuguugaguuuuucuuauuguuuugucagaguuuauguguuuccuguguacauccacuauuauauuuguugcaaguaucuucucacauuuaugguuuucuuuuuuugauggugucuuugguuguauagaagugcuuaguuuuauuuuuauuuuuuuuauagauguggucuugcuauguugcccaggcuggccucgaacuccugggcucaagcuguccucccaaguggcugacaacacacgcaccacugugcccagcugaaguucuuaauuuuaauguuguuuaauauauuaauuuuuuucauuauuauuauuaguacuuuauuuaagugauccucuccuauccugaaauaaugacaauauucuuuaaaaaguuuuaaagguuuauguuucauacuuuuuaagucuaucuggaauucauuuuuauguauggugugagauaagaauccuuuuuuucauauggccaauaaucaguuuuuucaguaucauguaaaugcauaagacuuauuuagauuugcaguuacaagaauggaggagaugauccgguauuauuuccuuuauugauuauguacucucugucuucuagguucuuuuucuaauuccaaauaaacuugcaagaggacuaugaaagauuaugaugaacuucucaaauauuaugaauuacaugaaacuauugggacagguaauuguuauuuuuuuuuggaggcaguggauagaucaacuauuugagaguauagauuauuuggguaggugugagcuuuuucgucuaacccacacaguuuuaaaauucuucuaccuacuucaguaagaaaaaguggagcaagcagagaggagaauaguaggagaagcccuguagguuauugcaaggacuuugacuuuuauucuaaauaauuuauucuaaauauuucuuuuauuucuuuuuuuuuuugagacggagucucacucugucgcccaggcuggauggagugcaguggcgcgaucuuggcucacugcaagcucugccucccggguucacgccauucuccugccucagccucccaaguagcugggacuacaggcgcucgccaugccuggcuaauuuuuuguauuuuuaguagagacgggguuucaccguguuaaucaggauggucucgaucuccugaccucgugauccacccgccucggccucccaaagugcugggauuacaggcaugagccaccgcgcccaggcuucuuuuauuucuugacuuuuauucuaaauuaaagucauuggagaguuuugaguuaagggguaauuugaccuuuguuuuuacagaguugcuguggcugcuugguagauaaaagguuggaugaaggagggcaagagcagaggcagggagauguuagcagacuauugcgauaauucagguguugaugcuagagaugauggugguguggaugagggugauguaaaagcagugaaaggggugggacauuuuacacacacauauguacacaccuauguguguauguuuuuauuaagguauaacauauaguaaaauaugcaaagugcaauaaucucaguggaguuuuacacauauauauguauacacauacccauauauucccugugcggaucaagacauagaccguuuccagggaguaucugccugcuuucccccaagguagccauugauauauuuugaggacagagcuaaugggauuuauugauggguuggagugcuagagaaagagaagggcuaaggaugguuccaggguuuuuggccugagcaccagggaaaauggaguugcccuuuguugaaaggaagaagaccaugggagagacuacuaggaaguucuuuuuggaaauguuaauuuggggauuucuuuuagcugccugaguggagacauuuguccagcuuuugguucaguuuugaaaaauaauugcuuaucuucaaaguuuuuuuuuuuuuuuggagauggagucuugcucugucgcccaggcuggagugcaguggugcgaucucgggucacugcaagcuccaccuccuggguucaugccauucuccugccucagccucccgaguagcugggacuacaggugcccgccaccaugccaggcuaauuuuuugcauuuuuaguagagacggaguuucacuguguuagccaggauggucucgaucuccugaccuugugauccgcccgccucggucucccaaagugcugggauuacaggcgugagccaccgcgcccggccucaaauauuuaaaacugaguggaaguuucauauaauuugucuuuggccucagcaacuuuauauuguguucuagcaguguuaauuauaaaggaaauuuaauugcaggauuauucauaaagcagauuucuaaagugaguucuguuuuuuuuuuauuacaaaguuugagauacacuaucaugguuaaaaaaaaaaaaaccuucagcuagacauuggauaacaagcagcaacaggaaaaaaaagccacaaacuucuaggaaaauuuggcuugauagagucuuuuaaaauuauuauauauaaaaagguguuugugccugaguccuugcuuaugcuuucauaauacauuuuccuacuuagguggcuuugcaaaggucaaacuugccugccauauccuuacuggagagaugguagcuauaaaaaucauggauaaaaacacacuagggguaaguuuagauuuauuuaaaaaauaguccacuuauagaucaguuucgugaauuaaaaccugaauuguucuaauguucuaguuacugcucuuagaauaauauuuuuauaccuuuuaaaaaacguauagaucugugguuuuaaaaaguaaucugggggaagggauuacuuuguucuucagauuuuaacgcagugcagugggacauauuugaagucuguagcauccaucugcagucuguagucuguagguguuucuggauauuaaugugucccaucuuucuuuucuuuucuuuauuauuuuuuauuuuuuuuugagacggagucucgcucugucgcccaggcuggaguacaguggcgcgaucucggcucacugcaagcuccgccucccggguucacgccauucuccugccucagccucccgaguugcugggacuacaggcgcccgccacuacgcccggcuaauuuuuuguauuuuuaguagagacgggguuucaucguguuagccaggauggucucaaucuccugaccccgugaucugcccgccucggccucccaaagugcugggauuacagucgugagccaccgcgcccggccucuuuucuuuucuuuacuuuuuuuuuuuuuugagacggaguuuugcucugucgcacaggcuggagugcaguggcgcgaucuuggcucacggcgaccuccgccucccagguucacgccauucuccugccucagccuccugaguagcugggacuacaggugcccgccaccaugccuggcuaauuuuuuuguauuuuuuuuuuuuuuuuuuuuaguagggaugggauuucacuauguuagccaggauggucucgaucuccagaccucgugaaccgcgugccucgaccucccaaagugcugggauuacaggcgugaggcaccgcgcccggccccaucuuuauuuucuuaugauacucuuacuaaauauaaaucauuuugguacuauagauaggcaaauagauaaauauuauguccuagcuuuuuuuuuuuuuuuuuugagacagucucacuuuguugcccaggcuggagugcaguugcacaaucacagcucacugcagccuguaccugcugggcuuaagugauccucccaccucagccuccugagugggugugaccagaggcacaugccacuaugcuugccuaauuuuuaaacauuuuucuagaaacaaggucuuacucuguugcccaggguggucucaaacuccuggccucaagcagucuucccaucucagcuucccaaaguacaggguauguaggggugagccacuguacuuggccugucccagcauuuuauucaaaauggcuuuagaaguuaucuaauuaaauccuuuuccaaaucagccucuuuuuccucuaugugaauucuuccagggggaacagcuuguuaucuccuaaagcagcccauucaguuuguggucuuggcuacaauguauaaaaaguuauuuuuauguugagauaaagccugucucuuuuggugguuuuucuggggcuucuguacccauuccaguguuugaagucaccuugagucaucuuuuuuuucuaauuccuucuaccauucuuuguuuuuuuuuuuuuuuuuuuuuuugagauggagucuugcucugucaccaggcuggaaugcaguggugcgaucucggcucacugcgaccucugccuccuggguucaaaugauucuccugccucagccaccugaguagcugguacuacaggcgugugccaccauguccagcuaauuuuuguauuuucaguagagacaggauuucaucauguuggucaggcuggucucgaacuccugaccucaagugaugcacccaccucggccuccuaaagugcugggauuacaggugugagcuaccacucccagccuaacauuuuguaauuguccuuaauuaucaaacauaaaaaauaauuuuugguugggugugguggcucaucccuguaauuccagcacuuugggaagcugaggccagaggauugcuugaggccaggaguucgagacuagccugggcaauauggcaagucuugucccuacaaaaaauaaaaaaaauuuagccaggugugguugugcaugccuguagucccagcuacuugggaggugguggugggagggucccuugagccuaggagguugaggcuacagugagcugugauugcaccacugcacucuagccugggcaacagagcaagaucuugucuaaaaaaaguuuuuuuuugauguuuuuauuguuggaaugagauagggcuuaauauuaauuguuaccuacuuuuuuaauuguuaaagauauaaguucugauuaacacauaaauaagucaaagggagccaggcacuguggcucacaccuguaaucccagaacuuugggagaacaagguggguggauugccugagcucaggaguuugagaccagccugggcaacaaggugaaagcccuucucuacgaaaaauacaaaaaauuucgcuggacauggugguacacaccuguagucccagcuacuugcggggcugaggugggaagaucacuugagucugggagguugggcugcagugagccgagauggugccgcugcacuccagacuggaugacagaacaagacccugucuccagaaaaaaaaaaaaaaagucaaagaguauguaaguaguuuuguuacagcaaugucauuaaaucauuugaauuucuuccuaaauauaugcuaaaaucauacaaugaccaguauaagaaauuauuuuuaauuaucugucaguggacaauucaggcuuuccuccaguuuuuuuguuuuauucaauuuuuuguuuucuauuuauuaaucuaagaaaaaagcauuaaaaccauuuuucuugagcauuuaaacaugaguaucaauuagauuaauucccuuaagcaguuuaaauuucaguuauaacuuuaguaugacuuacuuuaacacuucaaauacuuaaauagcaaacaaaauguuauuacaaaauguguuaucacacugaugcucaaaacuuauucuaaagcguaauaugacauuaauucaugauuucuaaacuuguuuuuauauuuucuguuguuauuaugcucauuuuaguuauuuucuaggauuuuaauaauauuuugauuacuuccaugguuuuauuuauuuauuuauuuauuuuugagauggagucuugcucugucacccaggcuggagugcaguggcacgaucucggcucacugcaagcucugccucccagguucacgccauucuccugccucagccuccagaguagcugggaccaccacgcccagcuaauuuuuuuguauuuuuaguagagacggguuuucaccguguuagccaggauggucucgaucuccugaccucuugguccgucugccucagccucucaaagugcugggauuacaggugugagccaccacgccuggccgauuacuuccaugguuuuagucaucaggcuuccuccccacaaagaaagaagauuaucauaccaagauagugaaaguuacaguugauucuuugucaagacaugauaucuaguugcauaguccuggauaacuggguccugagacacuggccauuaagacggagucccuuuuuauuuuauuuguuuuucaagauggagucuugcuuugucacccaggcuggagugcaggggugugaucucagcucacugcaaccucugccuccuggguucgagcaauucuccugccucagccucccauguaguugggauuacaggugccugccaccaugccuggcuaauuuuuguauuuuuaguagagacgggauuuuaccauuuuggccaggcuugucuugaacuccugaccucgugauccgccugccucggccucccaaagugcugggauuacaggcaugagccacuguagagcccccccgccuuuuuuuuucugauacggaguuucgcucuuguugcccaggcuggagugcaauggcaaccuccgccuccuggguucaagcgauucuccugccucagccuccugaguagcugggauuacaggcaugugccaccacgcccagcuaauuuuguauuuuuuuuuuuuuuaauuuuuucgauacagagucucgcuguguccccaggcuggagugcaguggcacgaucucggccacucccagguucaagugauucuccuugcuucagccuuucaaguagcugggauuacaggcacccgccaccaugccuggcuaauuuuuucguguguguuuuuauuagagauggguuuucaccauguuggccaggcugaucuugaacuccugaccucgcgaucugcccgccucagccucucaaaagugcugcaauuacaggugugagccaccacacccaaucagaguccuuuuuuuuuugagauggaguuuugcucuuguuucccaggcuggaucgaucucggcucaccgcaacuuccaccuccaggguucaagcaauucuccugccucagccuccagaguagcugggauuacagacaugcgccaccaugcccggcuaauuuuguauuuuuaauuuuguguuuuuaguagagacgggcuuucuccauguuggccaggaugguccugaacuccugaccucaguugaucugcccaccuuggccucccaaagugcugggauuacaggcaugagccaccgcgccuggcccagagucccucccuuuuuuuuuuuuuugagacggaguuucgcucuuguugcccaggcuggagugcaguggcaugaucucggcucaccgcaaccuccaccuccuggguucaagcaauucuccugccucagccucccgaguagcugggauuacagccaugcggcaccaugccuggcuaauuuuauauuuuuaguagagaugggguuucuccauguuggucaggcuggucucaaagucccaaccucagguaguccgcccaccuuagccucccaaagugcugggauuauacgcgugauccacugcgcccugccucagggucccuuuuuauaaugaaguuuuacuuguuacuugaugauaucucuaggcuucuguccuuuaaaguuuuuucagcuuggcuuaucuuccucuccccacccaacuuuuuauuuugaaaguuucaagaccucagaaaagauuggagacugagacagugaauacccauauaccuuucaccuaaguucacugguuuuuugcucagcaugcuucuuaaacgguguugcugaggcugaaagugguagcucaggcaugaugacugaguaguguuucugucauuuuccuuguuuggaaugcuaaccuucuaaggagucugagauuguuuucuggauguuguacuguugacccacauugaaccugucuuucauaaaaucuccaaugcccuuuuuaugcacaugcaaauaaauuuugcuauauuuuucuguaguguugaacaguuuuuggggggcuuuuugauagcuuuugcuacuuaguauuuuuuuuuuuugaaacagagucuugcucuguugcccaggcgggagugcaguggcgcaaucucggcucacuccaagcuccgccucccggauucacgccauucuccugccucagccugcugaguagcugggacuacaggcuccugccaccacgcccggcuaauuuuuuuguaguuuuagugagacaggguuucaucguguuagccaggauggucucgauuuccugaccucaugauccgcccgccucggccucccaaagugcgggauuacaggugugagccaccgugcccggccagcuacuuaguauuaaagcuguuaguauuggagcuuggaacaccaccugaauaaguuuauugcucauuccauaugauguuuugucacagagugauuugccccggaucaaaacggagauugaggccuugaagaaccugagacaucagcauauaugucaacucuaccaugugcuagagacagccaacaaaauauucaugguucuugagguuaguaguauguuccagauaccugaaaacauuugaucacuuuaucaauaguaaaagagaaaaguacauuucaccugaaagauuagaagagauguuaagcgacuuaccuguuuuguuccauuuguaacaauuuagauuaaauagauguauauaauaaguuggagauucaauguaaaugucauuuuucuaauacaccccuaaugggguaguaugguuuacuagauagaauauguuagaauuuucuccuagagggaaggacucauucuaguuuuuuuuuuuuuuuuuuugagacggaauuucgcucugucgcucaggcugaagugcagugaugccaucucugcucacugcacccuccaccucccgaguucacgccauucuccugccucagccuccugaguagcugggacuacaggcgcccaccaccaugcccggcuaauuuuuuauauuuuuaguagagacgggguuucacguguuagccaggauggucucaaucuccugaccuugugaucugcccuccucggccucccagagugcugggauuacagacgugagccaccgugcccagccucauucuaguuuuauaugguauauuaauuuccuagggcuguuggaacaaauuacuacagacuugguggcuuaaagcaacagaaacucauugucugacaguucuggagguuugaagucugaaaucaaaauguuggcaaggcugguuccuucuggagguucugagagggaaucuguuuccugccucuuugcuaguuguugguaguugcuggcaguccuuggcacuccuugguuuauagaugcaccacucccaucuuggccuccgucuucaaaugguguuuuccucucuguguagcugugucucuguccaaaugucucucuucuuaaaaggacccaagguuuaggcuuacccugauccagugacaguucaacccccagcacuggguagcuuccagugucuuuuauguaaaccaagcaauuucaaguuuuaacuugccauuuuugucuugaaagaugucuuuagaacuuguauuauucaacuucuuuaguuuucguuagucucagccaaauaauauguaauuugcacaugauuuucacaggauagcacuguuuuaaaagcauauuuuaaaaaucauaauuuuggccggguccucucaugccuauaaucccagcacuuugggaggcugaggcgggaggaucauuugaaaccagugguuuaaaaccagccucaguaacauagcaagacccugucucuacauacaaaagaaaaaagaaaaaaaaaagccgggugugauggcgcguggugcgcaccugucauuccagcuccucaggaggcugaggcgggagaauugcuugaguccaggaguuugaagcugcagugagccacguuaauggcacuguacuccagccugggugacagaacaaaccccugucucuaaaaaauaaaaacaaaaaaauuauaacguugaauguuuuggaucuagagcuauuguauaguaguacauuguauuacuacacuguagaucuaccuacaugguccacauuuuaaaaccucuuugauuuuaaaaccucuuugguaauuuuaaaaccucuuuauauuuuuaggugaucccuuuguucaaauaaaauucuuagggccaggcgcagggggucacgcuuguaacugcagcacuuugggaggccaaggcugguggauuauuugaggccaggaguucaagacuagccugggcaacaugggaaaaccgcauuucuacaaaaaauacaaaaacuuagccaguugugguggugcaugccuauagucccagcuaccugggaggcugagguaggaggaucacuugagccugggaggcagagcuugcagugagcugagaucaugccacugcacuccagccugggugacagagcgagacucugucucaaaaaagaaaaagaauuguuaaaaucucccaagcauccaugaaccuaggagaaaauuuaaaagguacaagagaguggccgggugcagugucucgugccuguaaucccagcacuuugggaggccaaggugggaagaucacuugagcuaaggaguucgggacuagcuugagcaacauagugagaccuuguuuuuacuuaaauaaaaaaagaaaaaaaggcuggguaugguggugcacaccuguagucccagcuacuugggaggcucaggugaggagccugggagauauaggcuacagugagcuaugauugcaccacugcacuccagccuuggcaacagagugagacccugucucaaaaaaaaaagguacagggaguauauauuaaaaaacaaaauccucucuuuccccuacaucccagucauccaauauucuuuaauuuuuaaauuuuauuauauuguuaauagaaaugggggucuuggccuguugcccaagcuggucuuggacuccuggccuuaagcgaucuucccuccuuggccucccaaaauguugggauuacaggcgugagcaacuaugccccacccuagucaucacauuucuuuucuuuuuuuuuuuuuuuuuuuugagacggagucucacacugucuugagugcuggagugcaauggcguaaccuuggcucacuacaaccuccgccucccggguucaagugauuuuccugccccagccuccugaguagcugggauuguaggcacgugccaucacccccgguuaauuuuuguauuuuuuaguagagacggaguuuuaccauguuggccaggcuggucucaaacuucugaccucaggcaauuugcccacuucagccucccaaagugcucgggauuacaggagugagccaccgcgcccggcccucaaauuuucuuuucucugagccauucauguacuuuucuugugucucuuguagauaccuacauauauuuuauacguauguguauuuuauauguguguguguguagcuuacacacacauggugugacacaaauggucacaaauuauuacuuugcaccuuguuuuuuucccagguaacaauugaucuuagagaccaucugagcacauucagauauuuuagacauuuuuauuucucuuuauuuuguauuucuuuauuugaaaauaugaaguaggcuguuuucuuuuuguaaaacuuacuguauaacauuaaaacauuuccuauugagguauaaauuuacauauaauaaaauguacacauuagguaugcaguuugacaaauguauauacccauguaccucccaccccaaaguauaaaacaucucuaucaccucagaaaguuuucuccagcccuuuugaaguuuucccuguaaccauagccacccugcccuuaccagcaacugcucaucugauuucuaucacagcagaucaguuuaaucuauucuagacuaugauguaaaugacucauacaguauucuuuugcuuauucuuuuguuaggcuucuuuugcucagcauaauacuuuuguaagccacuauaucaaucuauagucuuaauaacuuaguacuggacauuguuucauaucaguuuguaaagagcuuccucuuuuuuuuuuuuuuuuuuaauuauugccuagaauuccauuccgugucauaguuuauauaguaucagcauuuaggucugaaugcuguuauuccccacaaauucguauguugaaacuuaauccccagugugauaguauuaagagguggggcccuuuaaggaggugauuagguuaugagggcagagcccuuaugaaugggauuagugccuuuauacaggaggcuuuagggagccuguuugcucccuuccaccauaugagaauacauagcacaugccaacugugagcaacagaaccucacuagacacugaaucuaguggcaccuugauguuagacuucccggccuccagaaaugugagcaauacauuucuguuguuuauaaauuacccagcguaagguauuuuguuauagcagcccaaauggacuaagacaguuguuucuagucuuuugcuuuuacaaacacugcugcugcaguaaaugaucuuuaagguacguuuuuuguuguuguuguuguuguugcuguuguuguuuguuuuuugagacgaagucucacuuugucacccaggcuggagugcaguggugcaaucuuggcucacugcaaccucugccucccggguucaagcgauucuccugccucagucuccugaguagcugggauuacaggcgcccgccaccacgccuggcuaauuuuuuguauuuuuaguagagacggguuggccaggcuggucucgaacuccugauccacccaccucggccucccaaagugcugggauuacaggccugagccacggcgccuggccaaaguacuguuuuuugauaugagugaguacaucuauaagagcaguaacuaaauguggaacugugaggucaagucuauaugcauuuguaauuuuaauugauauugcuaaaauggaaacccagcucacagaaaaguggagaaaguuuucugugcccugggaaagggauggaaagccuugagcuuugugcucugguaccuguucugcagccucugagauaccucuguagaccugggcuccuucugguacagauugaaaaccacuggucuuugggauagagaaacaauaauuacugcuggcuuuuuaaauuucagguaauuacacugaaugagaguacauuaagaugagaauggcuuuuaauacuuugcuauaaaaauauaaaacccugggugagcuuuuuaaaaucacagugguaguugguuuuacuucuacuuacugguaauaaaacuguucgaagaaagaguuauuguucucauuccuggagucauuauugacuuguuugauccugagaguguacuuuugaauauaccuuacucgguuccauucccuauaaagucgaauuaauaauaucucugaguuaaguguacuuuuuuauuuuaaauuucugugaagugauuuuuuaaguuguaacaauaucugugauuccauugcuguugaaguacugcccuggaggagagcuguuugacuauauaauuucccaggaucgccugucagaagaggagacccggguugucuuccgucagauaguaucugcuguugcuuaugugcacagccagggcuaugcucacagggaccucaagccaguaagugacugcaucacaguuagaugcucaccuucagcgucauuuaccuguuauuuuuagguuuacaaaugaucugauuaggaaucuaucuuugguuugcuuuuuguuguuguugcuccagucauaccuaucagauuucuuuuuuccucuuacuuuuuuuuuuuuuuuuuuuggagguggugucucacucugucacccaggcuauagugcaguggugugaucucggcucacugcgaccuccgccucccggauucaagcaguuccccugccucagccuucugaguagcugagauuacaggcacagggcaccauguccggcuaauuuuuuuauuuuuaguagagaugggguuucaccauguuggucagucuggucauuuuuuuggagacggagucucacuccgucgcccaggcuggagugcaguggcgcgaucucggcucacugcaagcuccgccuccuggguucacgccauucuccugccucagccucccgaguggcugggacuacaggcgccugccacaacacccggcuaauuuuuuguauuuuuuaguagaaacaggguuucacuguguuagccaggauggucucaaucuccugaccuugugaucugcccaccucggccucccaaauugcugggauuacaggugugauccaccgcgcccggccaggccagucuggucuugaacuccugaccucaagcuauucuuucgcccuggccucccaaagugcugggauuacagguaugagccaccgcuccuggccuugguaggcuuuuuggaugcauuuaugagcauucuguguaucugucaauugugugugacuuuauaaaugucuuguuuuuuuuuuuuuuuuuuuaagcaagaucucacucugucacccaggcuggagugcaguggcaugaucagggcucacuguagccucaaccuccuaggcucaagugauuuucccaccucagccucccaaguagcugggacuacaggcguaugccaccaugccuggcuaauuuucuguauuuuuauuuuauauauguauguauguauuuauuuauuuuuauuuuuauuuuugagacugagccuugcucuguuauccaggcugaagugcaguggcgcaaucuuggcucacugcaaccucugccucucagguuaaggugauccucuugccuuagccuccugaguagcuggaauuacaggugccugccaccacucucggcuaauuuuuguauuuuuaguaggccugggguuuugccauguuggccaggcugguuucaaacuccugacuucaagugaugcgccugccuuggccuuccaaagugcugggauuacaggcgugagccaggguaccuggccggaaacuaucuuuuuccaucuguuuauacugaacucgucgauuucaacucacucuuuugguuuaaauuugcuuuuggcacaaauuguguuugcuuguaguugacucucagaacaccaaggagaaaauaggagaaaaugguuuaugcuagugagucuuauggggaagugauagagugaucgcccaggcuggagugcaguggugcgaucuccgcucacugcaaguucugccucccguguucacgccauucuccugccucagccuccugaguagcugggacuacaggcgccugccaccacgcccggcuaauuuuuuuuguauuuuuaguagagacgggguuucaccguguuagccaggauggucuugaucuccugaccucgugauccacccgccuaggccucccaaagugcugggauuacaggcgugagccacugcgcccggcccuuuuuguuuuuuuuguuuuuuuuguuuuuuuuguuuuuuuuuuuuugagauggaguuucgcucuuguugcccaggcuggagugcaauggcacugucucggcucaccccaacccccgccucccgggcucaagcaguucuuuugccucaaccucccaaguagcugggauuacagguaugcgccaccaugcucagcuaauuuuguauuuuuaguagagacgggguuucuccauguuggucaggcuggucucgaacuccugaccucaggugaugugccugccucagccucccaaagugcugggauuacaggcgugagccauugugcccagcccuucuuuucccuuauauacuucuugucauuucguuaguuucuagucauuuucaguuuguuguacccggacuuuuuaacagaaacaaccuuaaaucauuuuuacucauuuuaauuaauuuauuuauuuuuaaaaagugagaccaggucuuucuguguugcccaggcuggucuugaacaccugggcucaaauaauccucucucaucugccuucagagugcugggauuacaggcaugagcugccacaccuggccuuaagucauuuuuagaaauggcuagaggugggaugugauauaaggaagucaguauacaguuaucaaaauaucuuuguuuucccaggaaaauuugcuguuugaugaauaucauaaauuaaagcugauugacuuuggucucugugcaaaacccaagguaagugcagaaauaagaugcaucuauguucuuuguaaaugcauuuauuucuuagugugugauuuuguccugacuuccacuuauucuuuauugagcuugguugcauccauugagaagaauguuaaauuucaucccagguauggguaguuuuuguaaguucucuagaugaucauaacaugcaaucaagauugagagucacugcccuaguucuaggauugguccugcugaagacuccauggguaugcugugagaauuugcagugcagaggugacuugaggcuauuacagcaagaaugcugacuugaccagugcuugcaguuugaguauauugccacuagaugaugccuuuguuuguuuagauaaaaguugagaauuuagugcaaaucuguuauccaaaugguucuauaacuaacaauuaguuacauuuugagaaacaauccgcuuuccuuuuaaaagaaggaaaaagcccauaugcacuucuaaauuuauaacuguuauauauuuccuuaauuugcauuccaugguuauguauugguguucuccagcauaacuucucuuugaggugacuuugaacuuucuggcucugcugucugcagcagaucuccuguguggcugccuguuggaagcuuccucuggaguucucuaaucaugguacucacaaucucuaaaaugagcugucuacacucauuaagaauguugaaauugcagacuugucucgggcuuugguaaucccauaacuguuuccugcccugaucagaauuagcuaggugcaaagggaagcagauuuugccccuuuggcagaaagucugauucuuucugauucuucucuccuucccuuggcucuuuagaaacuauaaguggaaccuuuuuucugggaaccaaaugcuagaaggcagguuuuuuuuuuuuuuuuugauugacaaacauauaaagaaaaaacauacuuugaacagauaaacugguuuaaguuguucuccaugggaggcaguggagaagguuugugacagacccugugagccuucauuuauggcugccacggauuacacacauagacaccaucuaaggaaagugggguugccugggagaggauugccucagccuucuuccaaggagcacacuccugggcauguuguuucaguuguaaaugacaucucacaauucacaaauccuuugccagcuguaagaacucuauacagcuguuggacuguagcuuuauuuucauuaugucuugguauuucugugggagggcagaggaggaugagcagauuacucauuuuaacagaacuggaagcuaagggagugauuuauaacugcaucuagaaaacagacuuucaaggcacuguucuauguaacauauugcuuuuuucccucuaagaaaauagagcucuucuguauuugugaagauuucauacuggagauaagguccaguaaauaaauuuuuccccccgggauacuuggggauggaaagacguggaugcuuggauauaugcugggcuuauuuauguauguggguauuuagggaaguaugaaccugauuugacugagcuaaggggaaaggauuuguucaugccagguuguagugguguugggaauccagagaagcagagaccacacgugcaugcacacauguauacagaguauuguguuggcugcagaaauccuuuauuauguggggugguuuuucaucuagcuucucuuugcuugugcucaaauaauuuuuaucggccaggcgugguggcucauugccuguaaucccggcacuuugggaggccgaggcggguggaucaccugaagucuggaguucaagacuagcccagccaacauggcaaaaccccgucuauaccaaaaauacaaaaauuaguugggcaugguggcacgcugcgugccuguaaucccagcuacucuggaggcugaggcaggagaaucacuugaacccaggaggcagagguugcagugagccgagauugcgccauugcacuccagccugggugacagagugagacuccgucucaaaaaaaaaaaaaaaaaaaaaaaagaauguuuaucaagguuuaauucucuuaagcguuguaauuaauaaguuucauuuuuaucuuauuggcaggguaacaaggauuaccaucuacagacaugcugugggagucuggcuuaugcagcaccugaguuaauacaaggcaaaucauaucuuggaucagagguaauuauucauugauuaauucauuauauaaucagcagacauuuauauuggucaccuguagugagucaggcacugugcguuggggguauaaugaugaaguaagaaauaaucuuguuaaucagaguucagucuauuuggagagugagacaugauuacuuauaaaugaaauuaauaacuugcaauaaauauaguaacauauacuuaugaagcagggauauuucugguguccuuguuguggcugcuuuuguauuaaauagugccauaguuuggacugguuagucuagcuggauagaacaaaagacgaagguuccaggcucaguuucagagaugcugguuagcacagagaaaaccugugcuucguccauccagagcugacucuccaaggccagcagcccuguguaggaguccaggcugagaaggagugggauuugccugauuuauauuugcuguaucucaaauuaucaaauuagcuccucucauucucuggaguacuaguuuugcugaugugagugucauaagauuaaaaaaacacuuuaguugugaaaagcucaggaagugcucaaacagguuuccuauuucaggacauguccaaaucuuuuuuuguuuuguuuuguuuuuuuuuuuugagacggagucucacucugucacccaggcuggagugcaguggcgcgaucuuggcucacugcaaccuccaccuccuggguucaagcgauucuccuucagccucccaaguagcugggauuacaggcaacugccaucacguuuggcuaauuuuuguguuuuuaguagagacggguuucaccauguuggccaggcugguuucaaacuccugaccucaaaugauucacccaccucagccucccaauuauaggcaugagccacugcgcccagccuccaaaucuuucuuuucuuuuggagauggagucucacucuguugcccaggcuggagugcaguggcacaaucuccgcucacuacaagcucugccuccuggguucacgccauucuccugccucagccucccgaguagcugggacuacacgcguccgccaccacgccuggcuacuuuuuuuuguauuuuuaguagagaugggguuucaccauguuagccaggauggucucgaucugcugaccucgugauccgccugccucggccucccaaagugcugggauuacaggagugagccaccgugcccggcucuggccuccaaaucuuuaaugugcucuuguacagugugauccuucaggaaaggaacaucacagauaacagcugguucugauuuuauuugccuaugggauccacuuuugauggagagcaucuuuuggaacuagcauaaggaacuuugggaauaccagguuacuucauaaaaugagaagaugggaacuguuuccggugacuuuuuauuuugauauaaucucuaacuuacaagauagugcaagaauagaaugaggaacuuugguauaucuuuuacucaaauucacaguuauuuacauuuuuccuuauuugcuuuaucauucucuauguuuauauauaugcauguuuuuuuuugaaucauuugagaguuagcuagaaauaucauauccuuuuauuacucaauauuucuauauauauuuuuccuaaaagcaaagaccuuuucuuuuauaaccacacuuuaguaucaaaauuuaacauugauacaauuuauuuaauucauaauucauauucaaaugguauuaauuguaccaauaauguccuuuauaguuuuauuuuccccccagucuaggauauggugcaggaugcauuuaguuauugcauuuaguuauugugucucuuuagucccuuuuaaucuggaagacuuccuuaggcuuucuuuauuuuuuuugaucucagcauuuuugaagaagccaguuauuuaguagaauguacaucaauuugaauuuauuuaauguuucuuuaugauuagauucagguuauguauuuuuggcagaaauaccacaaaaaugauguuguagccuucuuagugcauuauaggaaagggaccaaauguuuucugaacguuuaucauaguccuggaaucaugcuggauacuuuuuauuuuuaauugugguaaaauacacauaacauaaaauuuaccaucuuaacuguuuuaaaauguauaguuuaguaguacugaaauacaaucacauuguugugcaaccgaccuccagggcucuuuuaauuuugcaaaacugaaacuuuauaccuguuaaacaauucuucauuucugccuacccuauuccccuggcaacuacccuucugccuucugucucuaugaauuugacuaaucuaggaacuucauguaaauggaaucauacaauauuugucuuuuugugacugguuauuucacuuagcauaauguccucaagguucaugcauguuguagcauguaucagaauuuccuuucuuuauaaggcugaauaauauuccauuguauguauauaccacauuuuguuuauucauucauccauugguagauacuuaaauugcuuccaccuuuuggcaccugugaauaauguugauaggaauaugaguguacaaguaucucuuucagauccugcuuucaauucuuuuggguauauauucagaagcggaguugcuggaucauauuguaauucuauuuuuaauauuuuguggaaucuccauacuguuuuccauagugagugcaccaucuuacauuuucaccaacaguguacaggaguuucacaugggcugggcgcgguggcucaugccuguaaucccagcacuuugggagacugaggugggcggaucaugagguuaggaguuugagaccagccuggccaacaugaugaaucccugucucuauuaaaaauauaaaaauuagcuaggcauggugaugcgcaccuguaaucccagcuacuuggggguugaggcaggagaaucgcuugaaccugggaggcagagguuguagugagccgagauuguaucauugcacuccagccugggugacagagcaagacugucucaaaaaaaaaaaaaaaaaaaaagaguuucacaugcuggauaccuuuaauaauuuucaauuaagcucuacagacuuuuuuuuuuuuuuuuugagauggaguuuugcucuuguugaccaggcuggagugcaauggcaugaucuuggcucaccgcaaccucagccuccuggguucaagcgauucuccugccucagccuccagaguagcugggauuacaggcaugugccaccaugcuuggcuaauuuuguauuuuuaguagagacaggauuucuccauguuggucaggcuggucucuaacucccgaccccaggugauccgucugccuuggccuaccaaaguguugggauuacaggcaugagccaccacgccuggccacagacauccuuuuuagugaauacuguuacccuaucccauaagauaaagaagaugaagaaacugaggcucagaaauuuggugccuuugcagggucacacagcuggugacugagugagauuugaguggagugagguacuguuuccacuauuccauuuaguuucccagaaggagugauaaucguaugccugaucucacaagauuccuagaggugaugagaaucugcugauuugaguguaucuggguuuuuccuauguaauuuuaaauuguuuucuuguccguguuaguucaacuuccuguccuucucagagugucuaaaggauaguggacugaggagucauuugagauacuuacuaaaugaugcagagcucagggugguaacucccucagagauuuugguuucguuuucugagauggggcuuuaagaaucuucauuuaaaauacuaauaaaauaguugauucugauguucacaguccugaucaugcuuuaaggacauguuccauuguaaauaucucuaauuucuucaguaauuuuucaugggaaaugguuucaguucucucuuccucccaauuauuuuaucuuuuuuuuuuuugagacagggugucacucugucucccaggcugaagugcaguggcaugacuauggcucacgguagccuuuaccuccuagacucaagcaguccucccaccucagccucccaaguagcugggacuacaggugugcacuaccacaccuggcuaauuuuuaaaauuucuuuguagagauagggucuugcuauguuucuggggcuggucuugaacuccugggccuaagugauccucccgccuuggccucccaaagugcugggagccaguuauuuuuucaugucaacugguaguuuauggauuuacuugcauuugcuuugguuuuuuuaugauuuuaguuaauuuauucucauauucaauucaaaacagcgaaguaaagguacuuucaguuaacugaaaaaugcuuuuucugcuuucuuuuuucuaauaaguguugguagcacuauggggauguuauuaucauuuuaucccucuuuaaguuuaacccuagacauaaucuuucuguugacuucuuguguguuuuuuuguuuguuuguuuguuuuuugagacggaguuucgcucuuguugcccaggcuggagugcaauggugugaucuuggcucacugcaaccucugccucccgaguucaagcgauucuccugccucagccucccgaauugcuggaauuacaggcauguaccacccugccuggcaaauuuuguauuuuuaguagagacgggguuucuccauguuggucaggcuggucuugaacucccaaccucaggugaucugcccaccucggcuucccaaaguguuaggauuauggguguaagccaccgcgcccgggcuuuuuuuuuuuuuuuuuuuuuuuuuuugagacaaagucucgcucuugucccccaggcuggagugcgauggugcaaucucggcucacugcaaccucugccucccggguucaggcgauucucauuggguucaggcgauucucauuccucagccuuccaaguagcuuggauuacaggcacaugccaccaugcccugcuaauuuuuauauuuuuaguagagacaggguuugacucaacccuggugggauugagugggaguggaaggacugcuugaguccaacaggaccauauuggccaggcuggucucgaacuccugaccucagcugauccgcccaccuuggccucccaaagugcugggauuacaggcgugagccaccaugccugacccuuuuuuuugagacagggucucacucugucacucaggcuggagugcaauggcgugaucuuggcucacugcaaccuccaccucccgaguucaagcgauucuccugccucagccucccgaauugcuggaauuauaggcauguaccacgccgccuggcaaauuuuguauuuuuaguagagacgggguuucuccauguuggucaggcuggucuugaacucccaaccucaggugaucugcccgccuuggcuuccuaaaguguuaggauuaugggugugagccacugcgcccagccauuauuuauuuauuuauuuuuuugagacgaagucuugcucuugucccccaggcuggagugcaauggccuccugaguagcuggaauuacagacaugcaccaccacaccuggcuaauuuuuuuaucuuuuuaguagagacaggguuucaccauguuggcccugcuggucuugaacucccuacuucaggugaucugccuaccuugcuucccaaaguguggauuacaggcaugaaccaccauguaguucacucuuuccugugcaaccucuuugcuuugaauuuuuuuugagauggagucucgcucuguugcccaggcuggagugccauggugugaucucagcucacuucaaccucuaccucccggguucaagcaauucuccugccucagccucccauguagcugguaucacagguguccacuaccacacccggccaaauuuuguauuuuuaguagagauggaguuuuaccauguugaccaggcuggucuugaacuccugaccucaggugggagguggcugguuuuggccucccaaagugcugggauuauaggugugagccacugcaccugaucugcuuugaauuuaauaccaugaaugagugucauaccaucaugucucaauuuauagauuaaauauuugacaucucggaggcguaaauggucaauuucugaccuccugcaacuuggaagaguaaucaaguguuugcuucaaagcaaauuguucacuugagacgucauaguagaguccuaauaauuugauaugauuugguagacaggacuagggguuagauuuggcuuaucuaguauaaguacuacccagauaugugaugcugcucaaguuauuuuaacuguuuucucuuucuuuucuuucuuuguuuucuuccuuccuuuccuucuuuccucuuuuucuuuuuuugcucuuaaaacuugccuaagccugggaggcaaauguugcagugagcugagauugugccacugcaccccagccuaggcaacagagugagacccugucucuaaaaaaaaaaaaaaaaaauuuccuaaggcucaaaugagaguaagagcugugacuucuccucagcuaaugguggcaucauuacugacuaaggccaaauacugcuugaacaaauaguuacugcuuaggacucaugggacacauggauaucacauauaaagguuaagcucuuuucugggauuuugagauuuguaggacuauuugugcugguaggcuaauuucuagugucucucucucucucuauguauauauacauauauauuugagguuuguaggacuauuugugcugguaggcuaauuucuagucuauauguauauauaauauauacauauguauagguguguauauaauauauacauauguauagguguguauauaauauauacauauguauagguguguauauaauauauacauauguauagguguguauauaauauauacauauguauagguguguguauauauauacauauguauagguguguauauaauauauacauauguauagguguguauauauauacauauguauagguguguauauaauaaauacauauguauagguguguauauaauauauaauauauacauauguauagguguguauauaauauauaauauauacauauguauagguguguauauaauauauacauauguauagguguauauauggacauauauguauauauggacacauauguauauguauauauggacauauauauguauacauguaugcauauauguauauauggacaugcaugcauauauauguacauauauacauauauaauauauauaauaaauaaucuauauaauauauauaaauaaaugauauauauuuuuagauggaguuucacugugucgcccaggcuggaguacaguggcgugaucucggcucacugcaaccuccgacucuuggauucaagcgauucuccugccucagccuuccgaguagcugggacugugggcaugcgccaccaugcccggcuaauuuuuguaguuuuaggagagacgggguuucaccauguuggccaggcuagucucaaacuccugaccucaggugauccacccgucuuggccucccaaagugcugggauuacaggcaugagccaccaggcccggccaccucuacauuugaaaagucaaucauugaacuuuauuaaaguucucuacauagaauuuuauaguacaacuuagucauacuugcugauuaucaauaaauuuuaagacauccucaugccuguuuacauaaucuucauauguaaccuaaaccuucaguagcacuguagaauugucucaucuucuuaucauguccaauccagcccagccuacuggaaauuauuuucuguuaaguguuagaguccagcuggaggagagugcauuaaauuggaagucaggaggucuuccuggguggccuccaauugacugggugacuuuaggcaagccuccuuagcuucagguucucugacuauagaauaagcagguugaaaugguugauaucugaguucuuuuuuagcuuugcgacaauucugugauuggaucaagaguccuaccauucugaaauauguuugaauuuuuguuucaguaauuuuucuuuuucccucuuucucucaggcagauguuuggagcaugggcauacuguuauauguucuuauguguggauuucuaccauuugaugaugauaauguaauggcuuuauacaagaagauuauggugaguauuacaaggcauagaauuucaauguagaacuuuucuauaccgaauaguauaugcuuucauucauaaauguacaaaaacaggcauaaaaguuauucucugcuguuagaagucaaaaucuuaguuauucuuugggagugguuaaggagugggcuucuguucuguuucuuaaucugggaguuggcuacacuuguauacaguaguuuccccuugucagcaguuuugcuuucugcggucuuaguugcccauggucaacugcggucugaaaauuggugaguuuguguaauacaguaagauauuuugagagaaagaggcacauucaggccgggcgcgguggcucacgccuguaaucccagcacuuugggaggcugagacuggcagaucacgaggucaggagaucgagaccauccuggcuaacguggugaaaccccgucucuacuaaaaauacaaaaaauuagccgggcaugguggcgggugccuguagucccagcuacucgggaggcugaggcaggagaauggggugaacccaggagguggagcuugcagagccgagauuacgccacugcacuccagccugggcgacagagcaagacucugucucaaaaaaaaaaaaaaaaaaaaaaaaaaggcacauucacauaacauuuuuaacaguauauuguuauaauuauucuauuuuauuauguuauuguuaaucucuuauucugccuaauguauaaauuaaacuuuaucaaacuuguguauauauauauauauauggaaagaaacauagcacauauaggguucauugcuauccgugguuuccggcauccaugggugucuuggaaaguauuaccugcugauaagggggacuacagcauucaguuuuugaaaacucauugagguguacucuuacguuauacaaacuucuuuuuuuuuuuuggagauggaguuuugcucuuguugcccaggcuagagugcaauggugcgaucuuggcucaccgcaaccucugcuucccagguucaagcgauucuccugucucagccucccuaguagcugggauuacaggcaugugccaccacgcccggcuaauuuuuuguauuuuuaguagagucgggguuucuccauguuggucaggcuggucucgaacucccgaccucaggugauuugccugccucggccucccaaagugcugggauuacaggcaugagccaccgcacccggcccaauauauaaacuucuauacauauacuucuucaaugaaaagcuuaacaaaauaaaaacagaaugcugugucaaaucacauuuuccuuuugacuuauaaaauaagaaccuccucuuuucuuuuuuuggaagauaaaauuuuggcuucagguuauaauaaaaccacaauugagaucaccuacuguaagcuuuguuaaaauccuauauaucagagacagagaguagauaaguuguugcuugggguuagggguggagagugacugccugugaguauggguuuucuuuuugggaugaugaaaacauucuggaauuagaaagaggugaugauuacacaacuuugugaauauacuaaaaucuacacuuuaaaaggguaaauauuaugguaugugaauuauguucaguuaaaaaaucaaaaaaaucacaggaaggaaaauaggaaaauuauuucaaagcaaacuaacaaaagaagacauguaaagaggaagaaagaacaucuuguguuccauagcaaacugaggucagacuagcagagcagcaucucugaaugcuucacucucuuucuucuucuuuuuuuuuuuuuuuuuugagauaaggucuugcugugucacccaggcugaagugcaggagugcgaucauggcucacuguagccuugacccucugggcucaagugguccucccaccucaaccuccccacuagcugggaccacaggcacugcaccacuacauccggcuaauuaaaaaaauuuuuuuguagagauaggaucuucccuauguuacccaggcuggucucaaacuccugugcucaagugauccucccaccucagccuugcaaagugcugagauuacaggugugagcuacugugccuggccuucugaaugcuucuugaauccaauucuguuuaacaaauauuuccugaauuucugcuuuauauaagaugcugaaaggcauagaaaagaucuaugaaacuuuauuauuguccaccagggccugaucucuuguuggagacagguauaagcuaucuaaaaacggcaaagggugaggaaugccauauuauaacagaguguaaaugaaauuaauacaggaguugggguggcucugggagggcaucuuagaggaagugagguuugagcaggucuuuaaaagaaggguggaaguguuucagaaagggaugugggcaagagcauuccugauaguacagguagcaugagcaaaggcauagaagugggagagacguggggaggaaugggcaguuuuuuguagcuggaccauuggaucucuaacaauuagaugaggagacuaccuaaagcaacucucacuucuaggaaguagcauacaguguugaaagugguagacccaguuggcuuguugcccacuccauagaacaccaagucuaaggacacugaguucaaucuucaacuuuuauuugacuuauaguuuuuccuauaucccaccuuggaagauucuuuaaaguugauucccaagcuucagagaauagcuuuggaaagagauggaauugcaauaguuccaacuccuugaagacugaggagcucugauucugcaggaucaaaaagaagcagugugagcgguagcuauuaacaccgcuuuggggacccauguguguccaggcuucuccuugugaaggggagauaaaugaggcagugggcuggaggccggccuccuagagccugcugcuguagccaagacagcuuguuuuccuccugucacuucuugagcuuucuugaacuuugcuggguagcacucguugcuuuggcuucugcaugcugacuguggcagcaguuccugacuccauagagccauaccugacugcauccacaucaggauacaggggagaguaggguuaggaucuuuuuguggcuuuagcuccagucaacagaaguggucuuugggcagcucaguaacauuuauccaguuauacuuuuacaaaauauuagguuggccucuugaauucuucccucuuuuugcuacuuuuuucuguaaaguagggcuguguuuuuuauucugaaauaauuguauucuaguauagguugaguaucccuaaucugaaaauccaaaauuugaaaugcuccaaaauuugacacuuuuugagugcugaguugaugcucaaaggaaaugcuuacuggagcauuucagguuuuggauuuucggauuuggcauauucagucaguaagcguauaaugcacauauuccaaagccugaaaucugaaacacuucuguucccaagcauuuggguaagggauacucggcuuguauuauaagcugcuaggauauuuuacccuauucuuguuuugggaacuccaucccaaagaaauaagcugacagauuucuccaaagugaacuagaauugaaucugcuagcugguguaacacggaauauuacaccuccuagacuucuagaaagacuguggaaacagauaaugguagaauuucacuguuggaaagcaccugggaaaucauguuuucugacccuuguugcuuguuuuauauuuaauccucacuaaaaugucuccugccuuggcuauguccauguacucucucucaggguggggaaaguuagcuaauggauuuaauucuuccuaaccauaguugcacauuagaauugcuuggggugcuuuaaagaguauugguuccacccccagagcaauuaaaucagaauaucauugagguuuuugaaauucagaagcuucagaaucucuacuuucuaucuguggacuuugguaaauuauuuagccucucugugucuuaguuucuuugucuguaaaaauggaugaaauaacacggcauaggguuguugugaagauuaaaugaguuaauccaugaaaagcauuuagaguggugcucaauaaauguagcuauuauuauuauuauuauuauuauuauuauuauuauuuugagauggcgucucgugcuguugcccaggcuagagugcagugguuagauucggcucacugcacccuccaccucccagguucaagcaauucuucugccucagccuuccaaguagcugggacuacaggugggcaccacuaugccuggcuaauuuuuguacuuuuaguagagacgggguuucaccauauuggucaggcuggucuugaacuccucaccucgugaucugcgcuccucugccucccaaagugcugggauuauaggugugagccacugugccuggcugcuauuauuguuuuauuuuuguuuguuuguuuuguuuuuuucugugacagagucucgcucugucacccaggcuggagugcaauggcgcgaucuuagcucauugcaaccuccgccuccucaguucaagcgauucucuugccucagccuccugaguagcugggauuacaaucaugcgccaccgugccuggcuaauuuuuguaguuuuaguagggaagggguuuugccauguuggccaagcuggucucgaacuccugaccucaagugauccaccaccuuggccuuccaaaaugcugggauuacaggcaugagccaccacaucuggcaauuauuuuugagacaaagccuugcucuguugcccaggcuggagugcaguggcgccaucuuggcucacugcaagcucugccuccuggguucaagcaauucuccugccucagccucccaaguagcugggauuacaggcgagugccaccaagcucagcuaauuuuguauguuuaguagagaugagguuucaccauguuggccaggcuggucucgaacugaccucaagugauccuccugccuuggccucccaaagaggcugggauuacaugcauuucuaaaugagauuugccaguauuuuguccaggacuuaaaauuggcucaaaaauuaauguguacuuuuuugggaacuaucuuuguauguuugguuuugguuucaugauuuguauuagccccauaaaguuacauuggggaguauucuuucuuuuacuuuucuuggggagagcuugacaauuuuuuuguggauguuuuguagaaugugcuuggaaguucaacuccaccugugccuucuuuauggaaagauuuuuaacuaacauauaacauuuaacuaacauagaucauaacauuucauuugaagcucucuaguggccucuuucucaucucgaguacaagccaguguuugcccugugugcuguggguuuucccccguguaauguggccucccaucaccucacugcccucauggucuacucccugccucacuugugccacccacauuguccuccuuguuguuucuuuuuuccccuuuuccuggaacacgcuaaggugugccugccucagggcauuuguacuuacccuuucaccugaaaugguuuucucccggagagaugcuuuguucccucccuucuuucaggucucuguucaaauguucucuaaucagaaagacaaccacuuguuuauguguucauuuguuuguucauuuacucauuuauucgaugucauuucaccuuagggaggaguaaaauaguuaccaaacaccuaauaugugccaggcacuuuucuagaugugugggguauaucugugaauaaaacagaugaaagaucccuguccucguggaguuuaucuucuaguaguggggauguagagaaagacaauaagcauaacaaguaaauuuuacuaaaagaugauauguacuuuggaaaagagaaaaaaauugaguaggaugaagaggaaucaggaguacagaugggggaguuguggaggaaagggccaguagguugcaugauuaaauaagguggucaggauaaacuucauggaggcgagauguaaggagacuugagggaugugagagugucaaguggauaucuaggagaaaaauauuuccggcagagggaacagcuagagcaaagacugggagguaggaacaugccugguguugucaagggagggugagagggccagugcagccugaguuuagcaagugaggagggcaguaggaaaggaaaccuugggaacaggagucaagcugcuuugggcuggguaggcucucauaaggacuuuggcauuuuuucuacgugaaauggggagccauuggaggcuuuugaggacaugauuugguuuaguuuuuaacaggaucacacuggcugcuauguggagaugacuguaggaagugaagagaaccagggcaucuggucaggaggauauuguaaugauucagauaagagaugguggcaguggaggugguaaaaaguggguagauacuagaugucuuuuuuuuuuuuuuugagacagagucucgcccugucguccaggcuggagugcaguggugcgucuuggcucacugcaaccuccgccuccuggguucaagugauucuccugccucacccuccugaguagcuaggauuauagguccuugccaccaugcguggcuaaguuuuguaguuuuaguagagaugggguuucgccauguuggccauguuggucuugaacuccugacucaggugauucaccugccucggccucccaaggugcugggauuacaggugugagccacugcuucuggccuggaugucuuuuuuaaaaaauuauuuuuggguuuuuuuuuuuuuuuuuuaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugauuacuugagauuagggauuggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaggaauuuuucuuagugcagaacaaaaugaaaagucucccaugucuucuacuuucuacacagacacagcaaccauccgauuucucaaucuuuuccccaccuuucccgccuuucuauuccacaaagcccccauugucauccuggcccguucucaaugagcuguugggcacaccucccagacggggugguggccgggcagaggggcuccucacuucccaguaggggcggccgggcagaggcgccccucaccucccggacggggcagcuggccgggcgggggggcugaccccccccccaccucccucccggacggggcggcuggccgggcagaggggcuccucacuucccaguaggggcggccgggcagaggcgccccucaccucccggacggggcggcuggccgggcggggggcugacccccccaccucccucccagacggcacggcuggccaggcggggggcugacccccccaccucccucccagacggcacggcuggccaggcggggggcugauccccccaccucccucccggauggggcggcuggccgggcggggggcugacccccccaccucccucccggucggcacggcuggccgggcggggggcugacccccccaccucccucccggacggcacggcuggccaggcggggggcugacccccccaccucccucccggauggggcggcuggccuggcgggggcugacccccccccaccucccucccggacgggguggcugccgggcggagacgcuccucacuucccagaugggguggcugcugggcggagaggcuccucacuucucagacggggugguugccaggcagagggucuccucacuucucagacggggcggccgggcagagacgcuccucaccucccagacggggucucggccgggcagaggcgcuccucacaucccagauggggcggcggggcagaggcgcuccccacaucucagacgaugggcggcugggcagagacgcuccucacuuccuagaugugauggcggcugggaagaggcgcuccucacuuccuagaugggauggcggccgggcggagacgcuccucacuuuccagacugggcagccaggcagaggggcuccucacaucccagacgaugggcagccaggcagagacacuccucacuucccagacgggguggcggccaggcagaggcugcaaucucggcacuuugggaggccaaggcaggcggcugcuccuugcccucgggccccgcggggcccguccgcuccuccagccgcugcuucccgggcggcgcucgccggcgcgguggcaaagaaaaaaauuauuuuuguauuaacaaaauuaaaaguaaaaguagaccuguauauacaaaggguaaaguaaaauugacccuuuguauauacaguaaaauugacccuuuguauauacaggucuaugaauucuaacacauauauagauucauauaaccauugccacagucagaauguagaacagucuggaugucuuuugaaggcauagcuaacaugauuugugcauggauuggaugaggggaguaacccgaguagcuagaaaguuggaaaauuauuaaagguaucuagcaugucaaacucuuuuuuuuuuuuuuuuuuuuaaggcagagccuuacuuugucacccaggcuggagugcaguagugugaucucggcucacugcaaccucuaccucccagguucaagcgauucuucugccucagccuccugaauagcugggauuacaggcucccaccaccgcgccuagcuaauuuuuguaguuuuagcagagaugggguuucaccauguuggacaggcuugucucgaacuccugaccuuaggugaucagccugccucagccucccaaguguugggauuacaggcgugagccaccgcgccuggccauaaaaccuguuuucuuagaggcaaucauugcuaucacguuuaucagauuuuuacguauuuuuuucagacauuagccugcauauguaaggaauuuuauauuuauauauuuucucuuucugcuacccccuucccaguuuuuuuuuuuuuuuuuuuuacacagaugguagcauaccauaaacacuguucugcacuuuguuuuccucccuuagcagugugucuuggaaaucauagcacuucauacccaccucagagccucuucauucuuuuuaugacugcauagaauugcauuguaugcauguaccauaauuuauuuaaccaguccuagguuaauggacauuuaaguaauuuccaaguagucauuuguacauugugaauauaauaaaucuguaagaaaauuucuagaacaguuggugggucaaagauaugugaauuaguaauuuugauagauauugccaaauugcuucccaguaaaguccuauugguuuaugcaacuaccaacaguagcauaauaaugccaguuucuccauacccccccaccaauacaguguaucacuguuuuugauuguuauguuuaagacuuauuuuugcugugcaggaauuuuuaguuuuuauuuagugaaauucaucaaucuuuuucuuuuuuucuuucuuuuuuuuuuuagagacagggucuugcucugucacccaggcuggagugcaguggugcagucauaguucauugcaaccucaauuuccugggcucaagugauccuccagccucagccuccugaguagcuggaacuacaggcgugcgcuaccacacuuggcuaauauuuuuuguagagauaaggucuugcuauauugcugaggcuugucucuggccucaagugauccucccaccuuggccucucaaaauguugggauuauaggcaugagccacugugcccagccugucaauuuuuuauugucauauuuggaagggcuuuuugacuuuauuuuuuaaaauaucuguguuuucuucuaguguuuuuaugguuucacuuuuuaaaaauguuuaaauguuugauucaucuagaauuugcuuuaguauguuuucuugacuuuaaacaucauaaaaaaaacuguagagauuugcuuucacauucuggauucuggauuuuaaagaucuaauuguagaccaggugugguggcucgugccuguagucccagcacuuuggggggcugaguuagggacauggcuugaggccagaaguuugagaccagccugggcaacaucgugagacuccgucucuacaaaaaauaaaaaaaaaauuagcugggcaugguggcauuugucuuuaguccuagcuacucaggagacugaggugggaggauugcuugagccuaggaguucaacgcugcagugagcuaugauugcaccauugcauuccagcccaggccauagacuccaugucuuuaaaaaaaaaaaaagggcccaguggcucacuucuguaaucccagcacuuugggaagcugaggugggcagaucacuugaggccaggaguagccuggccaacauggugaaaccccaucucuacuaaaaauacaagaauuuucuggucgugguggugcaugccuguaaucccagcuacuuuggaggcugaggcaugagaaucauuugaaccugggaggcagagguugcagugagcugagauugcgccacugcacuccagccugggugacagacagaggcuccucaaaaaaaaaaaaaaaagaaaaagaaaauugaaucaugaugucaacguagccauauauacuuaagauuugagguucauuuuuaacaauaguguauauaaguccuuauuuaaaauagucuugcuaauuucaaguuuugcagacaacuuguuaaaucuaauuagguauuuuuuuaacuuuguguuuugguugauauccuaaaaguagaagugucagcuccauuacuguuugcuuguauucauagucuucaaucugugguuucuuugcaagaguuuugagccacuugucuauucaaugaggauuuagcuucauuaaaccguauacuauaaucuguaaauccauguaacugugcuccuguaaagcacugcuuugcaauaccauucuuucuuaagagugucucauaguguagguuauauagggacuagugagcguacuagugccgauccauguacuaaauauuaacaaagcucaauuucuuauuuauuagauagauagaaaauuaauauaaaucuuugaagaccgccagucaagaaugagugaauggucaacucuaaguauuuuuuuuuuuuuuuuugagacggagucuugcucuguuguccaggcuggagugcaguggcacgaucucagcucacugcaaccuccgccucccagguucaagcaauucuccugccucagccucccaaguagcugggauuacaggcguguaccacuacaccuggcuaauuuuuguauuuuuaguagagacaguguuucaccauguuggucaggcuggucuugaacuccugaccucaaaugauucaccugccucagccucucaaaagugcugagauuacaggcaugagccacugugcuggccuaacucuacguauucuuuaggcagucccuugauaaguauaauaccucucagccagguuauugagugucagucaauuagggauuauucuaccuggaaauuacuugaaguuauggguauucugugaugcugaauaagaacaagaggggccaugaguauaacuggggcuaggauuggcauucuucuguaaacauugagccuucuaaccauacuuacuucuugguuaugagauacuaugccauaaaggauaacuagagucauuuuauccagcuaaaauuuugcauauucaccuugaccauaaaaagucucaauaaagauguaugauguguaaaacaaaaugagguauuauguagauuuaaaaaaaaauggaaugauaaaguuuucagugaguuuugaaccccccaaaaauauguagagagugggggagaugccuucugcaggccaggucuaagugucuguagguguccagaaauggaguucuguguuugaguugugcugaaugaaaucucuucugucuagagcaucugcagcagucuuuuggugguuuaauucuuucugcuuuuuucucuacuuccuuguuuccccccuccaaauggauagagcuuucugaaguguguguguugcauaucuuuguggcuauugcacaugguugaucagaaaaaauaaaauguuugcuggcgugcauauucucauccuuuugucacaaaaguaauacuuaacaugcaugaguuuuguuacuuaccaggcugugcucuaaaugaggugguugcuauuauugucuuccucuuacagaugaagaaaugaagggacagagaccuuaaauaacuuauucagggucuuauagcuagugaguagcagagcugggauuugaacccuagcagucaagcuggcagcccauucuuauaaccacaaugaaauauuguuucucagcucuguaguugcuagucaccuaagaaucacagaugccuagaggaagaaggauccccucccaagcaucuuuuuaugcuuauuaauuugggaaauuucccagacaucccaucuuuucugauuuacuaaggcuacaaguuaguucucccaauucauuuagguauuacugugcauaggcuuucccacgcauuuuaggugucaccccgcaaggauacuuacugguccuuguuuccuucaucagcagcauuagagcauugcaguaaucaguuauuuucaagauccauuccagcucugaguagcuauaaguucuuugacuucuguuucuucacauucaauuuuucuuguuucagccuagcauucucuuccuuuuuuuuuuuuuuuuuuugagauggagucucgcucugucucccaggcuggagugcaguggcgugauuauuggcucacugcaaccucugccuccuggguucaagcgauucuccugccucagccuccagaguagcugggacuacaggugcucaccaccacacccagcuaauuuuuguauuuuuaguagagacgggguuucaccauauuggccaggcuggucucgaacuccugaccuugugauccgccugccuuggccuccuaaagugcugggauuacagccaugagccaccgcacccagcugcauucccuucuuuugagauuuugaaucuugauucugcacucauguaguaacagcugucccugccagcauugcaccugccaacauuugcacauuucuuaaauaucccuaaacuaaguuguucauuaaaaaacugaauagaggcugggcgcaguggcucacgccugcaaucccagcacuuugggagacugaggugggcgaaucacgaggucaggagcucgaaaucagccuggccaacacggugaaaccccaucucuacuaaaaauacaaaaaaauuuagccgggcauaguggugcaugccuguaauccuagguacucaggaggcugaagcaggagaauugcuugaaccugggaggcggagguugccaugaggugagaucacgccucugcccuccagucugaaugacagagugagacucugucucagggaaaaaaaaaaaaaaaaaaaaaaaaaaaaaaaaaaaaaaaaaacuugaguagaacagaaccacucccuaaguguuccgaguauugguuuuuaguuuuauucuguuucagcuaugcuuaacuaagauuuuguagacuuacccacaaagauaaguaacuguuauuuuacuuaccuaccacacccagcuaauuuucguuauuauacuucuuuuagaccaagaaacuaaagcacagcaagguuaaauagcuuguauaaggucacacagcuaguaagagguagauccuggauuugaaccuagccaauuuguuuucagagccuuucuuaggaaacagggccagagagacugaauaccuuacccuguuaauaccuuacugaaauggaacuauucauggugauccuaauuuauugacuuaacucuaaccuuugcuauauuuuuaccugucuggaccuuaauccucuaugcuguuuauuugucuucauuuguuguuacugcaaguucacauucauauggcagccauggaauucauacuauuaucaguauauuguuucaucaauaaaaggugaauguaccaacauacaaacuucaguguuuucuacuuuuauuuauuugaaugcacuaguagauccuagauuaauccuuugagggagagagcuuaccuuaaaauaauaaaaaaguauauccuaauaguauaugugagauucaaguucugauauuuuugaaaaaucaaauaucuuugcaguggaaugaauaugguagaaaaugucuaauucuuguucaguggagauuuggccuuccuaauuaauaguauuuacuaauacuuguauauucuuuguuucuccuacucugaauuucauuuuuuaguuuuucauguauuugcaaguugaaaauugauucaaauuaggacuuuuaugcauuauuguggaauuuaauuucacacauuauagauuuugaaauuuauuguaaucuuggcucagaacuauuguuccgagucgcaguguaauacagucugcugguugaaucuaauuaaggugucguaucacuugcaugcaguauguaucuuugccuagaauguucuaaaauuccucacuugggaauaacacuuuccucaguucuugguuugauugaaaaacccagcaauauuugacgcaccguauguaacucuuguuuaaaaggcagacuucguuuaucuuuugcauuuguugacuauuuuaaccaaaaugcucaacugcacuuucuagcaugauuacuaauggcuugaguauuaaucuuauuaauguuaccuauauucauuugucaucacugcauucaaagacaagcacgaguguacuccagcugugguauacaaauauuagggaaguauaaauaauuuagcaauugaaaauugaguaguuugaaaauaaaauugcugccuaacaauuacaauuuauaauuuuaaggaaaaugagcaaguugucucuuuaugaaauuauauuuuuacaauuacggaguuuacuacagcauuaugauuauguauuggugagauggccugccucucuuagaacagugugaaaaacaauuucaagccacuggaauucccaggauuauuuugcuuaguccauagaucuuuucucccucucuucacuuggauucucccacuguuaucuguuucuugcucuccuuugcaaguuaauugucccuuaaauaaacaaacacaaauucuuuaaagaauagcagaaacaaggguccuaucucugaccauuuuuugcucuguaacaguguuucucaacauuaacacuauuggcauuuggaccacauaauucuuuguuguaggggacugucaugcauuguaggauguuuagcagcauccauuaccuuuacccacuaauugcuagggguaaucuccaaguagugacaauucagaauguuuccauacacuaccagauguccccuuguaggacaaaucauccccaguugagcaccagugcccuacaauauugaacaaguacuuaaucucccuggcugacaguugguuucuccauuuguauaaugugguuaauagucccugccuacuacagaggguaaaauauauguacaaguguuuugcgcauuuuaaagcacgguguacaaauaagagauuugguuaagccuggcagcagagcucauuuuuggacucuauuuuggccaguauuucagcacagagaaugaaguugagaaugucaggacaugguaaugagucacaggccuuaugacccacuuguggaugauacucuacagagguguucugcccaaauaggggaauuggauggggacauugcaggaggugaugugaacagggcuugccuagacgauguguaccuuaccagacaauccugagauucugagauagcugcaguggggcagugcuccauugggaaggccuaugacauuccucagaaugccuuuagccuuucuugcugcacugaguauuuagcacuuuuggauacaaggcuuuuggccaauguguccaucucuggcccucaaaaaaggaauacuacuuuuugaauauuccuaucuccuguuuauuucagauucaauacauauuuauugucucuuacaugcaaggcaguaugccgagugcuuucacauauauucuguugguuuauaauccuguaaguggcauuaguuguaucgcagauaauaauaaugguaguaauaguaucagcagcagcagucgaagcuaacauuuaucaagcucuuacuguguccaugguacugugcuaaaugcuuuauguauacuaaaucauugaacccuagcaaaauuucuaugcaguagguaucguuauuauacuucuuuuuuuuuuuuuuuuuugagauggagucucgcucugucgcccaggcuggagugcaguggcgugaucucggcucacuguaaccuccaccuuccggguucaagugauucuucugccuuagccucccaaguagcugagacuacaggcacgugccaccacacccagcuaauuuuuguuguuauacuucuuuuuuuagaugaagaaaguaaagcacagcaaggcuaaauagcuuguauaaggucauacagcuaguaagagguagauccuggauuugaaccuagccaauuuguuuucagagccuuucuuaggaaacagggccagagagauugaauaacucuuacaagcccauggagccaguaagaggcggaacugggauucaaauauaauauaugacuccaauccauuccuguuccaaugugccaaacaccacacuucucauucacuuguuuucucugcuucuuucuggauaggauugcuuccauggugccagcuuauagcaaagcacaggggaaucuauuaaaagauacuuuaagaauucaaaauagguugauaaaaaggggugauaaaaaggcaaagaggaauuuggaaucaguaugguagagcucucuuuauuuaguacuuuggucugaguauuuauuuuuacauuugguuucuguggaguacuccuacuuuuaguuaagaguacuuuucagaauugaaaggcauaaugucuccuauuaugauaguuucagaauuuaaaggcauaaugucuuuuuuauuaugauagaucugguuaugggccuguuauuuguguguuggagcagaccagaaagggcugaaaccuggaaucagacuuguccuugagguggacagaugcugguaugggggaggugaugugaagcagcuaaacccucauagauaguguaugaguuuccuaggguuguuguaacaaaauacuggagagugauggguuaaaacaacagaaauccauucuugugcaguuggagggauacuguucaacccaguacagauaguguccagagaguaagcagcaaacggcuuugcaaacagcagagggaagaccacccagaguacagggaaugaagcugauagaggacacucuaggagcaggcugugaucagagacucaggcagcucacggccuuuugaucagcacauaggaagcucuuuguuccaagcugaucuccacucucuaugggacccuggcaagagcaagcugaaauauuugagaccgggcaaauaagcaguuugccaagaaagagaacaaggcaaguccucaggacugggaucacgaaaagccugggucucaggaauaaaguaaagcucagauacgagaguggggccaaguaggucagggccagucaugcagcaacugugacucacuacugcugagucccagagaguuggcuagagcaucuaaaaccccuccuucccagggauaggcauggagcccaggcagcagugagccuucagauugggguccaguuggcuguagaugaagcgugguaggggagaaauaaauucaaggcuucauugcuguaguucaaaaacaaacuuugagccagcuagguggcucaugccuguaauuccagcacuuugggaggcugaggcggguggaucaccugaggccaggaguucaagaccagccuggccaacaugaugagacccugucucuacuaaaaaugcaaaaauuagccagucaugguggugcaugucuguaaucccagcuacucaguaggcugaggcagaagaauggcuugaacccuggaggcagagguugcagugagcgaagauugugccgugagacuucaucucaaaaaaaaaaagaaaaaauuaugaaggguuacauucaucgcagaauuguuuaugauauaauuaggaauuggucuaugacaaacuccagagggccuccaaaaugaaugaaagacaaaaugcacugaauaaggguucuagguuagaaauauaagugcaaguguggcaggccaggucucacuaaugcaggccuccauuacaacugucccagcacugacugaguggcuagguuauacacuaaaagcugauugagccagugcccuuauaccaaggcuggaauguaacaaagagcccaccaagaguuuugccuaggcuuuuccagggccuugaagcaugacaagauaacgaaggaauucuucucaggacccuuuuaggaugaaacaaauuuuuugggggucugaagaaagcacaaacaauuucuuuggagucuaaaggaacuccccaaaccuuuaugauuuagcaggauacaagauaaggguaaucacccuagcaccuagacccauuuagauuaaguaaacuuacugaggcuccagaaggucuucgggacucagaccuuaguuauagcuuaaaagaaguuagucacuuacguuuuuagauaaaugcacacuuacacguagacauauagcuuagaagguguauaggcucuggagaacuuuguaauuuugaguuggucuggugauaauuuccaggccuuuucccuguggcugguuacagaaauaaaaacucuuccuccccaguucaucuauaucuuguuauugggccucaagaaauagcagcccaagaggccgggcaugguggcucacggcuguaaucccagcacuuugggaggcugaggcgggcggaucaccugaggucaguaguucgagaucagccugaccaacauggugaaacccuaucucuacuaaaaauacaaaaaauuagcugggggugguggcaggcacccguaaucccagcuacucugcaggcugaggcaggagaauugcuugaacccgggaggcagaggcugcagugagccaagaucacucauugcauuccagccugggcaacaagagugaaacuccaucucaagaagaaaaaaaaaaaaaaaaagaaaagaaguagcagccugacccucaguuuagucugggaacacaaagaagacaaggacaagcacaagcgcaaacacacacacacacacacacacacacacacacacacgccaacuguaaaugaaugcggcuagaaggauggaggcagauaggugaggaagccauugacuuguaccagcauugggguucucuguucuuaugaacugucuaggauauaauucuuacagaaucaguccaccuuaaaggugaaguggaaaacagacagguauggaucacucagaguccuaagauguuauggcaggcuggcuuucaauuauguuaaagaaguaaugaaagucccagagaagcauugucaaacaaugaaucuaaaaagaaagggucaaaaaucagccucucugaugagaguagauggacugaccuacaaguguuuccuaggaagaacaguagcuuucauuuuacaaaugacuuuuaauauuauuacauuuuuauucccuuuaucgaaagcacucaguauuacccagagaacccauucucucucucucucuuuuuuuuuuuuuuuuuggagacaagaguuuugcucuuguugcccaggcuggagugcaauggcgcgaucucggcucacugcaaccucugccucucugguuccagugauucuccugccucagccuccugaguagcugggaauuauaagugcccgccaccacaccuggcuaauuuuguauuuuuaguagagacgggguuucuccacauuggucaggcuggucucaaacuuccgaccucaggugauccgcccaucucagccucccaaagugcugggauuacaggcgugagccacugugcccagccugagagcccauucuuauuuaucccuugccagggcaccuuaacacuugccagagacagaaacugacaaagucuuuuuuguuuguuuuguuuuugagacggaguuucacucuuguugcccaggcuggaguacuauggcacaaucuuggcucacugcaaccuccaccucccggguucaagugauuuuucugccucagccuccugaguaggugggauuacagacaugcgccaccacgccuggcuaauauuuuguauuuaguagagacgggguuucaccauguuggucaggcuggucucaaacuccugaccucggccuuccaaagugcugggauuacaggcaugagccacugugccuggcucagaguuuguuuuugaauuguagcaaugaagccuugaauuuauuucucccuaccaagccucauguauggccaacuggaccccaaccugaaggcucacugcugccugggcuccaugccuaucccugggaaggagggguuuuagauacucuagccagcucucugggagucagcaguagucagugacaguugccugugaccuuuggaaaaggcuuuuucucaauuuguuguuaacuuuguuaaugaauuuuuuuuuuuugagacggaaucuugcuguauuggcaggcuggagugcaguggcguaaucucagcucacugcgaccuccaccucccggauucaagcaauucuccugccucagccucccgaguagcugggacuacaggugcgugccaccacgcccggcuaauuuuuguauuuuuaguagagacgggguuucaccauguuggccaggauggucuugaucucuugaccucgugauccaccugccucagccucccaaagugcugggauuacaggcgugagccaccacauccggccaaugauguuuuguuauacagaaauaucaaacguuaauuuugucauauauuacucuuuauaguuguuggcuuugcugucaugucuagaaagauucuaaaaauaaucacucauacuuucuuuaaguacucuuaugguuuuguauuuucuuuuuuuuuuuuuuuuuugagacggagucucguucugucgcccaggcuagagugcugcagugacacgaucugggcucaccgcaaccuccgccuccugaguucaagcaguucuccugccucagccucccuaguaggugggacuacaggugcccgccaccaugcccagcuaauuuuuguauuuuuaguagaaacaagguuucccugugucagccaggauggucuugaacuccugaccucgugauccaccugccuuggccucccaaagugcugggauuacaggugugagccaccacgcccagccugguuuuguauuuucauuuaaucuggguggaauuaauuuugguauguucuaugaauuacaguucaaucaauuucucucaaauaauuaaccuguuaucuuagcaucauuaaacaaugugauuucugcugugagaaacuguuguauugcuuccucugaauugggaaagaggaugugugugguaaguguguaaagagauauucuaucauguauuagcauuuagccaagucccugaucuuuucuuugaugacuugguggccauaauuucugaguauacuagguuguauacauuugccuucuuagucucuuuuaguccuaaaagagguauuuaccuuagaaaguggcuuucacuaguuuuccucaaagauugugaauucuguuuuguggaugaccuguuuuuaaccauagccuauguacugucaccaaauaugcuuuucugcugcuucauuuugucaacugauaauugcucugaaauuauaaacuaauaauuguuucagcaguauaaaaauagacuacaguguauacuuacuguccauuuaauacuacagauuccaaagcuguaugacauuuuuguuuucuacuguuauguucuuugugcucuagcccuucucugauauguggauaauuuagaggcaaugauaguauuuaauaugcccgauuuuuucuuuaaggcaagaaauuguuuuuuuuuuuuuuuuuuugugauggagucucgcucugucacccagguuggagugcaguggcacgaucucggcucacugcaaccuccgucuccuggguucaagugauucuccugccucagccuccugaguagcugggauuacaggugccugccaccacgacugacuaauuuuuguauuuuuaguagagacaguguuucaccacguuggccaggcuggucuugaacuccugaucucaggugaucugcccgcuuugaccucccaaagugcugggacuucaggugugagccaccacgcccagccaagaaauugauuuuuuuuaguuaauaauguuuaccaaguauuguaguugggugaagucuucaagcuuaaaaguaaaccuccagcauguuauuaccuaaggaauuugugucaaggcugauugaaccugaaucucuuaaaugcuuuguuuuuguagagaggaaaauaugauguucccaaguggcucucucccaguagcauucugcuucuucaacaaaugcugcagguaaacuuuauuuuuaaauaauagaagucuauuguaauuguuugguucaacuuuuaagauaucuguggugcuacaucauuuccuauuagcuugaaaaaaaucccacucauaucuaccuugaaaauauccucuauuagauccuuucuuaauuauguuguaaaccuaguuuauuuuagacaccuaccauauguuauagcugguaugguuuuucuuacuuugcgaauuuucuguuuucucuaacuaguucuuguuccacucucuuuuauuccaaaauuauugauugauugauugauugauggagauagagucucacuccuuagaagacccucagguuggagugcaguggcgugaucuuggcucacugcaaccuucgccuucuggguucaagugcuuuuucugcuucugccuuccgaguaggugggauuacaggugugaaccaccaugccuggcuaauuuuuguauuuuuaguagagacagaguuuucccauguuggccaggcuggucucgaacuccugaccucaagguaucugccugccucagccuuccaaagugcugggauuauaggcgugagccucuacaccuggccccagcucuuuuuuuuuuuuuuuuuuauuuagauggagucucccucuguugcccaggcuggagugcaguggcgugaucuuggcucacugcaaccuuugccucccagguucaaguaauucuccugccucagccuccugaguagcuaguacuacaggcgugugccacuaugccuggcuaguuuuuguauuuuuaguagagacgagguuucacuauguuagccaggcuggucucgaacuccugaccucacguuuucugccugccucgaccucucaaaauccaaagugcugggauuacaggugugagccacuggcuuuuguuuuuuugagacagaguuuugcuuuguugcucaggcuggagugcaacggugcgaucuuggcucaccacaaccuccgcuuccuggguucccagguucaagugguucucgugccucagccucccaaguagcugggauuacaggcaugugccaccauuccuggccaauuuuuguacuuuuaguagagaugggguuucaccauguuguccaggcuggucuugaacuucugaccucaggugauccacccgccuuggccucccaaaguacugggauuacaggugugagccaccgcacccagccuggccucuuuuuuuaaaaaaaaauuuuauagacaggguuuuacucugucgcccaggcuggagugcagucauaugaucuuggcccacuacagccuugacccccaggcucaaguguuaguucuacuucagccucccaaguaacugggaccacugguauacaccaccacaccugacuaauuuuuuguguucuuucuuuaguuuucuuuuuuuuuugguuguuuuuaaauuuuauuuaucacuucauuccuuauaauuacuuucagcaaacuguauuuuuuguagagaugggguuucgcuacguugcccaggcugguuucgaacuccugagcucaagcguucugccugucuugaucucccaaagugcugggauuacagguaugagccacggcaucccgccuuuucccaacucuugcucauuaaguauguuaguagauacugaauaaauacuugaaugaguugauguacuauugaaugggcccuguuaccuagugcagugguucucaaacuucagcagauaucaaaauuaccccgggcuuguuaaaauacagauugcuggccuccagccccagaguguguaauucaauagaucugaggcaggacugaaauuuugcauuucuaacaagcucccagaagaugcugaugcugcaggucuuggggccacacuuugagaaccacagauuuauuggaaugagccucugagggugaaagauaggagugcugaagccuagguaagcacucuaccaauuaaucaauguaucaccuaaucugaucuauaaaauggggguucugagccuggccucacugcuauguaguguuauaaggacaaaaugagauugauaggaaacacuuugaaaauaugaguaucuucuuagugcaauuuuuuuuucauuauguauucagaauaucuucugguuuuuucaucuauuaagucaucuccaucuuuuauucaaaauuuaccucaggcucacucaccuugauuaaguagggccagaccaccaaaucuccguaaugagauugaaaaugccuuacucuuucuucuagacuccaaaauaacguuaaucuuuguugauuaauuuuucucuccuuacauuugaaaauuacaaauggaaaggugugcuuuucaacuuguucugugugauuguaagcucauuggagguagagauugcauauucaguaugaaugcccugcauuguggcugcuugaauguuuaauuggugaauauuucccgugaauagguuuuccagcaaaagacuauuacaucauacaauagauugaacuucacgaauaauguccauaccaaugaaguucauguuuguuaaacauuuaucuucuaagccuguguugguugcuauaguuuucuugccucuguugccuuuuuaaaagaauuucuuccaaggccauuuuaaagucuuugacagcauuuuugugaugauaaaguuuacaucuguucugaugcauuuuuaguuuucaggaggaaagguguucuauguucucuauuugaaauguuaaucucuagcuacuuuuuaauggccacuagguggacccaaagaaacggauuucuaugaaaaaucuauugaaccaucccuggaucaugcaagauuacaacuauccuguugaguggcaaagcaagaauccuguaaguaaaaugaaauccaguagaauuuuuuuuugacuuuguguggucuuugggugaauucagaaccuacaaugauguggucuaaauauacaagaaaauauauuaaucagauugguguuugggagacuuguaaccuaauggacagugguuccuuaaccccaucugcaaaugagaauuaccugggaccuuaaaaagaaaugccugcuccccaucccagaacacuuaaugggaguuuuuaaaagcucccagguguuucucaugugcagucagucacagugcucugggaaucuuggacaaguuacuuaacuuugcagaaccuauuuauucaucuguaaaaaguagguuaaaccaguucuacuucccagagaaguuaugaggguacaguaguucucaaacuuuuuaguuugaggaucccuuuauacucuuaauauuuauuuauucauuaaaaacuaauaugauaaaacuauugcauauuaacacaaauauuuuuaugaagaauaaccauuuacaaaauaaauuuagcaaaaagaaugacauuguuuuacaacuuugcaaauuucuuuaaagucuggcuuaauagaagacaccuguauagccaccugcuucuguguucagucuguuuugauagguuguuuugauugaagccaaggaauaaaaugcagccucacacagauaugcaauaggaaaaggaagaaaaauucuaauagccauucagacaguuucugauagcccauuaaaacuugacaaaugguaguuucuuaaaggguaauugcauguggaaucugaagccauaucaaugaaauuuuguacuguauuccauaaaauccauuguucuguccauuggaucuuuuccucacauaacaugaugcauugguuauuuggaaaacacugguuugcugaguuaugcaaaucuuccaaacguuaacacauuucguuauacaacauuaaaucacauuccuuaaaaucacuacugaucucaguagaaaagucuuuaacuauuggaaagcacucaagaucaugguggcaaauaaaaguuuucuaaauucuaauuuuugcuuaaaagcuaaaauucuaucauugacaacaaauaugucauucuccuugaacugacaaauucccuugguucauuuuugagaaaaugucugcugaacauuuaagucuaaauaacuauaguuaguccguguucuuucucaucaaaaugguguucuuugaaaaaaauggcuaauuaggccaggcacgguggcucacaccuguaaucccagcacuuugggaggcugaggcaggcguauuacuugaggucaggaguuccagaccagccuggccaacaugguaaaaccccaucuuuacuaaaaaugcaaaaaauuagcuggcaugguagugccuauaaucccagguucucaggaggcugaggcagaagaauugcuugaacucgggaggcagagguugcagugagcuaagagcgccaccgcacuccagccuugggugacagagcgagacucuguuucaaaaagaaaagaggcugggugcaguggcucacaucuguaaucccagcacuuugggaucccaggcggguagauuaugaggucaggaguucgagaccagccugaccaauauggugaaacucugucucuacuaaaaauacaaaaauuagcugggcgugguggcacacaccuguaaucccagcuacucaggaggcugaggcaggagaauagcuugaacccgggaggagagugagacuccaucucaaaagaaaaagaaaaagaaaaaaauggcuaauugagcucauaauucagucauacaggugcuuuuccucgagacagcuaucaaacuuugguauuguagaaguacauuaugcuacuuccuauuuagucacacagaguauuaaaaacguacucagaaauguaauaaaauuaauauauuuuacugguuuaucaaggaaauucuuaauugaaacuggcuucuuuucgaacuauggguauaugacaaagaauacaauauuuuaguacaguuuggugccacugcauugauucauacuaaggugccagcaauuuauuuauuuaauuuuaauuuuuuuuuuuuugagugggaaucucgcuauuaucgcccagacgggagugcaauggcacgaucuuggcugacuacaaccuccgccucccaguuucaagcaauucuccugccucagccacccgauuaguugggauuacagccgccugcuacaacguuuggcuaauuuuuguauuuuuaguagagaugggauuucaccauguuggccaggcuggucuugaacuccugaccucaggugguccgccugccuuggccucccaaaaugcugagauuacaggcaugagccacugcaccuagcugccagcaauuuuaucacugcauuuguaccauccauacaaaugucaacacuuugaaaaaugaaaaauaauauuauuauaaaaauaguuugaccuuggagacucucaggcaucugcagaccgugcuuugagaacuggucuaauaugcguauauguaaaaaaacauaaacaacaccaaguguuauuuaaguuuaaacaauuuaaaaaauacuauuucuacauuguuuuuaaaaaaugcuuuuuuuuuuuuuuuugagauggagucucgcucugaugcccaggcuggagugcaauggcgcagucucagcucaccacaaccuccgccuccuggguucaagugauucucuugccucagacucccgaguagcugggacuacaggcaugugccaccaugccuggcuaauuuuuauauuuuuaguagagacgggguuucacuguguuggccaggcuggucuugaacuccugaccugccugcccuggccucucaaagugcugggauuacaggcgugagccacugugccuggccuuaaaaaugcuuuuuuucaaacaaauggccacuugguaaaaauguggauauuacuauaggacuuggauauuuuguguauuaguuauugcugcauuaaaaacuacccugaaauuuaguggcuuaaaacaauaauuuggcugggcacgguggcucacgccuguaauccuagcacuuugggaggccgaggcagguggaucaccugagguugggaguuugagaccagccugaccaacauggagaaacccguuucuaguaaaaauacaaaaucagcugggcgugguggugcaugccuguaaucccaacuacucgggaggcugaggcaggagaaucacuugaaccugggaggcggagguugcagugagccaagauugcgccauugcacuccagccugggcaacaugagcgaaacuccgccucaaaaaauaaauuaauuaaaaaaaaacaguaauaauuuacaguucuguggaccagauauuugggcuggguucagcugggcuguucuuauguaggccuuaccuggggucguggcuacagucaucuuguaacugggcugaaugguccaagccucacuagaaagacuggcuguuuccugggccacauguguccaucaggcuaaccuggacuuuuuuauguagcaacuggauuucuuucuuucuuucuuucuuucuuucuuucuuucuuucuuucuuucuuucuuucugucugucuuucuuucuuucugucuuucuuucuuucugucuuucuugucuuucuugucuuucuugucuuucuuaccgagucucacucugucacccaggcuggagcaguggcacgaucucugcucacugcaagcucugccucccggguucaugccauuccccucccucggccucccgaguagcugggacuacaggugccugccaccacccggcuaauuuuuuguguuuuugguagagacgggguuucaccaugguagccaggauggucucgaucuccugaccuuguuauccgccugccucggccucccaaagugcugggauuacaggcaugagccacugcacccggccagcaacuagauuucaaaagaagaaagaggauaagcccuagugcucuagcauuuuucaagcuucugcuugcauuguacuuacuaauguuccacuggccaaagcaagccaugugacaaagcccagagccacuauggaagguguaucuuucaagguuguacaauucuuauucccuauuuauagauaagggaacggaaaaaugaaaagcaacuauuuaagauauaaauguagugagaagaguggcauugcuuuacaucuuugccaauuucuuugaagucugucuuauuagaagacaacucaugugcuucugcauucagccuguuuugauaacaucguuuugauugaaacaaaugaagaaaauacagccucacacagauauguaauuagaaaaaauagaaguauuuuaauaguguuuccagauaauuggggauauucucugauaugucaccaaaacuuuugcaguggacuaggacaugugcaugaaucaacacaacagcuuagaggugugucucagauaugccacagcauagaauugguagagcugugggguauuugcuuucuggaauaaucacaccaauguaaauauccuucccaguagccagcucgucuuggaaagauagacuauacuugcuccaagcccuuucucacuguucugcccacuauuaaugggccauguggccugagcugaaaucacuccugauucuccuaugacugucaacuccuaaaacuucuguuaucuaaauucccccagcccuacaugacaucuuuaauaucuauugagcaaauauaacauaauucuaacagcaaccacaccaagauccuaagaaaagcagaaugugcaagugucugagcaguguagcagcagaaccagggaagcugugaugugccccuugugagguggagagaguggguggugcaaaugccuguguucagccauugggggucaucauuucuccaugugcggagggcuuugcacaucuucucagccaugauccuaauaggauagaauacauuacuguuuguguuagaugccaaaaugaagaaagucucugcuuucuacaaccccaagaguuuuuuuuuauuugggacacaguauaaaguaaaauauauaaaguuaugaguguuccaaaagaguauacaguuucccuuacaucuuuuuuuuguuuguuuuuuugaaauggaguuucguucuuguugcccaggcuggagugcaguggugugaucucggcucaccgcagccucuuccuccuggguucaagcgauuuuccugccuuagccuuccgaguagcugggauuacaggcaugcgccaccacgcccagcuaauuuuguauuuuuaguagagacgggguuuauccauguuggucaggcuggucuuuaacucccgaccucaggugaucggccgaccucagccucccaaaguucugguguuacagaugugagccaccaugcccagccucccuuacaucuuaauuuaauaauugcuacuauuuacugagcacguagaguagaauaguguacuauuuuaguaagggcucucuguauauuauacugugguaaaauauagguagaacuguuaggauaguaccuuuaagagucaggcacuauccuaugggcuuuauguuguguuaacuccuuuaauccauuuaaucuguacgccaauccuccgaagaagguacuauuauugccccuuuuugcagaugaggcaacugagacacagaaucauuaaguaacuugcccauggucaaacaacgaguaaguguagaaccaggauuuaaacgcacaccgaaggguucuggaauggaauggaucugauaggcuagcugauucaagcucagggcccacguccuguguauuugcagccuuuguggcgagcauugcuuaucuggugucuguugaaguagcuacuggagcagagugauggagagguggcauuguguuaugguaggaaaaccuggggcuaggaaugaaaaaugccagucuuaggcagaucacaguaacuuuucugagucuucauuuuaucaccucuaauauggguauucuaaugucaaucuguguauguuugggucauguuuugccauuuauagaguaacuuuacauguuguaucauuaaucucuuuugccugccuugcagagcuguuacaggaucaaaugaauuauauacaggagaggcauaaugaauuguuguugcuuuuuaaaggauuugcuuuucucuuucaguguuguguuucaucaagagugaacuauuaaaaaaaauucagauuuccuugaauauuuaagguauagaugcugucuguucuguaacucuacgcaugaucgccuccuaccauuuucauacauaguucugguacccaaguauugcaucaaauagaaauuauagucaguuucauuuucugcccuggcgaacaggaaauguaguaggcacagauaauccaaaauaauuggcuagcuuuugguaugcaguuuuguacuuaauuugaguauguguggcugaggauucagagcgcuuuaaguauugauccucuuuggaagacacagcuugagauuaaucauguuuuuuagacccuugguaucuuuucuaccacacucauuucauuguuuccaguucaggagcccagcagagauaguagaaccuccuucuuccaucuccugccuuucucacacauaugccuugugguaaagguacaggcaggaggcugcgggagagagggguucuuuuacaguuaaaaaaauauuuuuuuuuuacacuuaagaugauggagggaaccucaaaaauuuauuuucuugcuugagcaguguugacaucaacaagaggauaccagguauuaaggugucuaggcuucugagguugagaccaucuugaggggaaaucuacaguucuaggagcggucauagucaaagcagcacaaugaaaacuuauucuuagcacuuuggacuuuaacaguaccacuaguauaaaccuuuguggucucuacuuuguaacccaugagguugugcuuauaccagucaauaaugcaaggcucucucagucuguuugagcugcugugacaaaauaccauaaauugaguggcuuagagagaacagaaauuuauuucuugcaguucuggagguugggaaguucaagaucaaggcaucauagagcuagaguucuggagaguaaaaauaaagaaaaaaaagaucaaggcaccagcagauuugguguuugaugagggcccacuuucugguucauagaauggcucuuucuugcuguguccucacgugguggaacgggagaaaggggaaaggccucuggagccucuuuucuuucuuuucuuuucuguuucuuuuucuuuuuuaaagagauagggucucauucuuuuaccugggcuggagugcaguggcuugaucauaccucacuguaaccuugaacucuugggcucaagugauccucccaccucagccuccugaguagcuaggacuacgcaugugagccaucgcaccuggcuaauuuuugaauauuuuuuuguaguaauggagucuugcuguauugcccaggccagucuccaacuccuggcuucaagugauccucccaccuuagcuucccaaagcccugggauuacaggcaugagccauuguacuuuggccuggggccucuuuuauaaguguaauaaccccauuuaugagggcagagcccacuugugaccuacucaccucccaaagacccaaccuccuaauacuauuacacuagugauuagguuucagcguaugaauugaggggaaaaauuugucuuuacuguuucuuuucaugauggcagccuuucucuugagcuuguuguuacaagugugauguucaaaacaagggaagcucaugauauugcccugccuugugcugggcagaccucucuuucuuguuauguuugguucugaauacuucacuuugauguguaguaucaaccuggagugugaucuaaagaaagggccagaauaguaaggggaguuaaucauuaaaguggagguuggcggaacuagaaaacggaagacuugcagaggaaagguugcuuauaauaggaauacgcaaauuucugaaaggcucuuuuagcacagaggaaauagaauuaugacuguuggugaaaauaaccaguuuuugagggccuacucuguugagauguuguacuaggcgcuugcucuauguugcauauauugcagggcacauaccaucucucucuagcagaugaugaaacugagacucagagguguggucauguucaaggccgcaugguuauuaaguccuguugcaauuaaaacuaaggucugucuaauucccaagccuguuagccaucaguuuguaccaauucccaguggacagagaucacagggagacagaccucaggcagcaggagggagaugcuaaccauuccagcuguucuguguacccuggagaggaggccuuuaagcagaacauaaagcaucccucacucgggcugccauaaagagagauuuuuuuuuuuuuuuuuuuuuggagauggaguuucacuguuguugcccagccuggagugcaauggcuugaucucagcuccccacaaccuccgccuccuguguucaagcgauucuccugccucagccuccugaguagcugggauuacaggcaugcaccaccacgccuggcuaauuuuguauuuuuaguagagacgggguuucuccauguuggucaggcuggucuccaacucccaaccuaagaugauccacccaccucggccucccaaagugcugggauuacaggcgugagccaccgcaccuggccuaagagaguuauguuggaaagaugaacuuuaaaguuguauuccucugcuucucuuccuguguaaucuucugagcucccuuccagguccaggccaggcuauuccugauuccugccuuuuuguucucagugauccuugcuugguucugagaacccauuuccagcccuaccuuuagugagguaccaucauguagggauuauuuggauaauuucuguccuuaagcaaaaugaauuuuguauagaggcucuuacuuauauucuuuuuuaaaguugugguccagcaaaauaacgaucguguggcaucuauggcaccaucguaaaggcuccuugaauugugcuaaacauaaacauaaccugagguacccugugcucuacaaguuugaaucacucuuuuaccagucuguuguauagccacugauuuuagaugccuagguggcugcucuuugaugaaaauaccaaugcaggucuugugguagggaaggggaguauacagucccugggcuguacaacagaacuuuuuuuuuuuuuuuuuuuuuuuuuuuugagacagagucucgcucuguugcccaggcuggagugcaguggcacagugucagcucacugcagccuccgccuccuggguucaagugauucuugugccacagccucccaaguggcugggauuacagaugcucgccaccaugccuggcuaauuuuuguauuuuuaguagagaugggguuucaccaugcuggccaggccagucucaaacuccugaccucaggugaucugcccgccccagccucccaaaaugcuagaauuacaggugugaacuauugugcccggcauuguacaaccgaacuuuaacaacaguugcucagaugaugauggggauaaagaguugggaaagagcacaucuucuugaaaugcuugcuggaauaugcuuacuucuuaaaagauuauagagaauauugauucuuccccaagaaauugacagauucauguuuuacauaaugauauuugauuguauaaaguaauuaugcugauuuuaaaaugugaaaacauugaauauauuuguaauuuuuuguuaauaaagugcauaauuuuuuuuuguaguuuauucaccucgaugaugauugcguaacagaacuuucuguacaucacagaaacaacaggcaaacaauggaggauuuaauuucacugguaagaaauacagcaugggcugggcgcaguggcucacgccuguaauccaaacacuuugggaggccgaggugggaggaucacuugaggucaggaguucgagaccagccuggccaauguggugaaaccccaucucuacugaaaauacaaaaauuagccaggugugguggcacgugccuguaaucccagcuacuugggaggcugaggcacgagaaucacuugaacccgggaggcagagguugcagugagcugagaucacaccacugcacuccagccugggcaacaagagcuaaacuccaucucaaaaaaagaaaaagaaaaaaaauacagcaccaauuugagaguaguaucuuuuguuucauuguucuuuauuuuaucaguacaugaaaaauaguauagcauuuucagaccugugauuuuauuauggguacaaauauugcauuuaaaaaauauuuacauaugauuuccacacaguccugaugugugcuagauaucuucuuuaaaaaugaacacuccauacuuaaaacauugaugaagaagaauuacagugaaaaaauaauuaagaaacaacuggccgggcacgguggcucacgccuguaaucccagcacuuucggaggcugaggugggcggaucacgaggucaggagaucgagaccauccuggcuaacacagugaaaccccgucucuacuaaaaauacaaaaaauuagccgggcguuguagcagaugccuguagucucagcuacuugggaggcugaggcaggagaauggugugaaccugggaggcggaguuugcagugagccaagaucacgccacugcacuccagccugggcgacagagugagacuccaucucaaaaaaaaaaaaaaaagaaaagaaacaacaaacuagugcacaaagaauggacagaguucuaauuuugacuacuuuaaaguucucuaacaugcaacuggguuucugcuguggaaaugagguaaacacaaagcaauuuucuuuucaccugaaagcaacagcagcgucacgucaccccuaaguggacaaaccaaauaccaugaaagcauuaucaugauuucugguguuggauuauuuuggcucuuucagaugcucagucucuagaucauaccuguguuuuguguguguguguguguguguguguguguguguguguguguguuuuaagagaucaaggcagucacagcugucucuaaugugaagggugacuuguaccucacuuuguuccuggcccaguacuaugucuucuaucaccugugauuuauguuugcuuuaucuguucuuuaacuugcaagguggaguccuuaagcaauuuuuuuaaaaaauuaaacaaagcuuugcuaaggcacaauucuuuucaguaaggagaaaauauaaaggaauucuucugaaugacauaauaaguaaagacacacagaauguaucuggaaaugguaguauaauuuacuuuuucauggauaaugccuuuagggaaauaguaagacuugggaauugcuguaagauuugugugguccucagucuuucauuagugaaaauuugaaguuuccauuuaagcaaccugaaaaaauaaauuguaggacauuuucuuugggauaaucuuuaauggaagacuauacuuuagauacugaaauuuuaaaaaauguuauuauagaaaaauuuacccaccaaaguagagagaauaguauaacaacacugaguuuccauguucucaucauucaguuccaauaguuaauaacauuuugccaauuuaaucuauauccuaccacuuucucccuucuucccuuuccagcugggauauuuccacguaaaucccagauagcaugucaguuuauccaggacaaauugguaugagaucuacaaacuuuaaaaaucugaaucuuaaaaguaacauacuuaagccgggcgcgguggcucaugccuguaaugucagcacuuugggaguccgaggcgggcggaucaugaggucaggagauugaggccaacauggugaaaccgcguuucuacuaaaaauacaaaaauuagccgggcgugguggcacgugccuguaaucccagcuacucgggaagcugaggcaggagaauggcuugaaccugggaggcagagguugcagugagccaagaucacgccacugcacuccagccuggugacagagugagacuccgucucaaaaaaaaaaaaaaaaaaaguaacauauuuagaguuucaauaaucauugaaaaagucuuuaaaaugguaucuuuuaugacgucucuaccuauaauuuucagacuuaaaagugaaauggaaauacaaauuauuugcuuuccuucuggugcauaaaacauaacaaagcauaguagaaguuguuuccugguguuacaguucucuaaagaucuucucaguuauucugaaaguuaagcaugaccaacaucaagaauguagugaggaaaguaauaguuuuucuuccuuuguacucuuuucucauucuuaaaucccuguucauacuucguugagucccagggaugaguagguuauaggcuacucacucuagaucagagauucucaccuuggcuguauaguggcauuucuugggaacuuuaauucugauguuuaggucucaaccccacagaugaugauucaguuggucuaggguauagccgaggcaugagaauuuuuagaaaucuucccagcugacugugguacgcagccagagucgagaagcagugcucuagauccuugcuguucaaaguguggccuaggaccagcagcagcagcauccaggugcuuuuuagccgcgaagacucucaggccucaccucagaccuacugaaucagaaucugugucaaaucuccaagugguucauaugguuaguaaagcuucagaagcauuggucuagcucaguucucaaccaggagugauuuuggcacucagggggcauuuggcagugacuagagacauuuuugguugucguaacugggguuuguguauguguacuaaugccaucuagcggguggaggccagggaugcugccaaacauccuucaaugcacagaagagccccucacaacaaacaguuauccaggucagaugucaauagugccaagguugagaaacccuugucuggguagcucagagaauucauacuggcucuacauacuuuccaauuugaagagccucaggaaaaccagguuugagacuagccagggucuguuauguuuuucugugacauccugagagcucugccuucacuuuuggggcugauuagacaggacagagagagauuaguucugugugauccauaugcugguauggugcugcugaucuuugugcagagagagagagaaacaauauuacucucaaacauucaacuuauaagaacucccacuuuuauauuauauacaggagcacucugaaacugcuuucucuaugcagcggugagccuccuaugucucaugauuuugagugaucucauuguauuccuuuugagauucccaacagugcuuuccuuacugucuuccuguuccuccagcccugaguggcucuggauuguggcagcagccaguccucugcuaggggaccuucacuaagggucacauguguguucgagaaccuauucaguccaggacagauccauuuuccccaccccugugauguaaacacccauguguguaaagacugaaggccucaggaggagggucagaggaaggguaggggccacuccuccgugucugugccccucugcacuaguagcugccucuccucaacccaggugccaggacaccucuuuaacauuuaacuggggauuuaagaauguuuuuaguuuucuagaaauggaacuuucucacagguaacccuaucacuuuacuuucagacauuugacuuucaaaagagggaauugccuaaaagauaagggaaaccuuugucuuagacuuguggauugacaucaccugaaagcauaacuaauguguugauuuaucuguuauugaacacagaacucuccugugcaucuuauaaugagaaguauacagugacacuggccagaaaguuaugaaaaagaugcuuuuuuugccuagggaaaaggaggguuuagaggaugguuguagaaauccuaggcauguuuaggaaacuccaucuaaaacucuuagcacuauccaggaauuguuuacaaugccuggguuaugccaugccaucauugauaagaaaguggcaacuuguuucuuagccauugucucuagucaguuuaugacaucucuuucaaaaagguggcuaucguacauggggcuaucauagauguggggugggaaaaagucuuuaauguaguuuuuggaaaguggagagugauuauaaguauauauuuuccaccccaccauaguuucccagccaccuucuccaugaagccucuucuuuucuuuucuuucuuucuuucuuuuuuuuuuuuugagauggagucucccucugucgccaggcugcagugcagcggcagaaucucugcucccugcaaccuccgccucccgaguucaagcaauucuccugccucagccucccauauagcugggauuacaggcgccugccaccacacccagcuaauuuuuguauuuuuuguagagacaggguuuuaccauguuggcugggcuggucucgaucuccuaacuucaagugacccacccgccucagccucccaaagugcuaggauuaaaacauguaugagccacugugcccggccaugaagccuuacuguccuuucuuugccucacccuguuuggauuaaaggcaacauuucauaauuuaugacacuauuuuaugcuuccccuacuagauugauugggccauuuaugcaaauuucaaagcauauacuaugaucguggccaucuaaguuauuaacuaauaaaauucauuacuaaaaacagaguugguaguugacuuuugagucauguacuuugugagggggcuacauagcaugaaagacuauuccguacuguuaaaaguuaacacuuuuguagggcagauagccccauaguuuucucaguacauuauuuagaaacuuucauuaaacauaguggauugaacagcuaaguuuacgucgaacacuuccuaaaaccuuaacaaaaagggauaaaaaggcaaaauauuuacaagcagaauaaaaggggagacaaagggaugucauuagaaguuuggaagauauagguuagugguauaagugguaguugucagagcauuuuggagaaagcugaaagcuaagugcuugcagugagaaaggcaucaagcaaacugaugagagcuccagaaaggcucaggaaucagagguaccaggagccucugaagucagggaagugaagaggaaaaacaggaagauggguuagaacccuagauuccuuucucuaccugugcugcauaacagccuccucuuccgcauccuggcagaagacuggaggucacaaggcauucuuguaccaaauacagcucagaugcggaugaugaacaauucugaaauggaugcgcaaagucuucauauugaacagugcaccaccaucucaaauucccuucccuauucaacuuugagaacgcugaaaccaggauuuguauccuauuugcagugaugguggggaaaauauuggaagauuuaucuccagggaaaagcuaagauaaauauccuacuauauuagugguugggaguucaaguuccuguccguucaucuuagagaggagccuucaagguauugagcagccccaucauacacauagaaccucucaucagcuguguaacguaauucuucacuuuuaaguagaaacagacaaccaaaaaucacuagaaauuugaggaaaacuucuaacaugaaagucggagaucaaaacaaauggaguaagguggggagaggaaagaagaaaaaguagauacugagaaaaaaaaaccccagauaugcagggagcgggagaaaauggcuaaaaacugcuaauuaauauucucagauaagagaagugauuuucauucuugacauaggaauaagaugaauaaaaaugaacauuccaagagauagcucuugaaaaucuaaaaugugaccacagaaauuaaaagcucaguaaaaguguuugaaaaugaaauucauuugaaaucuuuuaaaaguagaaccuggugggcuaggugcggcggcucacaccuguaaucccagcacuuugggaggccagcgcgggcagaucaugaggucaggagaucgagaccauccuggcuagcacggugaaacccugucucuacuaaaaauacaaaaaaaauagccgggugugguggcgggcgccuguagucccagcuacucgggagucugaggcaggagaagggcgugaaccugggaggcagagcuugcagugacccaagaucgcgccacugcacuccagccugggcgacagagcaaaguagaacagcuaggcacgguggcuuacgccuguaaacccagcacuuugggaggcugaggcggcagguggaucauuugagaccaggaguucgagaccagccuggacaacauggugaaaccucaucucuacuaaaaauacaaaaauuagccaggcgugguggcaugugccuguaaucccggguacucgggacccugaggcgagaggauugcuugaacccaggaggcagagguuguagugagccgugauugcaccauugcacuccagccugggcgauagagcgagacucuaucucaaaaaaagggaaaauaaugcaagaagaaauauuccaggccgggcacuauggcucacgccuguaauucuaaaacugagaggccaagaugggaggauugguugaggccaggaguucaagaucagccugggcaacauagugagauccuaucucuauuuaauuuaauuuaauuaaauuaauuaauuuauuuauuuuugagacagaaucucgcucugucgcccaggcuggagugcaguggcacgaucucugcucacugcaagcucugucucccagauucacgucauucuccugccucagcuuccugaguagcugggacuacaggcgcccacuaccacgcccggcuaauuuuuuguauuuuuaguagagauggguuuucaccauguuagccaggauggucucgaucuccugaccucgugauccacccgccucggccucccaaagugcugggauuacaggggugagccaccgcacccggccucuauuuuauuaaaaauuaaaaaaaaaauuuaagauuaaaaacaaaaaagagaaauauuccagaacugaagaauaugaguuuucaagaaugaagaggccuaaccugggaugaaacaguagaugaaaacagauucacaccaaggccuguucuaguggaauuucauaauaagauucaggaaguuuucaaagauaaaaaugaaaguucauacaaaaaggcuggagaaucaaaaccuaaaugacuauagguuuuucaguagcuguacuagaaucaagaagaguauacuaccaucaaaacugcgaagauuauuaucaacccagaauucucugcuuaaccaaaucagaaucaauugugaagauagaauguagucacuuaucagacaugcaagaucucaaaaaauuuacuucccaugcaugcgcccucaggaagucacuggaggauguguuccacaaaaaugagagauuaaaccaagaaagaagaauacuuaggaucuaggaaacuggggcuacauuguaagauagaggugaaaggaaucccuagacugacaauugaguagcuggcugagaagccgguccagaguggagcagaggaugcagacaucagguggaaucucucuaaguggggaagcaguuagcagaugugugugaacauguugagaggagguaaaguguuggaaaggguggaguucaauuuguaaggaauaacugacuuuuauuuuuaucuucaggaaaaacaaagguauaaaaaaauggaaaugcaagaauagcacccugugugguuuagcugcagagcugauauucggccagcaugaccacauugguuguuaaaauauuaguguauuuauauacugacugguaaauaaccacuaucuucagugcccuccauguugcccuguuacuucccuggacacuacucccuccccucuucucacaauuaaaagauuaauaauuggaaaggcaggcgucucccaggacccuacugaccucuuggccucuauuuugaugguugaugucaggguaacaauuaacuauuuugaacauuaucccuacuuaguugugaaugcuauuuacauaaucauaauaaugcaaauauuaacuuagcuaaacauugugauaaaauuauaguaggaggauacagggaggagaugugugggaaagggagggaguugcaguagaguuaaauucauauuucucauacuaggaaauuuauacauauuaucugaagcugaaaaaaauuuuaagcuauguaagcauuuaguuuggaaauacagaauuaauagcagaagaaauagcuaaaaguguuugaaaguuguuccuuagggggaguggaaauuguauguguguggagguguggugcacugguugcuguuuuucaucauaugcuguguaaaccuauuggcuuuuaaaguucugaauguuacacugaagaaaaaaauuaauuaaagauagaacaucauuuccacaaacaaguaaucuucuaaccaacuugauuuucuuuuccuuuaguggcaguaugaucaccucacggcuaccuaucuucugcuucuagccaagaaggcucggggaaaaccaguucguuuaaggcuuucuucuuucuccuguggacaagccagugcuaccccauucacagacaucaagguaaguguuacugccuguugugucuugccacgugcccucccuguuccugaguguguauaccacugggaagguaaacuuuccggugucaaggagucagaggcaagauguuuuaugauuucaauauuuuugaugagaaaaaugggaaguucugaaguugaacucuaauuuuuuuuuuuuuuuuuuuuuugagauagagucucacucugucaucuaggcuggagugcaguggcaugaccucagcucacugcaaccucugccuccgggauucaagcgauucuugugccucagccucccgaguagcuggaauugcaggugugcaucaccacgccuggccaauuuuuguaucuuuaguagagacgggguuuugccauguuggccaggcuggucucaaacuccugaccucaagugaucagccugccucggccucccaaagugcugggauuauaggcaugagccaccgugcccggccucuaaaauucugaauguuaacauggcauuuuacaaaccuccuccccugacuccuuuuuuuucauaauagcaauuccugauggcuauagaaaauguuuaagccaggccgggugugguggcucacaccuguaaucccagcacuuugggaggccaaggcagguggaucacaaggucaggaguuugacaccagccuggccaauauggugaaaccccgucuguacuaaaaauacaaaaauuagccaggcguggugaugagugccuguagucccagcuacuugggaggaugaggcaggagaaucgcuugaacccgagaggcggagguuacagugagcugagauugcgccauugcacuccagccugggcgacagagcaagacucugucucaaaaaaaaaaaaaaaaaaaagaaaaugcuuaagccacagaugagcuaaaaggaaaauagaauuuaccuauaaaccaacuaccuguggaggauguaguuaauauuuauugugucuuuccagucuuuuuuuuaaagcauacuuuuacacgcauucaaguacuuuuaaaggacacauuauugaauugcagagaacaaaaaaauuguugggaguaagaucugugauauggaauauauaauacuuuauaugacaugaaacauuuugauaaauauuuucauauuuauguuaaggguuuagguuuuuguuucuuuuaaaauuuucauacugaaauggagcauguugauuaguguuuguuauaaccaaauuauuuuucucuacuucacugucuuugucucaguuuugucauggacuuuaaaaaauuuuuuuguuuuauuuuuugaaacaaagucuugcuuuguuguccuggcuggaguacaguggugugaucauggcucacugcagccuuaaccuuccaggcucaagcaauccuccugccucagccucccuaguagcugggauuacaggugugugccaccacaccuggcuaauuuuuaauuuucuauagaaauggaguccagcuauguugcccaggcuggucuugaacaccugggcucaagcaguccucccuccuuugccucccaaagugcugggauuauuggcaugagugacugcaccuggccugucauggacauuuaaaauggugaagaagcuuacauacauagaggcaccaugucauuccuaaaugcuuguguuaguccuuguuuugugugauucuuuguauuucccauggcuuaaaauucagcuauccaaauacuuugccagauggguauggaacuuuguaaugucaucuucccucagauuaauucagguugcaauguaaauaaucuuagcacuaggaaauuguaccucauccucagagaaagguaguugguuggcccuguuuaugaaauccaagauaacacaauugacuguguggaugaaaguuugguuuuuuuccccuuuauaggccucaaaacuguaaaaaaaaaacaaaaaauguuaaaaugccaccucuuuuaugaucuuuuguugaauucccccucccucaaauuccuuuaauaucuaucucauuuagaucuccuuuugguacucaucagucaugugcuacagguauagugggucuuaugucacugccagaacuaaccugccccucuuuuucccucccuaguuggucagugcacuggcuguuguguaaagaaaucucugaagggagauauccugcaugguuuucuagucuguuguuggagaguuuuaauggcugguaaauauucugugccuaggcagcucuuuugcacaugggcuccuugaaucagccaaucccucaucccacccacacugccaaacccuuuaaacuuucaggugcaaguaacacaucuggguccaggaaaaugcaaaacccugaauuuugcaucugcucaagguaauuggagaaagcuauuagauacguauaccucuaugcuuagaaaaaucacuuucacuaaauuuuaaaauuuacgacaccucaguuaaggggccugagacauuuuccugagacauuggauugucuuuuuuuuuuuuuuuuuuuuuuuugagacagagucuugcuuuguugcccaggcuggagugcaguaguguggucuuggcucgcugcaaccuccgccuccuggguucaagugauucuccugccucauugucccgaguagcugggauuacaggugugugccaccacaccuaucuaauuuuuguauuuuuaguagagaugggauuucaccauguuggucaggcuggucucgaacuccagaccucagaugauccaccugccucagccucccaaagugcugggaacacaagcgugaaccaccacacccggccuggauuuucuuauaucugaauuggccuggucucaauugaucugcuuauaugaguuguaaguggaaaagaccuggaaauauauuuacucuuaucuuccaucuacucccuaaugaacauuuaacuaauaauuuaauuauuugcaaagucauauuauugaaucaauuuuauggcagaucaagagacauuuuaguaacaagaagugaaauagaaaucaaauuuuggguucgcuucuaaucuuuaugcaaauuauugagacacgaagcaagucacauagucugguuguacuguucuuccccuugauagaauuaucccuuuucucugggguguuguuuauaagaaaguaaguaaucaugaucgaucaaucaaucaauagguggcccuuucagugaaacagcaguacagacugauccaagaaucacaaauaaccacgucaucaucaucagugucauuagcauuuucaggccccaugcugggcugcugggaaacauaucuguguaaaguauaauacuuguucucuaagagucaagacauauauauacauagauaauacugcaucauaguagaugaugggggccagagaaguggccagagguguccuggggagcuuuagaggacaggaaugaucaccaugggauccaaacuggaccaacagucaagguuagaaagauggaaaagaaguggcacaacauucagggcaagauaaauggaaucagcaaaagcaggggcaccuaauuuugcuugauguauucuguugacaguggcuggacuuguguuaaaaaagaagaguucaaguagggggagagagagagagagagagagagagaacgcaagugagcuggaaggguggacaagagccagauaguagagaaccugaaaaugcacaucagaauuuuagacuuuguucaauaguuaaugaggagccauugauuugugagcaagagagagagaaaugaacaugauuuugaaaaauuaauccagugguguauacgauuguuuagucaggggugauaugugugcuauuagucccuacuggaguacccaugacagccgucauucguacagcacuguacuucuccccaccaagccuagacuuagcuuuaggauuuuucucagccuagcucuccaugcauccaguuccaaaugacaguaauugguaauccuggagaacucugucauccuugguugagacaguggaaagauuagugguagagacaauauugucuguuugaauagucuagguaugagaagauuuguccuugaucuaggauaguggcagugagacuuugggaaaaaaaggaugagauauaagaaauucaaguaaaauugcuuggcuagauuaacaauauaucgagggaaaaggaaggaaggagaaauaaaaacuccaaguacacccacagucuugaauucaggguauaauuaguauacccuuaguuuauagaggaggaagaaugaaagaacagaaguuauuuugguggcguuguuagcgcaagaccccaaauguccuaucccuaggagauccuucauaaggcuaauuuucuuccugguagaaauuauucacuacccuguauauucuuacaaagaagaaaccuauauuucgaaguuguuuccccuccaucuucuacuuugucagaucuuuuuauuuguaaauuugcaguagaguugucugguauuauagugauuaugugauaaugaaaaguaguaugcuauauaacauaagaauguugcaagacauauuauuugagagucggagguuuuccuuucugauaauuugaacugaaauuuucugacuuccuuuuucuguacuggauggucagcuccuucaauauagugucuccuauucauuuuuguuuccagggccuugcccuaugccuggaauacaguuuugugcugcauaaagacaacguuggacugcauuuaugaugguggucccauaaaauuauaauaccauguuuuuacucuaccuuuucuuuuuuuuucuuucuuuuuuuuuuagacagagucucgcuguauuacccaggcuggagugcaguggcacaauuucugcuuguuguaaccuccaccugguggacucaagugauccucccaccuaagccucccaaguaccugggccuacaggcacaugccuggcuaauuucuauuuuuuguagagaugggguuucaccguguugcccagacuggcuccaacgccugagcuuaagugauccaccugugucagccuuccaaagugcugggauuacaggcaugagccaccauggggacggccuuuuucuguuuagauuuguuuagauacauaaauacuuauuguuguguuagagccaccuacuguauucaguacaguaacgugcuacacagguuuguaguguaggagcaacaggcuauaacguacagccuagguguggccuagguguguaguaggcucugacgucucaguuuguguaaguacauuuuaugauguucacacagugauaaaauugccuaauacauuucucagaaugugucucugucguuaagugacgcgugacuguauuuuaaauauugaaucauaguacugucaucuuuaaguucuucugucuuucauugaguagucaaauaauuggagucuggaagaugugaccgcaagugauaaaaauuauguggcgggauuaauagacuaugauuggugugaagaugauuuaucaacaggugcugcuacuccccgaacaucacagguucgucauucuuauuacuauuuaaggcagaaucuauuguuucaauuauaaaaacaaccagacuaaugugaaaccaaggugugcuugcaaauuuaaugaaugcuuaagccacugaaaauguuuaugagcgauaacuggaauacgaaugaaagggaagucaauuauauccaaguugaagaaagccaagauucuauuuuagagcucuuuacugcuccuuuauuuccuguuuauuauuauuauuuuuugagacugagucuugcucuguuggccaggcuggagugcaguggcacgaucucggcucacugcaaccucugccucccagguucaagugauucucaugccuccugaguagcugggauuacaggugccugcugccucuccuggcuaauuuuuguauuuuuaguagagacaggguuucaccauguuggcagcuggucucgaacuccugaccucaggugauccacccaccucagccuuccaaagugcugggauuacaggcgugagccacugugcccggccuucuuuuuuguuuaaaaugagguauaaugagguauacuuuacauguaguuaaauagguaaagucaccuuuuuuagugugcaauucuauguguuuugacaaaugcauacaguuguauaaccaccaccaaaauuaagauauaaaacaguuccguuacuccucaaaauucccucauuccccuuguggcuaacuuccccucccaacucucgguggcaauugaucuguuuuucuuuccuuuugauaaucuuuuuauugugacuuuaaguuuguugagcuuuuuagauuaaugaagauuaaguauagauuaauguuuuuuaucaaauuugggaaguuuucaauauuuuauuugccccacucucuuuauuuuaucuucugguacuccccuuccauguauauuggcacacuugauggugcccuacaguacacugaggcccuguucauuuuucuuuaucuauuuucauucuguuucucagacuaauuucaguuaaccuguuucaaaguuucagauucuuucuucugcuuacugaaaguucuguuuaaucccucuagugaauuuuuuguuaugguuauuguacucuugaacuccagaauuuguuuuguucuuuuaaauaauuuuaucuuuauuuauacucucuauuuauugugacauugcucuuacacuuucccuugguucuucagauguuuccuuuuguucuuugaacauauuuaaaaacugauuuucagucuuugcuugguaaggccuacgucuggacuucuucaaggacaauuuccauugacuguuuuuguuuuucucguguauaugggccauccuuuuuguuuguuuguuuguuuuuuguuugagacagaggcuccgcuguaucgcccaggcuggagcgcauuguugggaucucugcucacugcaaccucugccucccggguucaagcaauucuccugccucagccuccugaguagcugggauuacaggcacccgccaucaugccuggcuaauuuuuuuuuuuucuauuuuuuuuuuuuuuuugagacagagucucgcucugucacccaggcuggacugcaguggcgcuaucuuggcucacugcaagcuccgccuccuggguucaugccauucuccugccucagcuucccgaauagcugggacuacaggugcccgccaccacgccuggcuaauuuuuuguauuuuuaguagagaugggguuucaccauguuagcuaggauggucucgaucuccugaccuugugauccgcccgccucggccucccaaagugcugggauuacaggcuugagccacugcaccuggccuuuuuuuuguguuuuuguaaagaugggguuucaccauauuggccaggcugguguuaaacuccugaccucaggugaucugccugccuuagccucccaaagugcugggauuacaggcaugagccaccgugcccggccauacuuuuuuauuucuuugcauguauaugucuuguaauuguugaaaacuagacauuuuaaauaauauaauguggcagcucugguaaucagauuuauccccuccucaggauuugauauuauugcuguuuguuguuguugguuagugacuuuucugaacuaauucuguaaagucguuaagucauuuaggucaguguugggcugcauuuaugauggugguccaugagauuauaauaucauauuuuuacuauaccuuuucucugcucaauuagcauagugaucagcuaaugcuuggcgagguuuccuuagaugccuggaaucaauucgucucucagucuuugugccggcucuguguacaucugggguaugccugcaacuuucagccaggcagcugacaacucugcauuagauuucauuuccuauuuguauaaaaccucaaggucagcuugaggugagaucuuagauccuucuaaaguguuuuuuguuuuuuauuuuuauuuuuuugagauggaguuuugcucuuguugcccaggcuggagugcaauggcacgaucucaguucacugcgauuuucgccuccuggguucaagcaauucuccugccucagccucccauggagcugggauuacaggcaugcgccaccacaccuggcuaauuuuguauuuuuaguagagacgagguuucaccauguuggucaggcuggucucgaacugcugaccucaagugauccaccugccucagccucccaaagugcugggauuacaggcgugagccaccaugcccagccccuucuaaagucuuuccugagcaaaugcacagcccuggguaugagcacauccuauacauguacauugggcuuguagauacccugguauauuuuggagcuuuuccaauucacuguggacaucuuauucucuaacuuuuuuuucagcauuuuuguuaguuuauuguggucaccagcuauuacuuacugcuucggcagccacaaugugcaacaauugccuguaaauuuuuuuuuguuuuugagauaggaucucauuccgucaaccaggcuggaguccaguggugugaucauggcucacugcagccucgaccuccugggcuuaagcaauuuucuugccucagccucccgaguaucggggacuauaggcaugcaccaccaugcccagcuaauuuuuacaaaauuauuuuguagagacagggucucaauauuuugcccaggcuggucucaaacuccuggacucaagagauccacccgcguuggccucccaaagugcugggauuacaggcgugagccacugcgccuggcaccucuaaaucuuuuuaacagaugcugcuggggaaaaggcuguucauacugggcaggcucugaguaaggucaaauaaagacagcuuucaggcugggugcaguggcucacgccuguaaucccagcacuuuggggggcugaggcggguggaucaccugaggucgggaguucaagaccuaccugaccaacauggagaaaccccgucucuacuaaaaauacaaaauuagcugccugugguggcacaugccuguaaucccagcuacucggaaggcugaggcaggagaauugcuugaacccgggagguggaguuugcagugagcugaguucacgccauuacacuccagccugggcaacaagagcaaaacuccgucucaaauaaaaaacaaacaaagaauaaaaaaagacagcuuucauaguagggucuucuagggaacuacuggccaggcuaaauaaugacaguuuucugagcaugaagcuuugaaggagcuccaaccuguucugcccccuccagcggcuccuagguugcuggucuucaucgugauugugggcuguggguuucuaagacuaucauagagcuggagagagaagaauggggauagguagggcaaauucaaacaccucaaacucacuguuucuacuuagcuguuuucuaugaauaaaugcugcgaucuuuggcuaauacacagaguucugaaacaaaagagguauacuuuguuuauggauagggagauuugaagguauagauuucaguuuuucccaaaaugaauuuuaaauuuaauguaaucucaacuuuucaguggauguaaaauaagucaaaaugauucuaaaauguauguggaaauacaaaggggcaagaauaacuaaaucauuccuaaagaauaagaagaugggaggaaacuggucaaccugauaaaagaacuauuauaaaauuaaagaaaguaagauuuccuuaauaaauaaaacaaugaaacaaauaaaacaaugaaaccuuucauaccuuauauuuagguaugucucuuuaaaaauaacauagcuaggccgggcgcgguggcucacgccuguaaucccagcacuuugggaggccaagguggguggaucaugaggucaggagauugagaccauccuggcuaacacaaugaaacuccaucucuacuaaaaaauacaaaaaauuagcugggcaugguggcgggcaccucuagucccaguuacuugggaggcugaggcaggagaauggcaugaacccgggaggcggagcuugcagugagccgagauugcaccacugcacuccagccuaggugacagagcgagacuccgucucaaaaaaaaaaaaaaaaaaaacaaaacaaacaaagaaaaaaacauagcuagauuugguaugcaaacugaaaaucuugucuuuugaauugagcgcuuacccaacuuauuuuuauuauggauuuaguuauuauauaucuuucuuuuuuuauguuuccuaugugucuuuuucuguauuucccccuuauuucuugauuuuuuauguuaauuuccccccacauuuuauugguuucuauuugauuucuauucuuuuaauauuuacucuaaauuuuuaacauuuaauuuaacgaaauauaaagugaaucuguaucuuuuuuuuuuuuuuuuuaagauggaaucuugcucuguugcccaggcuugagugcaauggcgugaucucaggcucacugcaaccucuuccuccuggguucaagugauucuccugccucagccucccaaguagccggguuuacaggcacccgccaccaugucuggcuaauuuuuguauuuuuaguagagacaggguuucaccauguuggccaggcuggucucgaacuccugaccucaggugauccaccugccucggccucccaaagugcuagaauuacaggcgugagccccugcacccugcugugaaucuguauguuuaauuuccuucuaaacaauaugaaggccuuagaacacuuaaucucugauuaccccuccuggauuccaugcuauugauguguccaguguauuagcucuugaauguuuuuaacuuuuuauuuugaaauauuuauggauucacaggauguuauugaagauauuauuccacuuucuucuugcuucuauuguugcuauugaaaaaccaaccucagucuagugccuuuuuagucugucuuuucucucuggcuccuuuuaggaccuucucuuugcuuuugguguucugcaguuucacuguuagggcuacugcguugcacaccuccagggaacacaccaucuguguggugucucuguggauaguguccucuggaguuguauaaucugguaaauagagauguggauuucuuuuauguauccaguucaugauucaucaugcuuucuauguauggggauuuguauuuuuaaucaauuuuugaaaauuucuugaauaauauacugcuuuuucuuuuucuccuuuuccuuguuucuuuuuuuuuuucuuuuugagacagaguuucucucuucuugcccaggcuggagugcaauggcacgaucucagcuuacugcaaccucugcuucccagguucaagcgauuuuccuaccucagccucccgaguagcugggauuacaggugccuguccccaugcccagcuaauuuuuguauuauuaguagagacagaguuucaccauguuggccaggcuggucuuguacuccugaccucaggugaucacaugacuuggccucccaaagugcugggauuacaggugugagccagcgcacccagccugcuuuucuuuaaaacaauauuuauauaaauuuauagaguacaaguacaauuuucuuagaugcauaguggucaagugagagguuuuaaggugucagcugaauaauguacaucgcaccccuuaaguaauuucucaucaccaacccccuuccaucuccucacccuuccaagucuacauuuucuaucauuccacucucuacauccacguguacacccuuuuuuagcacccacuuaugagugagaacaugcaauauuugucauucugugucuggcuuguuucacuuaagguaaccuccacuuccauccaccuuguugcaaaagauaggauuucauucuuuuuuaugguugaauaguauucuaucugugugucugucugucuaucuaucucacauuuccuuuaugcagucaucuguugauggacacuuggguugauuuuguaucuuugcuauugugaauaaguacugagauaaauauacaagugcagguauguuuuugauguauugauuucuuuuccuuugggaaaagaaguagagggaauugcugcuuuugcauuguccauacuauguauaucuggaacuuagaauagccuuauguuagacauuuuauuucauuuucuguuuccuucaaccaucuuucacguaucguaugucuuuuucugucuuggcuacauucagaguuauuucggauuuauauuucuauuaaaauaucucuauuucuuuuauucuguuauuugacaugugcauugcacuuuucauuuuuaucauguuuuuauuucuagaaguuuuuauucuuuuucaaaucuauuugaacaguuuugguagucuuuuguucuuuacucauguuuuuguuucacuauuuuaaacaugcaaacauacuuauuuauguucuguauuugauaauuuuaauaucugaaaucuuuaugcucauagugcuugugucuuuuggaauuuuuuauguagguuuauuuuucuuugaacucuaugggaauuaucugaggcuuggguuaagggcuugaguuggguuggagugaagcuuuucuuucagguaggaguugugcgugcuucuaccagguuccuggggcacaacuuagcauaggacuacuuuaaguuaaauuuaggcuugagguuucugggaccaugcagguuguauuaauuuggaccuuuauuuaucugaagacuggccuguguuuacuuacaaauuauuaaaagaaacuucauuuuucuccucccucagaaccaagaccaagacacccuuuuucuugccuauucccuuugaagagcagauuuauauuuaacucagccuuuaauuuuagcuauagcccuuccuggcuuuacaugggagcuuugguucuaacucaccaccuugcagaggcccaaggcuucuguggcuguagaaacacaugcuauagguuaucagaggcagaagauagcugcccuuagggcagcagagaguuucagccuugguuacuccuuuggauucauucucauguuuuuaguuuggccucucaggauuuuacuuacucucuugcaagcucaaccauaaauuuaaaaggauuaaaaaguauuuuuuauccaauauuucuguuagaguaguuuaacauguuuuuucugcccuaauugcugacuaaacuuuuuuuuugguacaugucagaggcaagccgugacuaucuagguauggaaagcauuucuuagugauugauuuguggccauucacaauauugccuaggaucugaguauguguauacacucagccuguaucauguugaaaauuacugucaauagaacagacuaaagugaucuacauguauuaaagaaaacuauauauuuucaaauuuccuaaugucaauaauauccuuuugauaauucauuuuaauaaaaauaguacaagguaguuugcaaaugaucaaggaauguuguaaagaaauugacuuuucuucuucagugugcuuuaucuaguaacuuuuuuuuuccaguuuaccaaguacuggacagaaucaaaugggguggaaucuaaaucauuaacuccagccuuaugcagaacaccugcaaauaaauuaaagaacaaagaaaauguauauacuccuaagucugcuguaaagaaugaagaguacuuuauguuuccugagccaaagacuccaguuaauaagaaccagcauaagagagaaauacucacuacgccaaaucguuacacuacacccucaaaagguauuugcuaagugaauuaagcaguaagaaguuucauuuuucuuaccauguuaaguaaacauauagcaggucagaaaugacuagcauugcuuucaggaauuucuaggagaagugaagcuguuuuuuaucaugucauuugcauuaguuaaaaugaaagcauauuugucaauuucaauuuauucucaaaugauaccaaguuuuuccucuuuuucacguuuauaaaauugaaucauagcauccuaggauaucaaagcugaaaggcaaguuagagcucauuuaauccaacucccuuuuucacagcuaagaaaccugagacucagaaggagugaagugauuugcccaaggucauauacccagguuuagaccuuucaugcccauuuaccccgacuuaugacucaagcugacgccuccgcugagccuuuacuuaucuggaucuccaguuguggugucugguccuguucugcccuaugguauuacugccuguccucagcaggcagggugaauccaugaugcccuuccagauaucugucuuuguccaguuaucacaacuuccucauuucccuugguuuccucuucaauuuagucaugagcaguuauuuaaaccauuuccuuuaugauacuucacuguuuugguugcuggccucaucuggacacauucuauuugaucagacugccucuuagaauacagugccuagaacuaaacugaguuuucuagacuaggucucacuaggguagagugguaagugucaugacaguagagacucucugccuuguuuauugcagcauggcauggucuguaguaggggccauaccugucugguacauaguacacaguacuagaccugaugccuaguacauaauaggggccauauuuauguaaugaauuaauaaauuagagcccaaaggaauuuuauuuacagugauccuguuuaugucacuuuaaaaaauguuaccuaaacuuuauuagccuuuuuccccccaccaauugugaccuucucaaguuucaagauucuaacaaaccuaaacucuggagcauugccaugugaacugcugggaaaccacauccugccauugugcuucuaguguacuaauggagcucauagccaguuugagggguuaacuucuugucuauaaagauauuacggaagacuuugccagaauauuugcuagaagucccauuuuuauguuaacgucauuuuccauuucaucaacucaaauaacacuuuccgccaaaaugugaggccaguuugguguccugaugaugucuguguuugugugugugugugugugugugugugugugugugugugugugugugugugugugauggugugugugugggggggugcgguggcgcugccugugguuguuaugagaauucagugagauagccucuacccugcaaugguagcugcuauugcauucuuucccaaugaaagggucucuuucuguucuguuguuucucuuacuguaaauacaguacccuuugugacucaugagauugggcagggagauaaaacggaccucagcucaccuuagcucauucaacgaucuuuuuuuuccccuuuuuuucuuuuuuuuuuaauuucuuugaguuggagucuugcucuguugcccaggcuggagugcaguggugcgaucucggcucacugcaaccucugccuccuggguucaagcgauucuccugccucagccucccuaguagcugggauuacaggcgccugcuaccacgcucagcuaauuuucguauuuuuagugaagacagggcuucaccauauuggucaggcuggucucaaacuccugaccucaggugaucugcccucuucagccucccaaauuucugggauuauaggcgugggccauugugcccggcccagggcuuuuuuauuuaaaaaaaauuuuaaugccauaaucccuuccauuauugacauuuuuuacuuuuuguguaacucugaagguuuugcaauauggguaguuuggaauuuauuuuauaaucuugaaauauuaucaguugacauauguugucaugacgagaaagauuguguuggucaaagcuauuauugguuguuucuuuuuaaacacgagccacuuaaggaagcaaguggcugaagccaugauuguuagcuuccacuggcacuuugcauuuuucuuucuuuucuuuuuucucuucucuccucuucucuucucuuuucuucuuuuuuuugagacagaguuucacucuuguugcccaggcuggagugcaguggcaugaucuugccucacugcaaccuucgccucccagguucaagagauucuccugccucagccuccugaguagcugggauuacaggugcgcaccaccaugcccgguuaauuuuuuguauuuuuaguagagaugggguuucaacauguugggcaggcugcucucgaaacucuugaccucaggugauccaccugccucggccucccaaagugcugggauuacgggggugagcccaccaugcccagaccugcauuuuacuuucauugugaguuauuuuugacauaaacauaaauuucauuuucgucacuccuacacaaugcaggcauuggcaguuuguugaagggcaguucuguauggugauagauacugucuguauacaaagaugaaaacuguuuuuauaaauauuucugauugcucuuauuuucuuguucuuguggaaagugagaauguagccaaauagucauaaacaaaaccaagccccuaaucucuuuuaaaauuuugauauuauaucuuuguuuuuauagugugaauauuaucucuaaaggguauaaaacuuuuagaucaugagcuaaucaguauaaccagauucguuaguacaaauuugucauaaacuaucuggaaugcaaauacccuacuuagaauaaaacacaaaauucuggaacagggaauauaaaaaauaaucaaagcuuacaucucuuuuuuuuuccgagaugaagucuugcucugucucccaggcuggagugcaauggcgcgaucucggcucacugcaacaucugccuacuggguucaagggauucuucugccucagccucccaaguggcugggauuacaggcgugcgccaccacgcccagcuaauuuuuuuguaucuuuaguagagauggcauuugaccauguuggccaggcuggucucgaacuccugaccucaugauccgcccuccucggccucccaaggugcugggauuacaggcaugagccacugugccuggccaaagcuuacaucucuuuaauaacuuaugucaagcuuucacaggggucuguucuuuuugccuaacaugaguugaaucgggcuaugaauucaauuaacaccuuuuaauacuagaucaauuaaaagcauaaauugggcccuuguauaaauacagauugacuuuuauuuuuagaaaaagaaucaguaauuaugagauuuguauuuauaugaucuguuuagauuuaucauaugauguuuauaauaaaauuaaaagcauggccuaaauuugcagugaagaaaaaaaagaagagccacacauacaaagcaaaaugauuuuguuuuuauuauaaaucacauggaaacauuucuugaaagaauuagagccuucgacaucacaggucaagugauuauacuguuucugagucaaugaauaaugugauaccugcauuauuauuaauaauagaaauuucagaaccauaguaugugcugcauauggauuguguuuguucuguuucuaauagcuagaaaccagugccugaaagaaacuccaauuaaaauaccaguaaauucaacaggaacagacaaguuaaugacaggugucauuagcccugagaggcgguaaguguuugguuuuuuuagacucuaaucuuuaguauauguaaccagauuuccuuuuucauguauuaauagaccugauuaagguaaaucaucacauagauucuguuggagaguaggaauaucuguuuauguguggaugaccuguggccauuccuggaccuguagccacugccuuccucaugggguagaaucaugaaacugaucagcaguaggacggcaccuuaaguacaacaggcugggaagacagugguccucaccccagccaacuaguuaccucucugaggcccaucuuacccuucucuucugccaguaaaauacagauauccucuaacagauuguaguccucccaaaucguaaagauacuguuguuucaaagaaaauccucuguaugaaaaguucugcagcauagguaacucuucaaguugcuauucuuuuauagcaauuucuuaaaggcauugucuauuuucaagacaauuggagaauuagaauguggacaggguauuagaugauauuauggaauuauuauuaauuuauugaugaagaaacugaggagaucaggaauaaaaugauuuaucaaagcuauauaguacaaagcuggagccagaacccaggucuucucauuccuaaucuuaugguuuuucucccacagucuggaagugcuggagaacuaccuagaaagccaacuaacaccacaguaguuucuauugaaaaaugcauucagguuccaaaauauuuacauaacugaccauuuuuagaacauuauccguuaguauuugguaacugcuuagcuucucaauaauguguauauaugugguugaacuaguuuccuuaauuuuauuuaacauuuuucagugcaaugguacuaugguuuuuuuaaaucucagugucagugcuugaaauacuuaacuaucuccaaccagaaaaauuucagaacaaaaggauaaaauaugccuaauaaacagccauauguaacguaaacuucucagcacacuuuaugguguugucuuuauggaagacaacauccuuauucauuggagauguauacugaaguguuucagaguaaagugucaugauauguucagaugaguuacuuucagauggcuuagcaaauaaguaaauuuaauguauuaucuacauacauuaaauuuauguguauauauagauauauacauugauguauauauaucaguguauaucuauauacauauguacauuaauauauuaucuauauccaaauagaaagcaaauguggcaaaauaugaacaauuguugaaucuaggaggauauaccgguguucauuguacucuucuuugaacuuuucuauauauaugaaaaaaggauauauauauccuuuuuuaaaaaggaaggggauaaauaguuuugcugaguggcaguugccugguagaagugugacagcuccuguccagggggagauggcuuuggugcuuccugaggaagagagaggugaucuggcccuggcauaccugagugaggcauccuaauguguaugaagggacaaaaguucacccuuguggaccccacaggccggaggcccagcucuacuugugccuuguuuuauguuuuguuucaggugccgcucaguggaauuggaucucaaccaagcacauauggaggagacuccaaaaagaaagggagccaaaguguuugggagccuugaaaggggguuggauaagguuaucacugugcucaccaggagcaaaaggaaggguucugccagagacgggcccagaagacuaaagguaagcaggcuggaauucuuucauauggagcagaagcugacugcuaauggacugccuuuuuuuuuuaaggugcugaaugaauugauuaguguuuuuuauuugaguauuuauucacuuaguuaauauauguuuuuugagcaacuaaaaucugcauguuacugugcagucaguaaauagauacagucacucccuucaaggagcaaacagcuaucauucaaauauucaagaacagguggagggauuagucacaggggcaacauggaggugaggaagcagggggcacagauggagagcugagagcugccuuaaggagggggacuugagcucaguugugucccugauucauggauacuuuguaggcccucaugaaauauuugaaugcaugggaagauaauuggaacuuugaguguggugugugucaggaaaauagugagugacaagcggggaagguaggccggaagggccucaaggccuggcuaagaagguguggaucuuauuuaauagacccaguaugcuuuaaaaggguuaaugugucacugguguggacaauauauuuagucaaggaaggaaaggaaaaauaagcuguuaguugauauaaaguacuuuuuauucucuuggauucucucugagcauucauucaaacaucugaugaauacauguuuguuugguggaaggggaguaauuaagagguaaagggacgaaugagacagcccauuccuugaggaacucuuaggcuggcugugaaaacaggcugggauguuguucugaaacacugggcucagugcuauaguaaaaacacauuccaagaggugugggcccaagcaggggagaagaugguagugugcccaucauuuggggacugggucuauguuuaguuuuugcacugagacucucguaaugagcaaaucugggcgguuugagggaaggaaaaugcugagcuuuugggcagaaggguguuuuagaggagaauguucugugaucucauuucuguucugucuuaaaguggaagaagauaggaguuauccacuagcagucauuaccuugaacuuuuguagugugcugagacguuacauauggcuguguauuaggcauauuuuauccuuuuguucugaaauuucucugguuggagauaguuaaguauuucaagcaccgacacugagauuuaaaaaaaccauaguaccauugcacugaaaaauguuaaauaaaauuaaggaaacuaguucaaccacauauauacacauuauugagaagcuaagcaguuaccaaauacuaacggauaauguucuaaaaauggucaguuauguaaauauuuuggaaccugaaugcauuuuucaauagaaacuacugugguguuaguuggcuuucuagguaguucuccaguacuuccagaauguaggagaaaaaccacaggauugggaaugagaagaccuggguucuggcuccagcuuugugcuguauagcuuugauaaaucauuuuauuccugaucuccucagugucuucauuuguaaaaucuggaaauaaugccuacccuggcaaccucacacggcugagauguagaaacaagacucuacauaugggaugcuacauggcauauuaaaugcuuuaugaguauaaggugacauguuuccaaugucaaggauuacuaucaguguugagcauuuuaccacccauguauagacccaugguccuaauuagcacaguccuaagauugaaaacuuuaacuuuagaucauuaacacuuuuuaaugcuuuuaaguuuuugcaaaacugaaggacuuucuuugggaaauuaaccuuauuuuuuuucaccuacuucaaauacuguacuaaaaacuauacacuuaccggaagaguugcaaggauaguagaaauaauaccuuaguuuuuuaagauagcaaaucauauguaguuauguccucuuuuaggaagcagucuauaaaaaauccaaaauuuaaguagauaaauuaggauucauucuuuauuuuaccaaagcaguaauauauugugauuugaagguguucaguuuauuauuaauaucaucuuaacagagccaauuuaguuuggugaaaagagugcuggaucaggaaccaagaaagagagggucccuucguuaacacucaguuucacgacauuugcucuauggguguauugggugcacuauuauuuaucugguauuuucauuauguugacucuccuuuaacaaauggauuuauagagauauaacugacauauaauaaacuugcacauauuuuauuuuauuuuauuuguuguuaauuuuuugaggcagagucuugcucugcugcccaggcuguggugcaauggcaugaucauagcucacugcagccucaaccuucugggcucaagucauccuccugccucagcuuccugaguagcugggaugcgugcuaccacacuuggcuaauucuuaauuuuuuuugcagagacagggucucacuauguuacccaggcuggucuugaacuccugagcccaaguaauccuccugccuuggcuucccaaagugcugggauuacagucaugagccacuacacccggccaacugugcauauuuuaaaguacaauuaauaugcuuuggcauuauauauaacaucugugaaaccauugccacaaucaagauaauuuuuuaaaacucaaauuuauuuaaaaggaaaccuuuauaucauuaggguuuuuuuguuguuguuguuaauuauguuuucgaaaucaguugggaacaaauacauauuuaaaaauauuuauccaugugccacccagaauuaccuugucuaucuuguaucacacuaugagaagcacuaccuuaagaaauuuguaucucuucuuugggccauagguucuuauuuugaaaaguaagauaguuggauacuuuucuuccuaggcauuuuguuauuuauacaaugaacucaaaccugaaagauauagaaacuaugguuuuguuugacagugaagguacuuaccaggaagggagggauuuuuguguguccaggacccacuaaaacagugccuaccacauaguaaacauucaaaaguaguuguugaaugaaugaaggauaaauaucaauuaggaaugaaauuaucucugagaauuaggcucucagucaaugagaaaaaauaauaugacaucacuuuuuuaaaggaauaccuguuacauuuauuuccucauagaacugucauaaaaucagcuccuggaacucuauaauauucuuuaaauaauccagaaagaguuaaggaaacauauccaacuagguacaaagcaaacuuuguaugguguuuguuuaucuuuccgugguauacauuucaggacuguuaaugucucuuaaaauagugugggaaggggaaaauaggcaaagcucaaacaguuagaugggugcucuuuaauauuuauuucuuuaaaaggauugguaggagaggaagaugaaaguaugaaaaggaagcuauggguguguuuacuaauaaccauaacuucuccaagcucucccagugggccauuaacucacuaagaguugacuguaaauuccuuugauauuuuuuaggaaauaguuccauuugaaacaguacuauauugaggaguuuuggaacucuugaucuggugugauggucuuuguguugauguaaaaauuuacuucucaucucuucuuuuucuuuucuuagcuucacuauaacgugacuacaacuagauuagugaauccagaucaacuguugaaugaaauaaugucuauucuuccaaagaagcauguugacuuuguacaaaagggguaagaagcacauuuacaagcuguugcauuuauuaguaucuuuuggacuuugagaaaauaggaguugguugggcgcgguggcucacgccuguaaucccagcacuuugggaggcugaggugggcagaucacuugaggccaagaguucaaguucagccuggccaacauggagaagcccugucucuacugaaaauacaaacaauuagcugggcaugguggcacaugccuguaguuccagcuacgugggaggcugaggcaugagaaucacuugaaccuggguggaggcugcaaugagcugagaucacaccacugcacuccagcauagguaacagagcgagacucugucucaaaaaaaagagaaaauagaaguugaucuccucaccccugugcuuuagaaaaaauguauuucucccaccucauucccaaaagcuuuugagguaguguuauugcuuauaauuuauucucuuuuguuugguucaagcuauaaaaguuuuagaagcacagauauugucccacuuuauuucaaaauaggaaaauucaaaauucuucuggcuuucuuguagauccucuauuuuccuuugauugucugcuuuacaauaauauuuauaaauuauaaucuaaauuugugagacauuucaaaugaaucagggauuuauacagaauccuucucuucaugacuggcuguuuuacagggcuggguuuucagugcuuuaggaaguuuuuucaccuuaccucucucccgcuguugaaggaacugccaucaaagccuccuugguuaugaucuccuggucucaauagccaggccucuucuggucacccaagauggccguauuucuaagcauuuccauucaauuauuucccuuuaaaauuucuuuauuaaagcaaccagaagagacaugcauggauuuaaacauguaaauagaauagucaauauagaguaagauuugaagaaacaaucuugugcagauauaauuuuuaguuuuuaguuaucuguaaauguuggcaagcauuccuucugugaacccuggcauuccucucaggcuucauuagaacacaucucucccacucugaucucuucuucaugcuuggggcuaugagccucugggcauaccucugucacaggucucucaaugaucuauuaucuaacaugugacuaaauuguucuaugccucaucuucuugucaagaaucuuaacuucagggugcuccuuuuggcauuuuugauguugacugcuuauuuuugagagaucaagccucuuucccaaaacacaugacuaaguuaguaagaaaaagaauauuuugguacauaacaguaugaaacagaaaaaaguacauaacugaaacaauguaacuucuccacacaucuguggaacagcacuuaaucaggaacccuuaaguauuuagggaauugaaacuuaaaaucaguccuauuuauugaagauugguaagacaaacaaaacucuaaaauagaauguaaacuaauuaaauauuauuacaugaauuaaauuuauacagcuuugcaggaucauacguaugucuuaagauguguuucaggcuucauuuugacugggccuuuccauucucagaguagauaaugcggcaguucuaucuauaaaugccguacguuucaguuaugggaauauaccauuuccuugggcuuuuucuucugcuuuucuuucugccauaaagugaugugaugaucgucauaagagguuaucucucauuacuaauuagaaaaaccucaaaaacacacgugccuuucugacagguuacuggcuucagcuuuauuuauaugaaagacaaguuucugacaaggcucacacacaugaaauauuaucuuucuugcgcuuuccuuuguugugaauguuguggaaaugcccaauguuugcggauuacacguugaaaggauugcauaaagaaugccagauuucuugagcaugaauggcauguauagcuaugaaacaggggcuuuucuuuggagcaagggagacuuguaauaaagccuuuucaugcuuauucuuaggauccuaguucaguuucugggaaaacaccagucauacucuauuacuaaagcauagcuaggucauuuggaaacuguaaacaguaauacauugcuuaauaugaaauaaugguucauuuccuccacuggccuccuagaggcuuagaaaacucuuauacagaauaugguucuccuacuaacuagcuucuuaucuuguuuuucacaguuauacacugaagugucaaacacagucagauuuugggaaagugacaaugcaauuugaauuagaagugugccagcuucaaaaacccgaugugguggguaucaggaggcagcggcuuaagggcgaugccuggguuuacaaaagauuaguggaagacauccuaucuagcugcaagguauaauugauggauucuuccauccugccggaugagugugggugugauacagccuacauaaagacuguuaugaucgcuuugauuuuaaaguucauuggaacuaccaacuuguuucuaaagagcuaucuuaagaccaauaucucuuuguuuuuaaacaaaagauauuauuuuguguaugaaucuaaaucaagcccaucugucauuauguuacugucuuuuuuaaucaugugguuuuguauauuaauaauuguugacuuucuuagauucacuuccauaugugaauguaagcucuuaacuaugucucuuuguaauguguaauuucuuucugaaauaaaaccauuugugaauaua

SEQ ID NO: 191369 - RNA, 27308 nt, Homo sapiens
uuagaggcaugaauaugacaaauuuuuuauuucaaaaaucucaaguuguaaccagcauagcaccacugacauggaugccuugauagaacuccuugauagaacuuuaugaucuguucaccagaaaagauucuacaugaucacgccagacuauaauuaaggcuaaccaaucaaaauucagguacccaaaaccaguuauaauccagguagaaacuacagaucauaggaacccugggacugguuuuccagggaacccuggaauuauuuuuuaagugcuacagcauguacaaggacacuggcccacaagcuugcuucucacacguagaaacugacagacuaagagguagaugagagauuccagguuccaucuagcaguggagaggcagggcuccagcauguaucagagauaagccccaaaagcaaaguccacuuaugcuucagcagagguaagcgggcaggcuccuggcaccaccuccuccaaauggaagggaaggagggcugcaccgcucugccugugucacuggcuccucucccuggguccaggcagggccucucauuuucuccaggcuaacccacugugucccaagguuaaucucacaagacacuggucccuacaucauguaaaggguggauggggagccuccuaacaccaugucaacaugacugcuaacaaggagccacacacacaacugaauuucacaggaccucauauccuccaaugggcucuuucccacaucuacucgaaaggaaucguggguuucccuuugggcuuuucuuccugggaaucaguccaugggagaugccaagcgccccuggaacaugaaauuauccacacauguguaacugcacacucuagauuaacaggagagaaaacacgcucauuuuuguuuccagcuacacauacuuagcuuucuaaacacaaaaacugaauaauuuaucugauuuaugaaugaugguuugguaugucuaagaaagcuauauaaaacauaaaaugaacucauguucaugcaugaauuaaacugacuucaugaguucuagggagacgcauuaaccugugcuguuccccuggacgcacacuuggccucauacaggugccacuaacagcccugauggcagugucagaggacagcaaggugaggcuggggaagugaggcuguagggcccagagaggcccuagugccuccaacagucucagaugcuacuugauuacuucuaugcuaugggcugcuaacucuuacauagccuagaaaauauuuacccaugaacacuaccauguuuggauuucaaacaacuuuaaacauuugguaucagauugggggagcaacaaauaauaaaauuuagggucuguacuguuaaaaguauaguauauaacaguaauaaaaccuguguggggcauuuuugguuaaucugucgucgaaaacgguaaucuaaaccugggagaguugcuauauggggaggggagagugaagaaauggagaacaggcuuguccucggguaggaugugucagccuagacuggcccucaacaucuggacggagcaacagguaaaugugccauggaagaccccacaaaacaugacuccacaucagcagaacaaagacaaacacaagucuuuucugacuuccuaacauggaacuguaacaucuguaauacaaguugguuaaaauacugcucaaacagcacauagggaaacaauaccuugucacucucuacaaguacacacuccauuuacaauuugguuuuuaaaccagaaaaaacuguuaaaacaucuauccaacagugauguauucaaaaguauauacaucuaauaguccaagagaaugcucacucuggacccagugucagcaccaaagugcaguguuuaugacugcaaaucagguaaaaauaaaaaauacaguacuuugaggccuaggacuagcucaugauacacuuuaaagcauuuguggcagacagguguguccucaaaggccuuccuuuaagacaggcaccaaaucaccacugguuacacauaagugcauuuugcaucacuauacagggauauaauacucccaucagaagguauaggaaauuuaaaugcuacacaguuuuacaaaaauugcuaaaaaauuuuuuuugcacuucaauuuuuaaauuuuuaaaugugccacuuuuaauaucaauuacaaacuacuuucugacugcauuacucaaccccaaggaagcaccugguuucagggauugcaucccuuucccaagacgugcacuucacucagaaaugcagcagcacaaauacuacauguuaguucuccgguuauuaguugcuaaacuguuuaagagccacugggcagcuggaagccucgaacccaaaggcauuaacugcuuaccaaaagaaauucagucugacaacuggccucagcguugucuuguaaggacaaacagcuagagcaaagugcugggaagauugcugcucugccagcgcaggcagguagucuuugagugcuuauacagguggcuggacugacuaaaccucuugccacacuucaggcaggcguaaggcuuuucaccugugugaacacggaugugcuucuugcaaucugucaaagucagaaaaguuuugcagcagauuuugcaggcauacuugcgagcucccucuacaaccaaaacauugugcucugauaaggccuucuugcacuuugacagaacaucugcagaugcccuggucaacuguggagggccaggcugggaaggauggccauuuucaaaugaggacguagcuccauucaucauuagcugagaacugguagaguuuucugggaucugugagcuccugacggaaguuacaacuggcauuuugggagcuaugcggcgguaguaaggaaaguuacuggcuccuccccuuggggaaccuaucauuacccuggagaaggaggaguggaggcccaaaccagaccuggaaaaguccaucccaaacuguucuccuccuugguagccugaagucugcacacacggcaggcccaucaccuccugcauaggccugacgaagugggagucugcagguucacuaaauggguucucuacaugggagccaggggcagaggagggcccaccugcaggcccagccucuggacucaacaaauagggggccucacucuccagccugcagucacuagugguguuuggaauauuaucaucauuguucugauuugcaguaaaguuauuuccucugcucuuguuaagaaaauucgaaauacuaaaaguggacuuaugcucuagguuauuugugacuuccaaaauauggauaucaccuacccugucugugcuagacuggggaucugaaaaacuccgaucacugcuuucagggcugaggucuaucuucucggcacugaccacaacuccuuccacuuccacagacucgcugccuucugcuugugaggucacaucgcucacuucauccugaggcucaggugagcucaggggcucagauuuaaccaccacucucaugugcuccuucucaccaaggccaaccucaggguuuucacacugaaaacuacuuuucucaggugcagcuuccugaucaaaacuagucucaaccugaguugcacgagaggccauggacaacugugccauguugccagcacuguuaucagacuggcugggcaccugggcaucuucuugagugccaaaagacugaucaaacaugaucgcacuaucuuccugguuaucagucauuccaucagcuuuaggauuauccacaauuuucagagaaucuggugaaaagaacuccucccgagaaugaaccccugaaggcccauucuccgguguaacaucugaaauggcagacucaucuauggagggucggaggcgcugccuggcccgcuccucugcagacugcuugcgcuuaugaaggcgucucauggggaagggcgugcgcugauccagguuacugcgcauggaagagcucaugggggcuggcugcuccucgccauucuggcuggaauugagggcugagcucacgaugcuuagucccagcugcuguagcauaaaggagcgcugcaugcgggcgcucugcuccugaacgcgcucacuggggggagacaugggcagcguccuugucguuaaguaauguuuacaugccuuaacaacagaguucaaaugcaggugagaggcugccaauaagacauccauuacauugcucucccccagcaugaggguggagguauacaucaugucaaucagugcagcaaaggccucugcugucaccaccucgcuauccagcuggaucauguucauggucugaucuccuucugccacugagaacagggcucggaaaugcgugcugcaugcugccagcacggagcggugggcuuuaaagugucuauuccccacuacaaugacacaaucacagagcuggccaugaagucucugguaguucagcugcuggaagauuuguucaaagugaccaggaaaauccaugauccuacagaaaaacaaagaaagaaaauguuaagaccuagaaaagcuucaaagucagaacacaaaggguaugaugaaaagaguggaauggauggccaagcuuggaccuuugaagcccgugauaucucugauaaugggcacauacacuaagagcuugucauauaagaagcaaauggcaauucagccaucagcccaggaggcaugcacacaugugggccuagcuaccgacaggcuccccuuuacucuucauaugagccauguauaacacuaagggucuaaauuaguaaagaccagugugugagugauggcauaucuaucccacagaaguuuguuagaauucugcauucccuaaggaugaggaaugaauaccaagaaauuccaaagucuuaggaacccuaaauaagugaaaagggcaaaucaauauuaguguggaagauuuccaguuauagaugguagcagauugcacacacgcauuugccccgugcuuuuuccugaaaccccacuaaaaugacacgaagcccggcauggaggcucaugccuguaaucccagcacuuugggaggcugagacgggcagaucaccugaggucaggaguucaagacgagccugaccaacaugaugaaacccugucucuacuaaaaauacaaaaaauuagccaggcaugguggugcaugcuuguaaucccagguacucgggaggcugaggaggcggagguugcagugagcugagaucacaccacugcacucccagccugggcgacagagugagacuucaucucaaaggaaaaaaaaaaaaaacacuaaaguuuuuguuuaaacuuuaaagguguaaacccacaaggaaaaagagaaugagaaggccuucaauagcauuuuggaagcuggggagagguaaaugagugcuaacugacucagcacaccccaaaagcgaaaauccuaaacugggcagcggauaaaacaaccuaacauauauaaaucucauucccaaaggccaaggaacugguugcccuugccaggggaaauggaaugaagguguggcuaaggcaggaggccuggcugaaaaucuauccaauuaaaaaaaacaaaaacaaaaaaacaccaggaugugguggcgcaugccuguaauccuauagcacuuuuggaggcugaggugggaggauugccugagcuuaggaguuugagacaagccugggcaacaaggugaaacccugucucuaccaaaaauacaaaaaauuagccgggcaugcugguaugugccuucagcuacucaggaggcugaagggggaggaucacuugagccugggaggcagaggcugcagugagcagagaucgcacugcugcacuccaaccugggugacagagugaaaccugucucaaaaaaaaauuagccgagcaugguggcgugcaccuguggucccagcuacuugggaggcugaggugggaggaucacuugagccugggaagucaaggcuucugugaacugucacugggccacugcacuccagccuaagcaacagagcaaggcccugucucagaaaauaaaauaaaaauaagugaaugaauaagagaaggaauuaaucagguccaauaucuugacuacagaaagagaaaaggaagaauacagagggugaaaaugauguaagaaaugguuuuuuguuuuguuuuugagacagaguuucgcucuguucccccaggcuggaguacaguggcgcaaugucggcucacugcaaccuccgccucccggguucaagugauucuccugccucagccuccugacgagcugggauuauaggugcacgccaccacacccggcuaauuuuuguauuuuuaguagagacagggguuuuaccuuguuggucaggcugguuuugaacuccugaccucaggugauccgcccacccuggcaucccaaagugcugggauuacaggcaugagccacugcgcccggccaagaaaugguauuuuuuaaauuuugagaacugaagaaauuugcuuauuaagacuaaaaaggcccaacaaguacucaaaauaugaagauacaaauccccacacuaggcugacaucaggaauaaaauuggcauucgucuuugccacagcagcacuaaaagcuagaagaugacaguuccuucaaaauuauccaagaaaaugauuuccaacuuagaaugccacacccagcuaaacuauuaaucaauuaggauaaacuaaggcauuuucagauaagaacccaaagguuuauccuuucucaggaggcgacuaagauuguaggaaacaggagacccaccagagaagacaggcaaagggaaucccaaggaugaugaugaagcuccagaugacaacuaggcagcaggccuggagagcaaaagcagucagacuggagcaggaaggacuccaaggagugggucuccaaggggggugggaaaaaaaggaauggauagauaaccugaugugacugggagugcuuguaauuuaccaguccuauccaagugugcagauaggucauuaaaaaaaacaagaaguuuuuaaauggaucaaugauuaacuccaggaaaaaaaaaaaagguuguuuacucacaggacacaauauguaguucauucguagacaauauuuacacagucauaaaauauguacacuaaaccgaaugugagauauugggaggaugagagaaagcaacuuugcaugggggaagaggguagaggagaugagguauaauaaaguuaaaucuucacuuuccuuauuaaucuagaaauacagucugaaauagguuaucucaaaaaauaguaauuuggcauguuauuuagaaguauagaaguuaaccaacuuggugguucacgccuguaaucccagcgcuuugggagaccgagguaggugggucccuugagcccccaggaguucaagaccagccugggcaacauggggcaaaaccccaucucuuacuaaaaauacaaaaacaauuagccaggcauggugguaugugccugcagucccagcuacuugggaggcugagggggaucacuugagcccggagucagaacuugcagugagcagagaucacgucacugcacucuaaucugggagacagagugagacccugucaaaaaaaaaaaaagaaaaaagaaauauggaagucaauaguggaagaaacagcugaaauaauugaaagugguugccucugaggaguggguaauugauggggaaaaggaugggacaggggacugcuguuuuguuguuguuuuuguuucuuuuuaccuauaagccuuauggaacuauaggcugggugugguagcucauggcuguaauccuaacccuuugggagacugaggcgggcagauuguuugagcucaggaguucgagaccaccuuaggcaacauggcaaaaccccaucucaacuaaaaaugcaaaaaguagccggccaugguggcgagugccugccauguagucccaguguacuugggaggcuaaggugggaagacugcuucagcccagggggcagagguuauagagagcaaagaucgcugcacugcacugcaaccugggcgacagagcaagucucugucucaaauaaauaaauacauaaaaauguauacacauauauuuauaaaauuaaauuuaaaaaagguagaucuaugauauucuaaagggauauaccugagaucuuugcaaaucuccaaaauucacaaauaccaucauggcauuucauaagaaggcagcaugggugccaaguggcuccccaggcccaaccacuugcucugaugucccagccauacagccuuacaggccaaaguuggucaggauccugggaaauaacugaaauggcaaacuaaguccacaaaauucaagggucuacuguggcgacugagacuauuaugcuauucagcuauacuuggaaaguuaacuaucggaaaagcaaaugccucaaagcagcagacacauguuggccauauuguuuugccuauguuuguugagcuuugaugaacuuucaacaacaaaauagaucacacauacuuucccacugaggugucuguucuuugcuaucauguaugagagaucagaucuccaaagaugcagccacugccacaucccuucuugcuuuaccaagcuuuccggcagaaagcagagagccagcaguggcaggcagcagcacacacaucccggguccccacccgacucacucagggcccacagagcuuaaggcuuuggggagauuaaacaaaaugcaauuacugcucauuaagucuauagcccugccuuagaaaguacacucauauaugaauaagugccaaguuccagagggguaauuauuuuguagcaguaacagggaagaaacauucugguuugaggaauaaaauaaacagggaauuguggugggaaguuguacaagacucagaguugcucuucuaagcgaccauggaagcuugggcucaacaggcaaaaacaaggaacacuagacacucagcguuacugcuuucucuccuacaguggggaauagacccaguguauuagucuguuuucaacugcuauaaagaaauacccaagacugggugauuuauaaaggaaagagguuuaauugacucacaguucugcauggcuaagguggccucaggaaacuuacaaucaugguggaaggcaaagggaaagcaaggaccuucuucacaugguggcagaagagugugagugugugaaggagaaacugucacuuauaaaaccaccagauguugugagaacucacuaucaggagaacagcaugggggaaaccacccccaggauccaaucaccuccuucccuucauguggggauucaauuugagaugagauuuggguugggacagagccaagccauaucacccagcauuguaguaacagucucacuggugacaguaacagagguaaugguagugguaauaaaauauauauuuuuuacugugcuuuuuuuuugagacaggguuucacccuguugcccaggcuagaguacaguggcaugaucauagcucacugcagcuuugaacuccuggcuucaagcaauccuccugccagccugggauuacagguauaauaacaguaauuacugagagccugacagucauuaugcuaaguacuuuuaauuuacauuauuucuaaucuucaaaacaacaguggcaggugggaauuauuuuccugaguuaauaggugaggggggccauaaaagacugacuucacaaauaaauaguauuucaacuaggcauacugauuuaaaagggcacuaauauucugcucaaugcuucuuuuuuuuuuuuuuuagauaagcaaaagaacuuauaugagaaaaauggcuuacuuaaaaauuacggggcugggcaugguggcucauaucuguaauucccaguacuuuggaaggccaagaugggaagauuaccugagccuaggaguuggagaacagccuaggcaauauggcaagcccucaucucuaaaauaaauaaauaaacaauuuuuuuaaauuguggucccagaaacaccauuuugaggaaauuuuccaagagccaggggaucuuugaaaagaggcuacugagguagcuaaacacaaccccaacaaagauaaaagguuuaaguaauacuggaagacaggcaaacaguaccuacaaucuuuuaacuucccaucagccuagagauccucagcucuacacuagaucccccaucacaggccuugagaccaacucaaguucuccacauuccucucaaaacacuuuagggaugcuuggaacuuccuguuauaccuuguuggcagaccaucuucaggcaauacagaggcuaaugucugcaucauaacuaugauuccaccuugggaaagugggaaucacaauuugcagacuauccaaaugugaaggggggaaggggugcucagaagauucuggggagcugcaaaugacagauguccaccuagcaucccucugacaaauagggccccucuacauauuaauccaugugacuuuggaaaugcauaguuuuacugaguaagaggugaucuuccuggaaaugaaagaaagaaccaaacaacagaaggccagaugaguugguguuacacuguaacaucuucaauuagcaauuuauuaaguccugauuacucugccauggacagcuaaggaaguagaguagauuuucuuaaaaaaggaacucuaaagaaauuaaaacagaaaauuuaaaacuauuugucaacuuauuuaaaaauaguaauaaacgauuacagccgggcacaguggcucacgccuguaaucccagcacuuuggaaggccgaggugggcaaacacgaggucaagagagcgagaccauccuggccaacauggugaaaccccgacucuacuaaaaauacaaaaauuagcugggcgugguggcgugugccuguagucccagcuacuggggaggcugaggcaggagaaucgcuugaacccagaaggcggagagugcagugagccaagaucacgccacuguacuccagccuggugacagagcgagacuccguuucaaaauaaauaaauaaauaauaaacaauuacauguuaacauaacauuuuaauaaacaacugggccgggcacgguggcuuacaccuguaaaacuagcaccuugggaggccuaggugggaggaucaguugagcccaggaguucaagaccagccugggcaacguagugagauucuauauaacaaaaagaaaaaaguuauuuaaaaaauaaauaaauaguuuccaaaaacauaagagggguauuguuuuauauuuuggcauuaagagaagacaacuggauucucauauuugcuucugcauucaggcuugugguaucacacauugcacggccuacuccaugcacuccacucuacauucaugaaagaaugaguaaaaaaaggccuggugcgguagcucaugccuguaaucucagcacuuuuggagguccaggugggcagaucacuugaggccaggaguuugcgaccagcuuggccaacauggugaaacccugccucuacuaaaaaugcaaaaauuagucaggugugguggcacaugccuguagucucagcuacucgggaggcgaggcauaugagaauugcuugaacccaggagguggagguugcagugagccaagacuguaccacugcacucuagucugcgcgauaguaugagacucucaaaaaaaaaaaaaaaaaaaaagaaugaguaaaaaugauacaggaauuaaagacaaauuaagcagauagugaggguaagccagcccucgguaagguuuuccuuuuaauaaaaagcagccccaagugauuuuucuuucuaacaaagagcagccuguaaaaucgagcugcagacauagaugccagcaguggugccaaucauguucaaaaugguggcuucaucuucccuucucuuuuucagcaauguguacgguaagcagcagacaauggggcaggccaaggggaaagcccauuugcauaauaagauuaggguggaauggccagccuuccccaugugcuauauaaacgucacacgugaucaaaccaaucugugggcccuacguaaaucagacaccaccuccucaagccugccuauaaaaucuggcaaauucugccaccggcuggucguuuccuuucagaagcuccucugucucacuagagagagagcuguuuuccuuucucuuuguuucuuucuuuggccuauuaaaccuccauuccuaaacucgagugugucugugucccaaauuuucuuggcccgagacaacgaaccccagguauuuaccccagacaacgaagcugcuucaaaaaaaaagcaaguaagucuuuguaucauuauaaaaaguucugaccucacagaccccuugaaaaagucuguggggcccauacaggucacuggacuauacuuugcgaauugcugaucuaacaaaaauuuuaauuauauuuggaagauagaagaaugaguaauaugcauugagcaaaacuggcagaauuacaaggagaaauuaacaaauucauaaagaacaguauuaccuuuaaccaaggagaugucaauagauaaugccuaaacugaaauuaagaauuagcuccugccaggcacgguggcucacacuuauaaucccagcacuuugggagaucaccugaggucaagaguucaagaccagccuggccagcauggugaaaccccgucucuacuaaaaauacaaaaauuagccaggcuugguggcacguaccuguaaucccagcuacucaggaggcugaggcaggagaaucgcuugaaccugggaggcggagguugcagugagccgagaucacaccacugcaccccagccugggcaacagagcaaaacuccaucucaaaaaaaaaaaaaugaauuagcuccaagcauauuauuuaauauauacauguaauuaccaaaagaauuagcuaagaguugaaaaugguagucuuggagaagagaaaauggaaaacaggaaccugggcaacauggugagacccccgucucuaccaaaaauacaaaaaaauagccggguguggugaugcacaccuauaguaccagcuacucaagagacugaggugggaggacagcuugagccugcagggguggagggugcagugagcugagaucauaccacugcacuccagcuugggugacagagugagacccuaucuccaaaaaaaaauuuaaaaagaaaagaaaauggaaagcagggaagguaaggccugguguuugucuuaaaucuuguagaacuacugauucguuaaaugauguucacuggcuaggcacgguggcucacgacuacaaucccagcauuuugggaggccgagguggguggaucacuugaggccaggaguuugagaccagccugaccaacauggcaaaacccugucucuacaaaaauuagcugggugugguggcgcaggccuguaaucccaguuauuugggaggcugaggcacaacaaucgcuugaaccugggagauggagauugcacugagccaagguagugccacugcacuccagccugggugacagagugagacuaucucaaaaaaaaaaaaaaaaaaaaaagacagacgugcacuuagcaaauuuacauauacacuuuugguaagaugauaaauguauaaagaaagccugaauagacuauaacgacacacauacaauuagaaaaaacugucauuaucacccccuaaaaagcuuuuuauccuuaaaagaguuuuuaaggauaauuugguggguagggggccagugaguuaggagugcugauugguuggcuuagggaugaaaucuagggagucgaaguuguccucuuaugcugagucaguuccuggguggggaauacagaacugguuggcagguccagguggggccauccaguugucagaaaugcaaaagccugaaaagacaucucaaaaggccgaucugagguucacaauagugauguuaccuucaagaguaauuggggaaguugcaacucuuaugaccuaccuaaugauggcugguaauauuuagaaucccaaccccucucauucuaacuugguggcugguggccuuucauuuguuuuacaagaacaguuuagcuuuaaacuguaaacaaaauuccuucucaaggcuaguuuggccuacgcacaggaaugaacaagaacaguuuagagguuagaagcaagauggggucgguuaggucugauaucuuucgcugucauuaauuuucucaguugugauuuugcaaaggcaguuucaauugcacugacugaauuuuaagauaagcuauuuaaaauaucuaguaacagaagcauaacucacaguaaaaauggggucaugaguuaaaccaaaugcagcaugaguuaaaccaaauacuagcaucauuuuugauauauguuuuggccauccccaaaacccagaagucaauauuccaagaauuaguuggaaauagcaguguauaucacuacuaauaugaagcucaaaagugauuccaaagacuaugaauacaaaggaggcuuagauucauacuguuuuaauuaggguuccccagaggcaaaucauaagagaaagauucaagugcaagugauuuaucaagaaguucccaggagaaaaugggaguaaggagcaggagaaggaagcagcagccaaguaaagguauaauauggggcaaaaucccagccuuaguguguucuagcaggggugcucuggaguauaaacaaugccucugaguuugagccaccucaaggcaaaggugcuggucuuucauagcccugcagucacucagucaaugacuaaaagccucccuagggcaauguaaacugccaggcacuucugguucucugggcccaugcacaaagugaugccagucacccaaagacaguccucaagagucacagaugcaagcuguuaagcacacaauagcuauaggaugggugcacagaaccgguaauagggaucaaggggaucuggucagagcuacacaguaucugcuacacaccuggugauacuaaaaaauaaaguaacauguaaccauauggauaaacagaugcuacugucuauuaguaaggaauauucuuguauauuuacaucauauagguugcacucucaauccccuaccccugucccauaaccauuaggugaacaagaaaucucuauuccuucauuggauucuaagaugccacaugucugucugucugucucucucucucuuuaaauagugacagggucuugcucugucauccaggcuggagugcuggcacaguuauagcucacuacagccuugaacuccugagcuuaagcaauccucccaccucagccucccguuggcugggauuacaggcacagaccaccacacgcagcuuuuuuuuuuuguagagacaagguucccuaugauggccaggcuggucuugaacuccugugcucaagggauccuuccgccucagccuuccaaaguguugggauuacaggugugagcaccaugaaguuuucagaucuguuacacagcacuaaguaacuguaacggugugaaacuuuuuuaccauuuccccacaaaucaacauucaaauacuaucuccaccuuuucggggagagggggucccucuaugucauuggagaaaaucacuucccacccauucuuaguccaugaguccauguaguacagaucgaacugccccaaacaccugaguuuaccaggagacggaggauccagggagacccagucaacuugguacccacucuccuugauuacagugauuguuucagacaaucacuuggguaugugacccaaguucugccaauggagucugccugugggcuuuugcugguauaucaagaaagagacuaucucaacccagauuacaaacugugagggaguuauaaauccagcacugagagugaccauuuuugccuguuugagaacgaagccaacacagaagagagugauaccaaaaacacuguccagaagguaucaagacucuggaauccagguaugacuaaaguuggcaccacccuaggacuuguuucaugagccagugaacuccccuuuuaccuuaaccugguuuguguuggaucucugccacacagucaaacaugaaguucaaauuacaucucccaggaaaaccuauauaauacagcuaucucaaaaccuuuagaacuuuuuuggaucuagagggaauauuuuaaaaauucaguucauuugggggauauaaaauuugcuauuaucugcucugauggaagggaaucaugaaucaagaucauucuuacucagaacucucaaguaauucuagcaaagucagaaggccagucuaaaagccuuaacagagcucaggcugaguaaauuaagaguuuuacccaaagcugccugucugaagccuucuaaccaaggaaaaaggcuucaggucucuuuaaaaggcuccaaaaugugacaauaugagucaacauagcuggaggagaguguggcaagcaaucuacugauguauaacugugucuaacccaaagcaaguguaaaguucaguauuuguuaucugcaggaacaaauauuuaggaauuucaaaacuaaauauaauuaagaaaauacacucucauuacuguccauuacauuaacaugaauaaucaaaagaugacuuuucucaauagauuuacuuuucuaauaaugcuuuacuuaggcuaauaaaguuccuuucugucuucggagaacaagccagcacauuuuaaacuauuuaauuuauacacugauauacccacaugcuucucaauaauauacuucauucauaacaaaaaccgcacccauacucaaacaucaucuacuaccauaucaaguaauuugcugcuugccugccaggcaggauccacacaguugucaccugcagaaagcaaauuaacauucuaaggaauccuuaacauucaguagcccaaucuagauaaaacccuagcagauccuacuucugugugggcucagcaaaaacaaaaacccuagugauauggacaggagacagggaaaugcuggguagaagaaggcaguaccccagcuaaggccccacccucaagccuggaaaccuguggcccuaaaugggaacaggcaucccuguuuuugcacccaaauguugccuuuuggccugccacaccaugcuauccuguacacauauaaaccccaaaccccagguuccacaggcagaugagcagacaaacagaaugugcagaggagcauaagagcagcguggccaaggagagaagagaaggagcaucugaaugucaagagccauucagcuggggauggucagagagaucggccacaggacagccgaacuccaggggaagaucaucuucccacuccauccccuuuccagcuccccauccaucccacugagagccaccuccaucauccaauaaaaucccgaauacaccauccuucaaguccaugugugacccaauucuuccuggaugcuggacaagaacccaaauaccaagaagguacugagcugguuaacacuuaacccaucugcauauggcaagcuaaaagagcacuguagcaugcccaauggggcuucgggagcugcaggcacccaccccuagaugccaccguggggccagagccuaaaagagcuugccccagcuccugccccugccugucucugugcuccuccuccuguaaaggguuuuagcagugguggcagccaaacagacgagccacaucauugucacacguccugcgagggggguucagagaacucucccauuucaucagcagaaaaauaacuagacagaacauuuccuccacuuguagagacgauauagaugaaaacaaaagucagagagcagaacaaagcaaggacccacucaaguaggcuaggauuuuuuuuuuuuaaauacagguggggucucaauaugcccaggcugcuuuugaacuccagcgcucaagcaauccuccuaccacaggcuccggaagugcaggcuaggauuuuuuuuuuuuucuuuuuuugaggcaggaucucacucucucacucaggcuggaguacaguggccugaucacgguucacugcagccuugaccucccaggcucaaggugauccucccaccucagccuccuggguagcugggacuacaggugcgugucaccaugccuggcuaauuuuuguauuuuuuguagauaggggguuuugccauguugcccaggcugguuucaaacuccugggcucaaucaauccaccugccucagccucccaaagugcugggauuacagccgugagccacccacccaccuggcccaggcuaggaauuuugacagggcuccaagucagacagagcggaguacuggaacauccauccauuguucuaauuugaccagcaaagugggaguaggggaaggcuggaacuaggugggcacaaugaugccuggguuaaccccaagaaaccagaccugucagcaugacuaaugucauaauaucucugguucugcucugucaggguuggcucagaaacugaacagauuaguucuauaaaacaggaaaauuccacuagugacuaaagaugagcaugacugaggaaggcgagcuggaagcccugaccaucucaccuaacucuccaauucucuccacauugccaccuuguuuuccaggccaaaaucccuagggaugaauugaccuagagcucuguaacucaguuugaauaagaaaagguauuagugcccuacuuagguuccuaguacaagcucaaaugcuuuuucuacuaaaacagcuuauugagggcaggaacuguauuuucucucucucaaagugccugacauaaaauacucaguaaauuauuugcugaauaaacuuuugcuauauauggaugaaguauaauguauuacccaaaaaucacuuuucugagaaucacaacuaucucuaaaaucagccaaaaaccagaagaaaaagucucagaauauccaaaauaaagaucaaagacuauggaugaaagauuuucucauaggaaagucccuuaagcccucacacagucuuuuguucgaaacaaaauucaaguuuuucuaguucccuaacuaacugaagcagcaacuccagaaugagagcaaggaguggcugcuuaaaugaaguuaagcugauagcugcagaaagagacagcugacccacuaagggggaaaagaggcccagcagcuuggagcuagguaguauacagcucaagggaccucaacagcccauaaagguacuuguguauuuuuuguauacaaguucauucauguaauauguuuuuuguuuuguuuuguuuuugagacagagucuugcuuugccacccaggcuggagugugguggugcaaucacagcucacuguagccuccacuucccuagcucaagugacucucccaccacagccucccaaauacugguacuacaggcacgucaccaugcccagcuaauuuuuuauucuuuguagagacgggucucacuauguugcucuggcuggucucgaacuccugggcucagguauuccuccuaccuuggccucccaaagugcugagauuacaagugugagccaccaugccagcaucaucuaauguuuuaaagugcuuacuuguucaagguuaagcgcuguggagcauagauuuguaugggacaguacuaacugucacagguauuuaguggaaauaagauauacaugaauaacgauauuacaaaguggaaggcacuaagugccacauaagaggugaaagaaccucucaaugguuuggagaaggcaaagguuauuucuagcuucaugguagcguugacaacagagcuaggucuugguuggauuuggacaaaccccuagacagagguaaagguggagaagggguugagguggguaaagcaauguauucgauuuggcuggaaaauaguauggcuagaaagguagguauuggauagugacugcucauaacugauguuaauaauuacaagucaucagaaagguuaaccaugaggcacauacuuuugaacuaaaggcuaucaucacuuuugagauuacuuucuuaaaaaguauuuuaggguuuuuuucuuaaguuuaagcagcacaucagccagagucauugguugcagcaacaaaaauugauccuaaacauaaaaguaauuuacugaaaggcuauuaguuugaucauggaauugaugggaaggcuggauacguaagauugaacugggaagaaauuaagcuaggcagcaggaacaaucaggucagaaugccaaacaucugugcugaacacagcuacuacuaaccaaaugcucacuccaauggagacccagccuccccuucccuacaucuguuauuaagucucaacucuugaguaccuguuuucaauaugugugauaaaaugggaaguacaccugaaguuuuccuccugcauucugaaauacaaguugccucaagaaaaagcacuugugcaguuuuugagguggcucaacuaauugcuuuucucaugggacacuauuuuuacuugaaagaacgaaugacaaacuaugguuauuuagaaguauuuaccauuuucuugaaaaugaaugaaaaaaugaaugaaacaagccuguuauuuuaaauaagauaacuuaguacuacuuauugccaauaaaaaaguuugagaauucaggugaaaauuaguauuuuggaaaacuuguaucugucacugugagcuugacagcuucccacaugcucaaauucuucugacagaucauuggugauauuaaugaaaugugauuuuuuuacauuguauaauaaaugagucaacguuuggaagaucugcauaacucugaaaucaguauuuuccaaaugaccauguagccauguaacaauaaugcuauaaaacaagguauggguaaaaauucauucaagguacaaaacauaagcuaauguauuuuaaugcaacagaauaugaaaaguucauugacauaauuucagauuccacauugcacuaaucacuuaagaaaauaccacuuguggaguuuugguacaguaucagaguaagaauauccaaaauuaucugaaaaaucuacugaaauaauccucccuuuccaacuacauauuugugugaugcuggaguuuuuugguauauuuuaaucaaaauaguguaucacggcaaaaugaaugcagaagcauuuaauggaauccagcugucuucuauuaaacuacauauuaaagagauuuacaaaaaauguaaaacagggcaugggcaugccagccccugcuucucagccuguacucccagcacuuugggaggccaaggcagguggaucaccugaggucaggaguuugagaccagccugaccaacauggagaaaagccgucucuacuaaaaauacaaaaaauugguggggcguggugacacaugccuguaaucccagcuacucgggaggcugaggcagaagaaucgcuugaaccugggaggcagagguugcagugagccaagaucgcaccacuguacuccagucugggcaacaagagcaaaacucuaucucaaaaaaaaaaaaaaguuuucuuuucuuuccaaucccaacugauguguagcauaaacaacuuuuaaacaugucuuuuaccccugacagaucaagaaacuuuuuuuuuuuuuucaggcagagucucacucuguuacccaggcuggagugcaguggcacaaucucagcucacugcaaccuccaguucaagcaauccuccugccucagccucccgaauagcugggauuacaggcgugcaccaccaugcccagcuaauuuuuuuuuuuuuuuuugaaaugagucuugcucuguugcccaggcuggagugcaguggugcgaucucggcucacugcaagcucugccucccggguucaugccauucuccugccuuagccucccaaguagcugggacuacgggcgcccgccaccacaccuggcuaauuuuuuguauuuuuaguagagacgggguuucaccuuguuagucaggauggucucgaucuccugaccucaugaucuguccgucucggccucccaaagugcugggauuacaggcgugagccacugcgccaggccauuuuuuuuaauuuuuaguaaagacuggguuucaucauauuagccaggcuagucucaagcuacugaccuugugaucugccuaccucagccucccaaaaugcugggccuggccaagaaacuucuuucuuaaugaaaaaaauuaguccagcuaggcacaguggcucacgccuguaaucccagcacuuugggaggccgaggcggguggaucaacugaggucggaaguucgaaacuagccugaccaacauggagaaacccugucucugccaaaaauaaaaaauuagccgggcaugguggugcaugccuguaaucccagcuacucgggggcugaggcaggagaaucgcuugaacccgggagguggagguugcagugagccaagaucgcgccauugcgcuggauccagccugggcaauaagagugaacacuccccccccaaaaaaauuaggccagaugcggggcucacaccuguaaucccaguacuuugggaggcugaagcgggaggcucauuugagaccugcuugguuaacauagcaaaaccuuuucucuacaaaaaaauuuuuuuuuaauuagcugggugcugggcaugguggcucacgccuauaaucucaacauguugggaggccaaggugggagaaaugcuugaguccaggagucuaagaccagccuggaaaacauagggagacccccaccuccacaaaaaauacaaaaauuagcugggcgugguggugcaugccuguagucccagcuacuugggaggcugggugggggaggguugcuugagcccaggaguuuggggcugcagugaguuaugaccaucccacuacacuccagcccaggugacagagcaagacccuaucucaaaagcaaaacagaacaaaguagaaagaaaaaaaaaaacuaaacuuuuaucaagaugaaaacuaugacaaagcuuuggagacacuauuauuauggugccuuuccaacagagaagaugaacauggacuuaauccauuucuuacaccuaguuuacuuucaaagcaguauaugccuucacuucucaaucauuuaucaaaucaauaaugcucagcaagugaccuucacuugaccugcagaguugcuuuugaucaucuauucaaaauaaguacaaucuaaguaacuuaaauguguuuagauuuuuguagcauuucugggcuccucccacaaccaaaugcccaaacacuggauuuuguuuuccuggucuuccuuccucaaauccucuucgcaaaaaagacuaaaccauaaggacuauaaaggugaaagccuuguauuuuuagaggaagaugguugaguggauuuuaaauuauaauugacuaagauguacugaaaaauuaauuauaccaugucaacaauaucaugcauagaaaaaaaggggagcaacucacccuaaacauuuuaaacuuaagaaaauggcaaucagccaggugcaguggcucucaugccuguaaucacgcacuuugggaggccaaggcagucggaucaccugaggucaggaguucaagaccagccuggccaacauggcgaaacccugucucuaccaaaaaguacaaaaauuagucgggcaugguggcacgagcuguagucccagcuacucaggaggcugagacacaagaaucauuugaacccaggaggcggagguugcagugacccgagaucagauuaugccauugcacucaagccugggugacagagugagacccugucucaaaaaaaaaaguaaauuaggaauaaaggcauuuguaaaccuguuaccauacaaaguaacagauuaccaaguauaauuuccaaaaaguagaccuaucacuuaaucauccuuuaaaauuuguaaaaugaacauuuuauuuguuaauuuccauuuacauaaggaaaaauaucacgcucgauaggcuucuuuucaguaacaaacauuuuccagagcaggaaaacgaauuaggaaaauuuauugguuacaauuacaaggaauuaguuggguacaaaagucucuuuaugggggauaggcagccaggauuuuacuauguugccugggcugguuugaacucaagugauccuccugccucagacucccaaguaguugggacuacaggugugugccaccugagcuaaaauucuauuaauuuuaccaaauuucauuaaaucuaagaugucugugauuauaaaaugcauuauuucauguaacacuaggaaaaaaacugccaauuaagcuauggcauaaugcuuacuuaugguauccugucuucaaggaaggaaaacugucugccaaugacuacuaugauagaggcaggagacagacaaaugccuaggcagacaggggcacauccccagugaaaccccaccuccaagccgaagacaguuuaaaagcuugaaagccaagcuacaagucaaauccacggaccagauugagaaccuguguucccauuuggcaugcuuuccucugacugauccccacccuucaccuauuuuacauauaucuaccccuuuccuaauugguuuucuacacugucgugcccaccuuugaguggugucuuugcuuuaaccguuuuuuuuuuuuuuuugagacagggucucacucugucuccaagacuccaagugugcaguggcaugcucucagcucaaugcaacuucugccucccaggcucaagcgauucuuccgccucggccuccugaguagcugggauuacaggcgcacgucaccaugccggguuaauuuuuguauuuuuaguagagacaggguuucaccauguuggccagauuggucuugaacuccugagcucaggcaaucugcccgccucagccuccccaauugcaguaauuacaggcgugagccaccacacccggccuucccuuuaaacuuuuugcaucagaaaccaaucagcacacacuccccauucugagucccuaagaagccccggaaccagccacacugggaaagagaccacccccugcaugcccucuucucugagagcuguuccaucacucaauaaaauucuucucugcccuccucacccuucgaauugucagaguaaccuaaucuguuugggaugucaagauaaaucaaagcuuuuaggaaauacauguauaacuaauaaaaugaaaggcaccucuaaaacuggaucuugaaauuaaaagcuacuauucaguggugaaaaugaugagaacauaugcaaagagcaauaguucacucagaaacagcuggucuuuuaggagaugagaaguucacuucauacuuagacaaaaggcauaguguagugcuacauuccaucccaccugcuacacuaacaaaacuggcucuacuagacaacauccauauuugagaaauauuacguacaguaaaagaaaaaucacacgcuuaaaacugacagagggggaaaguauuuaaaauuaauuuacauuaaaaaaaaaguugaaagcuaacauagaaucaauaccuuggguucuuuuuuccauuuccaaaacgaaugugagccagauucaagauucucugucagcacuacaccagguuuugucaauuucacugaacacaagauauuuuaaagucuccaauucgauauaauucaugcugaguucuuuaaguacuauuugauaucccagugauuuuuuauuacuuccacuuuggggacagucuugugagucucuuuugagagcguucgcuccuaagucuguaagaugccuuuccuccaaaucuuaccauuuucagaauucugcuagagacauaucaauuaaccaaaauccagcuugccagcauccucagcuaacuaaaaguuauguuuugacacaacuuuuagggaaaaggggcaaaucucuaguaaacgaguugacuucaggacucuucaaaaaaagagucuguuuauucagcaaaacccaagggcccaaaacagguccccacccaaguagucuuaccuguaaggucaccaagcuggcugugguggccaggucaaucuucccaaauuugaugagauuuccauaaggguuaaaaggaagagugaacgguuuccuuuggcuuaggggcuuuucucuaaaauuccuugucuucuucccaucuggacuuuucccucugaacuauuagcuuacugccaaccaccguccccacagaaaucacaagaguuuaggcaaaugaaaagcaaguucugcccagccuuuuacaucuaagcacaacagcccauacuaggacaacaaauuaccaaugacuuaaugacuaaggcacagcauucucuucaaccucuaaagaaaagcccguaauguccucuacuuaauacaagugaaaaauaugagaacauguuuuggaauauuuuugcuucaauuuuugaaggugaagaguuccuucuauuaauucaaguuaacuagagucagaagauacuacuuaguaaucaacuuuacugugcuuucaccuaaaauuuuuccuccaaauuauuuaggauuugccuucuguucagaaaauuaguuuccacaauauccuucacuaugccagaaugcugacugacuuaaaaaaaaaugaccauuaugaaaggaaaaaacuaaccuucaacaccccuuaauucacugccuuuuauuauuuacauacaaaucuguccuccaaacaggagaagaugggacggcagugucuuaccaccgcaucccccacagcuccucgcacgaagccugggaguagugggcauucaauaaaugccuauuaaacacuucaguccucucauaacaaguuggggcauuccgaaacacuggcuccaccccuccagggucggccgcuggcucccgauggcagucugccuauggccuugcucuggugaaaugaaaccucgucgcucaagacccaggaugggggcaagggagccguccgaccacaucccgcagggcagcagauccucucuucaucccgccaggccgcugguccugaggccuuucccaccccauucgggaaccuacgucgccagccggggauccacaggaguaccagcccccgccccaccccgcagacagccuggcgucgggacaccggggacgccugcgcagaagaacccgccuggccccuuggcuccaacgguaacaaugcuccccuccgaaagacagccagaguaguccgggggcaccaguacacgucugcgcgcuccccgacgccuuggcgcgccccuggugcucaaccuuccccacgugagcgcgcccgccaucacgauacucgcugacggggucuccucaccugagucgggcuccgccccccuccuccucgcugaaggaggcggugaccccucuccgaucggacucggcagugucagaggaggugggaacguccugaccagcgucuccguuacgggacuuccucccccuuccacccgccccccucccaccccgccucuaguccccuagcuccuccagccaguucgccgcagcacucu

SEQ ID NO: 191370 - RNA, 25168 nt, Homo sapiens
ggggauccgaugcgcgccgcugccgcugcgugggggugaggggaucagguacgcuguccgcugguuaagggggcuggcugggggcugcggggucuguccugggacguccgccucccucgcggguggggcggacguugagaaagcagcguuuagcagucauguggccugugguacuccaccuuccugauacuuucccuuccugcuuccacucgcacgcucagccugugggccgggagagacccgcaggcggggugcucucaggcugaauucgaugugccaucacuuagcggcaguguagguacccaucaggugggaguuaggcuagcaaaggucugaggccucugccaaccuagggugggggugcggaguggaggauuuaugaacucagcaaguauuuauuaagcaucuauaagcaaacaacacuugccuacauugaagggauggaggagguuccgacaacaaguaaaauagguuauguuggauaguaauaugaaugaggagaggaagguagucugugagugucuuagggaagagcauugaggguaaagagaacggcgaauguaaaggccuugaaggguauguuugaggaacagcaaauagaccccggagugcagaggaaacgagaaagguagaccuuagugaucugcauaggucauuguauggauuugggcuauuuacugucagugaaauggagaguacugcaggguucuaagcagaagaguggugaucaucaaauacuuaggaugcucacagggcucggguacugaggguguacaggugaauucuuccaauucuucccuggguuuauaaucuaguggggaaacagguagacagcugucaugcaaggcagggucagauaauuggagccccaugaaagcagaacgaaugucauccccaaguccccaggauguacuauuaugucaggugcuuaguagcuuuguugaacgaaaguaaugaauauucagcaucggacccauaauuggaggcucagaaaagauguuuaaugaagaaaugaaaaauaaaugaaaucucacuucuugauacuguuacaauggcaauuaaguuucaaccugaaugugagaaggggacaaacauucaaaccagagcagcacucaaauucauaagauaggaaauacaaaggugcugccaggauuggggaagggagaguuauauaaaggucacagggucgggugugguggcucacgccuguaauccuagcacuuugggaggcccagacaggugggucgcgaggucaggagaucgagaccauccuggcuaaaauggugaaacuccgucucuacuaaaaauacaaaaaaaucuagccggacaugguggcgggugccuguagucccagcuacucaggaagcugaggcaggagaaugcgugaaccugggaggcaaagcuugcagugagucgagaucgcgccacugcacuccagccugggcgacagaguaagacuccgucuuuuuuuuuuuuuuuuuuuuuaaaguuaguuucacuuuaggaagacaaacaagcucuggagcuggacaguggugaugguggcacacaauguggaugcccuuagguguguuuuuaacugcacauuuacaaaugguuaaaaugguaguuccuauguccaaaaaaaaaugcuaaauuugggcauagauaaugucccacacagauugagcagaucucugcuucugugauguccaacuucaccuuugcuuucugaggaucccuagguggcaaucaccuaaucaguauuuauugagcuuccauucugugccaggccuuaugccagacaacagagauacaaagauacaaaagaggugggccccgccuucaggaguguuagcuuguucuauuacucuucugauggugguuggaguuguuuuuauuugauuugcaagguuauugcaucccaaauuccugguuuaagaaacauucucagggacuguagagauuuggagaaacaugagguaaaaggaggggaaaagaaaggaagggagugggagugguggcgguaaacuucaguucaauuaaacaaaaaauaaacacugcuguuuucaagguucuauacugugaacucuuaaguguuuagguaaauguagguauaagcccuccuacaaaggaauucaguuugauaggagagaagauaccagcacagacuuuccaauuuuugaaaacaacaguggaagucuguagcuccuaggaucuccuauccuagaucucuuuuccccuccuuagccagacuaccuccagagaaaucucuagauccauugccucccagucauuccccaacaggccccggcauacaguaggagcuugguggaauguuuauuaacuaaugaauggucaacacagguaaaaauacaaaaugcuaugaaguuuaaaggaggaagagaucacauggcuauuaacuagcauuuauuuaacaaauggguguugguuuucucacccuaauacaaugaaguugucaguuaaagauuaguuuaucuuaauguuuucauuuguuauuuucugaaugccuauaugcaggaaaaugcagaugacucugaugguauaaaagucuguucauucaucuaaaagaacugucauaaugggggucuagauaucuuuuguuuaaaaaaaaaaaaauggcugggugcgguggcucacuccuguaaucccagcacuuugggagccugagauggguggaucacuugggucaggaguuugagaccagccuggccaacuuggugaaaccugaucucuacuuaaaaugaaaaaauuagcguggugugguggugcgugcccguagacccagcuacucgggaggcugaggcaugagaaucgcuugaaccuggguggcagagguugcaaugagucaugagauugcaaugagaucaugccacugcgcuccagccugggugacagagcaagacucucaucucaaaaagauauauauauauauauacacacacacacauauauauauacacauauauacauauguguauacauacauguguauguguauauaugugugcauauguguguaugcguguguauguauguguguauauauacacacacacauauacauacacacauauauacauauacaggugugagguggcucacaucucuacccagugacugggaagcugaggugggaggauggccugaggccaggaguucgauacuggccugggcaacauagcaagaccuaucucuuaacuuuuuuuuuuuuuaauuugugaucaacuucacuguucauucauguggagugcuucugaaauguuuaagaauagcuuggauuuuuuguuuuguuuuugaaacaggguuugcugugucacccagguugaagugcaauggcacaaucauagcccacuggagccuugaucuccuggguucaagcgaucuucuggcuucagcugcccaaguagcugggacuacaggugugcaucaucaugcucaucuaauucuuuguggagguggggucucacuuuguuccccaggcuggucuugaacccccaggcucaauugauccucccuccucagccucccaaagugcugcgauuacaggcaugagcuucugcgcccagccagcuugguauuuuccucauuucucuggagauacacauuaugaaauuuuaugcaugccacuaauucuuugugauagucuguauguaaauacauuuaaaaauguguacuggauuuuaaaggauuucuaagcagaaauaaacuuuagccuaggcagacaaauggacacaaauuucaaaucuauaauuuugaaaaucuagaagguaauuuacuuggucaucuucaggaauauaucugguggucacauguucacaugauaagucaugaauaaccaaaacugcucagaagauuuaccuucuaauagcaacuguaagaacaacacugaagggguuuugaauaguaguuaacagcaaguauuucaugaguacuuguuuuauaucaguaagugaaagguaucuaauucuugcaacaauccugugaggucguuuuaucccauuucguggagagacucuauggcagagacuuaaauccucuagcuauugucccauuacucacaaguggcaagcugggaagugugucugaauucuaagaaugcuauuuucccgcuuaaaccuauuuuaagugugucuaaacugaaaacaacuaaaguuuggcccaauuuugagcauuugauggaguacaagaaaagcaauaugaacucaacacuagaaauguuuuccaaacacaggagucaaaauggaaaagaaaacauaauucuaggacacuagccaucucuacagugaauaauauuuauggaguuauaauauaaaugcaguuuacagcuggugcaguggcucacacuuguaaucccaccacuuugggaggcugaggcaggcggauugcuugaguccaggaauuccagaccagcuuggauaacauggugaaacccuaccucuacuaaaaauacaaaaauuagcugggcaugguggugugcaccuguagucccagcuacucaugaggcuggggugggagaaucacccgagcaugggaggucaaggcugcagugagcugugauugcaccacugcaccccagccugggcaacagagugagacccugucugaaaaaauaauaguuuacaaauuugguuuacaaauuuuagaaaauaccacggggauagacaaagcacuuaauuguuuugucagggcaaaauguaaaaccuaccuugaccauauaaaauuaaaggcucaguuggaaaauuaaagggagaacagagauagaaauauaaggguguuuauguucacagccuaaagauuggggagucagaaauacuauaacuugaacaagaaguagaaguuuuaaaauauucuuaaaaguaauagacuccugguaauugucaugacagaaggaauggguauuggacuuaccuuccuacaauaaacuauaaaacuggagaaaggauaugaagaaauuguuuucagguauugggcaguagucaggacaagacuguaauccuugagggaaaagaaacacacaagcuaagccccacagucacccuggcuuucuaccugagggugcauagugacacggagcccauacagaguacgucugugucacuggguggagcaaacaguugaauuuagggcugcugagauuggauacagcagggagggagugguguagcaaaggagccccagaaaucuguguacggguccccagaugguggugcuguggaacauuuggaaugcucauacauugcugacaggcaguguaaaaugguauaauacuuugggaaauggauggcaguuuaugaguuaaauacacaccuaugcuaugaccuagcaauucuaccuuaaaacuuagucaauggaugugaaaacauguauccauaaaaacacaucuaugaaaauguucauagcagauuuauuccccaagcuggaaaagaucucaaaugcccaucaacagaauaaauugugauauauucauacaauggaaugcuacucagcaauaaaaaagcaacuacugauacaugcagcaacauguauaagucucaaauauuuugaggggaaaaaagucaagugcuaaagaguacauacuguuugcaucuauuuauaugaaguuguauaauagauacagcuaauccaugguuauagcaaagagaacagugguugccuuuggcaaguugugggaaugggaugaagacugauuuggaaaguggagaagaaaguuaaacuuucuggggagugaggcugggugugguggcucacgccuguaaucccagcacuuugggaggccaaggcaggugaaucacuugaggucaggaguucgagaccagccuggucaacauggugaaauucauuucugcuaaaaauacaaaaauuagcugggcaugguggugcgugccuguagucccagaaacuuaagaggcugagaugggagaauugcuugaacucaggaggcggagguuccagugagccaagauuaugccacugcauuccagccuaggcaacagagugagacuucaucucaaaaacaaaaacuuucugcggugauggaaacguuccauaucuugacaggauugucaguaacacagaaccuauacauuuguuaaagcucauugaguuaguauauuuuaccacauacacaaauucauuaaacuguacccuuaaaaucuuugccaaaaaaauguaaagaucaagguaacuugaucucaaauuucaaaaucaagauaacuaaugaagaauuaaaaauaauaggccaggugcggugguucacacauguaaucccagcacuuugggacgccgaggugggcggaucaccugaggucaggaauucaagaccagccuggcuaacauggugaaaccccgucucuacuaaaaauaaaauuagcuaggccugguggcuggcgccuguaaucccacuacuggggaggcugaagcaggagaauuguuugaaccugggaggcagagguugcagugagcugagauugcaacgcugcacuccagccugggugacagugugagacuccaucucaaaauaaguaauuuaaauagggguugaccccuaucucuacagaaaauuuuaaaauuagccaagcauggugaugcaugccuguaguccuagcuacaugggaggcugaggcgggaggauugcuugagcagguugaggcuguaguaaaccaugauugugccaccgcacucgagcuuggguaacagugagacccugucucaaaaauaguaauaauacggacugauuuaagcgauuugaauucuuauguuucauagggagucaauacauucaaagcugaugaaucaugaaauaaugauguaagcauaugauuucaguuuaaggaguuaauuaccaaaagaacaaaaaagaacugguuaacaaggguugccacuagagguggaagggauaggaguguggauuguuacuuuucauuguaguuuuuuuuuaacaccauauacaugaaucauacuacauagacuuaacacuuuuuaagauauauuuuucauaaaagugguugugugacuacacccggaggaccagccauagguaauggucacaucauuuguguucugugacauuugaccauugacuaaagcauuucugacucauaucguucagauuuugaacuccacuuugaaauugacaucauuaaguguuguguaagagugcuugucuguaguauucaaccucagcacuucugagggauauuaaacauuuucaguggugacuggcuuucuacugcagugguauucaacugaguuggaggaaauacauaguuuaaaaaaacugauacauaccaacaaccuaaaagaauucuugguuucaugucacucuacuauauacauugguacauucucccaagaugucucuaguacaguaccuuacuuacaguagguauucaauaaauauuugcuaaaggaacaauuuugaaaauaaacugguugaaacauaaugggggaggugaaguggcuuuugcaaucugucuuacccucaaaucauaucaugcauuuuaaaguacacaauaaauaacuugguuaucugugucacugcagcuauggauaaucauugauugcuuggagacgucagguguugugcauguccucuaagaaguguaucuggggcugggugcaguggcucaugccuguaauccccgcacuuuggggggccgagauggguagaucacuugaggucaggaguccgagaccagccuggccaacauggugaaacccaucucuacuaaaaauagaaaaauuagccgggcuugguggcagaugccuguaaucccagcuacucaggaggcugaggcagaagaaucacuggaauucaggaggcagagguugcagugagccaagaucacaccauuguacuccagccugaguaacgagagcaaaaccgucucaaacaaacaaaacuuccuuacuacugaacuguuucucugcugaaucauguaucuggaagacacaugcuuuucucaguccaguaaaucugguucaguauuuuacacacuucuuucaguaacacaauaacacuuugucauuuggauguagggagauaccuauguuagugaaauaauguaauagcucacauaauugugccuuuuuccagucugguggaaaggacagaggacuaaguccauggacuggaaauuggaagggaguacucagaaaguagagucaccugugcugcaggggcaagaaggcauccuagaggagacaggugaagauggacuuccugaaggcuuccagcuucugcagaucgaugcggaaggcgagugccaggagggagagauccuggccacaggcaguacggcauggugcucggugagugcgugaauugccuggccauaggccuugaaugauggaaugucucaagacaccccuguuuuaaagauggauacugguagugaaaagagagacggaaugaguuuuguguauucugagugaugaauuuucugcuaacugguuuaaaguuuuaguuccauuugagucauaggaaaaguucaaaaggaauuuuugauauaccccugaagggucaggaaaucuaaacuccaggcccugucacuaaugaauuuucugugaccuugaccaggucaugucucuuuuucuggggcucuguuuucucuaaacacgauccagucuagguuuguuuuuaagaguaauuuccucuuucucuccaaacuauauauauaaauaagaaaaaagcaaauguuucuaauguucauuuuccuuuuuuggugcuuaugaaguucucaaacaauuuuguuuucuggauaauauaagaaaaauguccagagaaaacagagacacugggaaaagauaguugcagcaaagaagagcaaaagaaagcaagaaaaagaacgaagaaaagccaaucgugcagaaaauccaggugacaauaaaugagacuguugguauaauaauauuuauuuuuuagcaaacgugucugcauguuccaaugagaguaggaauuuuguauaaguaaaaagcaucugggaugugggacccacugcccuauuuucuugggaaucaaaacaucaaagaaagcaaaauuuguagcugggugugguggcucacaccuguaaucccagcacuuugggaggcugagguggguggauuugcgaggucaggagaucgagaccguccuggauaacacggugaaaccccaucucuacuaaaaauacaaaaaaaaaaaaaaaaagccgggugugguggcacgcaccuguagucccagcuauauuugggaggcugaggcaggagaaucacaaaccugggagauuagagguugcagugagccgagauugagccacugcacuccagagccugggugacagagugagacucugucucaaaaaaaaaaaaaaaaaaaaaacaaaaaaaaaaauuuaaggcugcuuuucaaauauaagcuaucuaacuaacguguuuauaagcucagaauaggagugauaccagcaacagcuaauauuuauucaguauucuguguuagguucaguucuaagaauuuuacauggauuaccucaauaaagaggagcuguuauuaucauucccauuuuguaggugaagagacugaggcuuagagaaauuaaguaacauaauuaugcccaagauaauguagccaaucaaugaacaaacugaacuuggauuuaaacccugcugugugcugcagagcccauacuccucaccacucuguguaaaucuucuaaugaacgaauaccuuacaucaguaucaaguuucucuuuauaugcaaaauacccaccuggcuaagauuuguuucuuauauaauauuccucugguuuuccacuuuuauuucuuucugauauuucugcuuuaggcauuugcccccagcacagcaaacguuuccugagagcucuaaccaaagacaaacuuuuggaagccaaacacucaggaccaagacuauguaucgauuugaguaugacccacuacaugucaaagaagguagaacauccacuaagccuggaauuccugcucgccaugagggaggcccagaaggguacagcuuuccgaagaauauggucaacuccagcuucugggauuccuuaguaaacuaguaaaguguuugauuuucuauacuggguuacuaaguuccaagguggcuguuguaacgaaccuggaagagaauauauauaguuugguuuaguuugcaaauuuuuaccuugucuucuguuuuaagcccaacaucuuugccucucuguucaugauauccucagucuggauggaaccuuucagguucaguuuuccagacacuaaaccuuugggaagaggaauauuugccugguagcauguugugggaagauuaccugguggaagaacuuuuugcaauguguguguuuuuuguuguuguuuuuuugagauggagucuugcuuuugucaccuaggcuggaguacaauggcaaaaucucagcucacugcaaccucugcuuccuggguucaagcaauucuucugccucagccuucugagcagcugggauuacaggcgucugccaccacgccugacaaauuuuuuuuuuuuuuuuuuuuuuuggagacagagucucacucuguugccggggcuggagugcaguggugcaaucuuggcucacugcaagcuccaccuccuggguugacgccauucuugugccucagccucccacguagcugggacuacaggcuccugccaccaugcccagcuaagguuuuguauuuuuaguagagaugggguuucaccauguuagccaggguggucucgaucuccugaccuugugagcuacugcgccuggcacacccagcuaauuuuuuuucuauuuuuaguagagacgggauuuugcgauguuggccaggcuggucucaaacuccuguccucaggugauccaccugccucagccucccaaagugcugcgauuacaggcgugagcuacugugccuggccucaauguauguguuuuaauugaugcucauucaccucauugaugaaagagggauucccacacuagaguucugggaauggcagaaugcaugacaccugacacuggacagaugagauucacagcaguucaugagucucauauacuuacagcccaggggaggaagauacuguauaccauacagggccacguggggauuguaaucaagaacagaaugaacagcaaggggcugugugaggugggcuuuguaguauccagggguugaggugcccccugguuacuauaggaggaugugauuggcuuguuaggaaaauuccaugggcuggcagggaaccaaaacuccuuagggauaaagagauuaugccuuggacccuugaugaaaaguauuuaauuauuuauuauuaaguuuuaagguacaugugcacaacgugcagguuuguuacauagguauacgugugccauguuggugcugcacccauuaacucgucauuuagcauuagguauaucuccuaaugcuguccuuccccccgucccccgaccccacaacagucccuggugugugauguuccccuucccguguccauguguucucauuguucaauucccaccuaugagugagaacauacgguguuugguuuuuuguccuugugauaguuugcugagaaugauaguuuccagcuucauccaugucccuacaaaggacaugaacucaucauuuuuuauggcugcauacuauuccaugguauauaugugccacauuuucuuaauccaaucuaucguugguugguuccaugucuuugcuauugugaauagugccggaauaaacauacgugugcaugugucuuuauagaagcaugauuuauaauccuuuggguauauacccaguaaugggauggcugggucaaaugguauuucugguucuagaucccugaggaaucgccacaccgacuuccacaaugguugaacuaguuuccagucccaccaacaguguaaaaguguuccuauuucuccacauccucuccagcaccuguuguuuccugacuuuuuaaugauugccauucuaacuggugugaggugguaucucauugugguuuugauuugcauuucucugauggcuagugaugaugagcauuuuuucauguguuuuuuggcugcauaaaugucgucuuuugagaagugucuguucauauccuuugcccacuuuuugauggguuuuuuuuuuuuuguaaauuugaguucauuguagauucuggauauuagcccuuugucagaugaguagauugcaaaaauuuccucccauucuguagguugccuguucacucugauggugguuucuuuugcugugcagaagcucuuuaguugaauuagaucccauuugucaauuuuggcuuuuguugccguugcuuuugguguuuuagacaugaaguccuugcccaugccuauguccugaaugguauugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauuaaauaggguauccuuuccccauugcuuguuuuucucagguuugucaaagauuagauaguuguagauauauguggcauuauuucugagggcucuguucuguuccauuggucuauaucuguuuugguaccaguaccaugcuguuuugguuacuguagccuuguaguauaguuugaagucagguagcaugaugccuccagcuuuguucuuuuggcuuaggauugacuuggcaaugcaggcucuucuuugguuccauaugaacuuuaaaguaguuuuuuccaagucugugaagaaagucauugguagccugauggggauggcauugaaucuauaaauuaccuugggcaguauggccauuuuaaugauauugauuuuccuacccaugagcauggaauguucuuccauuuguuuguauccucuuuuauuucauugagcagugguuuguagcucuccuugaagagguccuucacaucccuuguaagcuggguuccuagguauuuuauucucuuugaagcaacugugaaucagaguucacucaugauuuggcuguuugucuguuauugguguauaagaaugcuugugauuuuugcacauugauuuuguauaaaaaggauuuuuaaagcuaggagaccuuaucuacgggagcagaguugggaggggagcuuacuauuaggcuauuugaaguauucccaguuuugacagaugucaaggcagugcauaauacugggccuuaauuuuaggccuuacaucacaguauguaaauuguaaacucucuuuuuagacaucuguuuuaugugcuaguguuugcauauuuuucagauaaguuaggaaaacugcagaucugagguuccuaccugaaacuucuaacucuaguccucugaaaauguuaaccaagaauucccuacuauuaggcugggcacaguggcuccugcauauaaucccagcaucuugggaggccgaggcaagaggaucacuugaggccaggaguucaagacuagccuaggcaauauaggaagacccugccucuaaaaaauuaaaaauuagccagguaugguggccuguaccuguagucccagcuacucaggaggcugagguaggaggaucacuugagcccaggaauuugaggcuguagugagcuaugauuguaccacugcacuccagccuggguaacacagccagacccugucuccaaaaaaaaaaaaaaaaaaaaaauccauauuguuaaauuaagauagcagauuaaaucaaacccagagucuuuuucuccuacccaacaaaucaagccaaauugugaaauugcuuuuauauaagagcauugucugugauucaggguaaaaaguuaaaacuuccaacccuauugcaucuccugaaguuaggaagaagguaccaaauuuauaugauguucuguaaaaacauuuauguauauuaaugaaaccucuuuaauaacuuaaauaguauuacauaagauuuuagauaaaagcuaaaauaagaauuucauauauuaaacauuuaacagcagggccagcaggagggcgaauuccguuuuccacuaccucacuguuucuggacuuguaucauuaucuuuugucuguaaggugugaugccauaagguauaauacacgcacacauguacuccuaguacaugggguuuucuggaguagcguucagugaacuuauuguagccauuucuugauagcuaauuuagagugaguuggcauguuuuugcccugaguuguucuuauuucuuugaaggaauuaaguagacuggcuggacagauucgaagguuguaugguucaaacaaaaaagcugacaggccauuuuggaucugccucacuggauucacaacagacaguccccuuuaugaagagugugugaggaugaaugauggauuuucuaguuaccugguaagucucuuuuugcauauuauuugaauugucaucugaaaaguuauugugguuaauaguauuuuuuuuuuacuuuuucauauauguuacauuuucaguauugaagucuaaaaaaauucagaaccucucauaaguucuuaaauuuaaaauuuuuucucauccuccuacugcauuggcaaaguacuguuaccagugucuaggacuguauuuuguaucccguauauuuaugcuagacuguauacuccaggaauauuuuugggaaaugccaugacuccuuucuuguucucauuaauggugaauugggaaacaugaguuuugggggaagagaaggaaucccuuuaugaaguaaugcaaauuuaagauaaguuuuagggaguacuaagguacuuuucaccucucucuaggaucucauacauuuagugauacauauacaugcaagaauccaaaugaguuucucaaaugucacugaaaaugcccaguguguuugcauuguguagcugagacugagcaguugugaccuuccccaggaagguccauggaagugaugaaugugaagggugcauugcgcggggcugcacagccagcuguuuugcuguuacugucuucacagucucucuuguagugcagcuaguuccaguuuucuucuauguaguuguuuuaaugauucuuuuacauaagccaaacaguccuuuuuacagguccacauaguucccuuacuuuccugucuucgugccuuucuuagucccucagcuuugaguucuucuccuuuuguguaugucaauauuaaucuauuuugaggcugggcacgguggcuuauuccuguaauccuugcacuuugggaggccgaggcagguggauuguuugagcucaggagcucgagacuagccuuggcaauauggugaaaccccgucccuacuaaaaauacgaacauuagcucggugcaguggugcgcgccuguagucccagcuacucaggaggcugaggcaggaggaucacuugagcuugagaggcagagguugccgugagcuuagauuaugccacggcacuccagccugggugacagagccagacccugucuuuaaaaaaaaaaaaaaaaaaaaaaaaaaaaaaaaaucuccuuucagaaacccaguuccagcauuuccuuccccaggucaucccaauguuacucccucaucuguaguccuggagcaugcuccccguaccucugucagaaccccauaucgcugucucauuucauagguuugaacgucugugucuacuuucccuccuaacuagguacuuucugagaagcugucaagcugucacaugugcaguuccuugauaaaccuagagccaugccugauagaaacuugaagcccaguaacuagucguugaauuuugagcgggguuuuuuuuuuuuuuuuaaagacaggcugaagugcaguggcaugaucuuggcucucugcaaccucugccuccugggcucaagccauccugccaccucacuccuaaguauuauagcugggacuacaggcacaugccaccaugccuggcuaauuuuuuuguauuuuuaguagagacuggguuucaccauguugcccagucuggucucgaacuuuggagcucaagugauccuuccaccuuagccucccaaaguucugggauuacagacgugagccaccccacccagccgugagcuguuuuaacaucagacuguuugcauuuuccaguuagacauaacagaagaagacugcuuuaguuuauuucccuuggaaacccuuguguaccugacuccugacucagaacacgguauguaguugaaugcauggauucguauagcccauuguuccuguguuucauuauucccuguggcagaauuuauuaaagccccucaagaaggacaccccuccccacccccacaaaaaguaaugcacaugagcagugcuccucuuacaggcaggggccucacuggaugcuucgaugugucuuaccauggcucacagcugcagacuuaggguuuccauccuuaucugggccuuguguagugccugccagucuuucccaguguccuuggucugcuaccccacuagcccuucuuggaucaauguuagaucuauuuuuuccuagaaaaucauucauuucacauaauuuuaaaauguauugguauucaguugaucauaguauucucaucuaauuauuucacauucuucugcaguuuuguuuccuuucugaaucuaauguugauuugggucugcuacccuuuuucgugauuagcuaugccaacaguuugucuguuuuauuggccauuuuagaaaauuagcuuuugguuuuauugagcaaguuucuuuuuguuuucuacugaauuucuacuuuuauuguuaauaauucuuucauuuugcuuucucuggauuuagaaauuauaaaacagauuugaucucauuggccuucauuuuuucauuagcucuugaagauguugaucuaaacaaaguuuacauccucggugggcuuguggaugaaagcauucagaagguaaguauacauuucagccccaacaucuguuuuaaaaagcagugcuuacuuuuagaggcaugugcccuguuauagucuccucuagagggucuaagaacucagagggaacaggaagaaagagccauccccaccagguuggcccucuggcuggugaaguucccucucuccucaugagcaaugucagcgaaaucaagagucgggaacuggacugggcacuguuugguaauuacauagccauuguugaguuucucucuucaguucugcaaggauaacucugauauugaccaaguaagcaucaacucaacauucuuacuagcuguucuuugagggaguaguuugcuccuucuaagguugaucucucugcugaaauagucuuagcccaaaaccucaaacuccuaggauuauccagauuuuuuuuguuggaguuuuagaggaauaauuggggugucacuggaauuuugaaauguuuguuauauagcuguuuaagauaauuguuuauauuuacuaacauauuacauagauaauaaguuuaauaaaaguuaaagacuaacauauaaauauaaaagaguagaaugaaagucuuuccuaccuuugucucccaauuccccuccccugaggcaaccgaugucaaguuuucuuguguauccuucuuugagacauuauaugaucacaaaguauguguuuguggguauauuuuacauauagguagagguagauguguucuaucuauguuccuguauguaugagauguauguauauuuaacacagaugauagguuaauuuaauugaauuuauuuaaaaaauauuaguguuccaugacuccauagugaucaucuaaaauacgagcaggggcuacuuacagaagaaugcagcuaauaaggaaugcauaauagaauuagaaaaucaucauuuugucacuccuaauacaauuguugacucaguugaaagaaagguuguggaggaaccggcuauuuacauggucucaaaguaucacccuacagauaacaaaggcaaagauuuaacauuacaguaaagcauucugguggucaccaucuuauccaaacuugaucaaacuuaguaucacccauacagguacaaucucugccuccugagguguaguauucuugacagaaaauguuuuuuuuuuuucuuuugaagcagggccuugcucuguugcugcaaccucgaucuccugggcucaagcaauccucccaccaccucagccuucugaguagcuaggacuacaggcccaugccaccacaccuagcuaguuuuuaauuuaauuuuuuugagacauggucucacucuguugcccaggcuggagugcaguggugcgaucauggcucacugcagccgcaaucucaugggcucauuugaaccgcccgccucagccuccuggguagcugagacuacaagugugugccaccaugcacagcuaauuuuuauauuuuuuuguagagacagguucucaccauguuuuccaggcuggucuugaacuccuggacucaagcaaucuacucaccucagccucccaaagugcugggauuacaggcauugagucacugugccuggccuaguucuuaaauuuuuuuuuuagagacagggucucacuuuguugcccagacuagucucaaacuucuggacucgagcaauccuccugccucagccucccaaauugcugggauuacgggugugagccaccgugcccagccucguguuuaaaauuuuuuguagagacagggucucacuguguccagccuugaauucuuggacucaagcaauccuccuaccucagcaucccagagugcugggauuauaggcaugaguccucaucuggcccagaaaauguuuaagcugaauuuaauugugaggaaacagacaaaucagaaugugggacauucugcaaaacaacuggacuggacuuaaccgaggcaggaggcuguuacagauuaaaagagguucguccaggcacaguggcucaugucuguaaucccagcacuuagggaggcccaaggcaggaggaucacuugaggccaggaguuugagaccagccugggcaacacauugagaaccuaucucuacaaaacaauuuggaaaagaagaaaagguuaaaaaaccguaauagccaaaugcaguaugugagccuuguuugaauucuguauugagaggaaagcuuuauaaaaaacaguuuggggaaaguuuaggaaauuuuaauguagauuguguauuaagugaaauuacagauuuaaaaguuuucuuugaagugaaaaugguauugugguaagguagaaugucauuguucuuagaugcaugcuuaaguauuuagugaagaaguauugugaugucuguagcuuacuuugaaaugguuuggcaaauuauuuuuuauugagacaaggucuuguucugucauccaggcugagugagguggugcgaucauagcucgcugcaaccuugaacuucuggucucaagcaauccuugcgccucagccuccugaguacguaggacuauaggcacaugcuaccauggccagcuaauuuuuuuuuuuuuuuucuguauuuuuguuagagacgaagucucuugauguugcucaggcuggucuugaacuccaggccucaagcaauccuucugccucagccucccaaaacacugggauuacaggcaugaaccacccuguccagcccaaaauauguauuuauauacagagagaaaaagcaacauauuaacaacuggugagucuagauuacaggaaugaauauugauuguauuauuuugaacuuuucuuagguuugaaauacuucaaaguaaaaaguuagggucgggcgugguggcucacgccuauaaucccagcccuuugggaggccaagucaggcaaaucacaaggucaagagaucgauaccauccuggccaacaugugaaaacccugucucuacuaaaaacauaaaaauuagcugagugugguggcaugugccuguagucccagcuacucgggaggcugaggcaggagaaucucuugaaccagggaggcggagguugcagugagccgaaaucacaccacuguaguccagccuggugacagagcgagacucuguuucauacacacacaaagucuggagggcuggaggacuacuugaacccaagaguuagaggcugcagagaacuguggucacaccacugcacuucagccugggugaugcaacacagugagacccugucucuaaaaaaaaaaaaaaaaaacaacaauaauaauaauuaaaaguuuauuagucuuaccugcagcagggugacagcgcccccaccccguccaagacagggccuugcucugcugcccaggcuggagggcaguggcacaaucagcuuacuccaggcucaauugaucccccuaccucagcuucccaaguagcugggaccacaggugggcgcuaccaugcccagcuaauuuuuuguugaguugggguuucaccguauggcccaugcuggugucgaacugcugggcugaaguuacccaccugccucacccucccaaagugcugagauugcaggcaugagccacggugccuggccaacagucccuuuuuugaggcaguuaaguucagagggucagugagcagugcaugacuuacagaugugcaguuuuaacauauuaucuguccaccaacauuuaaacugaaaaauaacuggaagauuugugagauguuuagaacuuuuugguuguuauuggaguuuggcuucuucacagaaauaagcuaagaacaacauuucuucaaggagagucauuuuauuaugaaucauugugcaaagaacauaaacuaaauuguaagcucuucuagggcaacacccaaauauccuaauuuugaauucuguacuucaaagugauuauaaaggaauaagacuuuuuauaaaacaaacguaucauauagcucauauaugcaaaggaguuuuauccuuucaaauaagucccuguaucgcuuaaaacauuuuuggaaguucuaucuaaaauuuuguuucaugugaggcaggugucagcaccgaaaagguacuagguccacuucacacuauuccaccugguuagaccauacucaugauggccagucaguuaugggaccguaaacaaaaugauacuggacuagcuuagaacaaguucaacuuguccugaaugaugaagggacuugaaauucaaagaagaguugacagaacugaggcuacaaucuggagacuagaggauuccuaggggcaugaucacugccuucaaguuucugaauggccaucuuuuggaagggccaucuuacuugcaugguuuggccuugggggaauagaccuaggaugaaugaguggaagucucaaagaaaacagaauuuugcucaagaucaagaagaauuuccuaucagcugguacuaucaaaacuggaguggguugucccaggaugcaugaacucccugucacaagagcuguccauugaguggccacauggccucuuggagaagucauagagaacagacaaugaaugggugguuagagugauacaguuaacacuauugagaccccuuccaagccuuggcauguuaauuaucccaguaaucugaaccuuucucuuuaauccugaagucuuagguagaaaaucuuuccugugcuucuuacaaggcagcaaauguaaucugacugagucaugacucagucugagggacuucaugacuaaggaacaucuuauaaagggacaucaguuucuguacucugacacuaaauggccucaaguugauggacuucuugugacuccuuuuugcaguuuucagagcccgcccuuuuauauuuuugagacagggucuccucugucacccaggcuggagugcaguggugcagucacagcucauugcagccuugauauaugucccaggcucaagugaucauccaacuucagccuccagaguagcugggacuacaggcacacaccagcacacccuguuaauuuuuuuuuuguuauuuguagagacaggaucucccuauguugcucaggcuggucuugaacuccugggcucaagcaguccucuggccuuggccucaaaguguugugugaggcacuucaccuggccccuuucuuuuaauugggcucucucuucucacacccuaaugccacuuguugcaguggugcaccugucuugaaucuugucuaccuuuuccucuaauuugaugcugccuuuuggcaaugagcuggaaguuccagauauccagaauugggucuuacugaguuagggcucagaaugugcucugauugauuagacugcuugggccuuuugaugccuacuguggcugcagaugugccucuuuugcuuauuucccucuugguucuaaguggcagugaguggaggacuguggaugagugaccccccaaaaaguaagauauugucacauaagcucuugagacaguuaacucauuaucugcaguuucuuccauuccacaauaggcuacuuauuuuuaaugcuguauuacauugagaauauacucauguauaauuuuuauaagaaaaauauuuaacuauauauuuacagaaggugacauuucaaaaggcccgggaauacucugucaagaccgcacgcuugccaauccaggaauacauggucagaaaccagaaugggaaaaacuaucauucagagauacuggccaucaaucaagguacuucuuacacggcccccauccagggugugugaguucuggugcugcugcuuugcacuguguuuaaguggccuuugagucagucuccucugugacuaauguguguggacuuuauugcauguacgucaugacauauauucuggccacuaagaggcauucuguuuucuucgucaccaacuauguuaaagauaguugaaauuguccccuuggccaggugcaguggcucacaccuguaauccuguaauccacuuucagaggccgagguggguggaucaccugagguuaggaguucgaaaccagccuggccaacauggugaaaccccaucucuacuaaaauacaaaaaucagucaggcgugguggugcacgccuguaauaccaauuauuccagaggcugaggcaugagaaccacuugaaccugggaaguggagguugcagugagccgagaucacaccacugcacuccagccugggugacagugauacucugucucaaaaacaaaaaaaaaagcugggcacgguggcucacaccuguaaucccagcacuuugggaggcugaggugggcagaucaccugaggucgggaggucgagaccagccugaccaacauggagaaacaccgucucuacuaaaaauacaaaaauuagcagggcauaguggcaggcgccuguaaucccagcuaaucuggaggcugaggcaagagaauugcuugaaucugggaggugcagguugcggugagcugagaucgugccauugcacuccagccugagcaacaagagugcaacuccgccucaaaaaaaaaaaaaaaaaaaaaaaaaaaaaaaaaaaaaauuguccccuucaucuagaaugcccagcuuuuaaccucucaccacugaauuccuguuugaucuucaggguucaguucaggagcaucuuggcccuuccccaucccaggccacagcagagcccuucuguuucccauuuuacuguguuccuuucuguugcacccuauccauucauaggccuguaucuuucaggguaggcugagguccuugagagcaagcagagccuguguccuugccucuccccgcaagaccuuaguaccacauauggugcagaauagguuuguugaacgaaauauuacagaacauccuuuucauuuacucguucuuuuuuucccucuguggucacuguguuuucuguuuacucucuaacaguguuugauauccuguccacuuacuuagagacucacaacuggccugaagcauugaagaaaggaguuucuucaggaaaaggcuauauucuucggaacucaguggaaugaugggccuaagauugcagcugcguggccaggugcucacgccguaaugccaacacuuugguagaccgaagugggcagaucaccugaggucaggaguucacgaccagccuggccaacauggugaaacccuucucuacugaaaauacaaaaauuagccaggugugguggcgcauaccuguagucccagcuacuugggaggcugaggcaggagaaucacuugaacucgggaggcgaagguugcagugagccgagauuucaccagugcacuccagccugggugacagagcaagacuccaucucaaaaaaaaaauaaauaaaaaaaaaugcagcugcaggagugaggcgcuuggagguaccuugacccaaagagcagggcagaggguggcaguggcacauaggcaagugucuuugcaugacaucuucucagagcuucacaauaaugucagggaccacauuuaaugcuuuuuaaucucccauagugccuggcucacaggaagugcucagauauguuaaguaauaaaaaguuaauguggugggugcaguggcucacgccuguaaucccagcacuuugggaggcugaggugaguggauuacaaggucaggaguuccagaccagccuggcuaauauggugaaaccucgucucuacuaaaaauacaaaaauuagcugggcaugguggugcgugccuguagucucagcuacucaggaggcugaggcaggagaaucgccugaacccgggcggcggagguuguagugagccaagauccagccugggcgacagagccagacucuugucucgaggggaaaaaaaaaaaaaauuauguaacaaggaauuagccucaaaaccacauggcuuuggacgugcuaauucaacuuuuguacaucuauuugugagagaccucuugaaauuguuuaaaugguuacaucaagaguuuaauauucacuaaacuggcaucauaaaauuguaugacuuucuccagccuugucugaucaugcucguuguugcccagcucaguaauaagcuuugcaggauccagccuguucugaccuaucccuacugaguccccauagcauuuuguucccuccuguggcucuuaccuuguucucccuugcagaguaugggcauggagggcuucucuuccuaauccuuccuaaugguaggauccuaacaggacaaaucuguguaccuaucuuucuauccucccugagccuguaccaacuagauucuucauauguauuuguaacagauuaaauuggaaagcaaacaca

SEQ ID NO: 191371 - RNA, 22501 nt, Homo sapiens
cacucagaaaggccgcugggugcggggagcgcagaggcggugcagggcggcuggcucgccucggcgugcagugcgcgugcguggagcugggagcuagguccucggagugggccagagauggcggcggccgacggggcuuugccggaggcggcggcuuuagagcaacccgcggagcugccugccucggugcgggcgaguaucgagcggaagcggcagcgggcacugaugcugcgccaggcccggcuggcugcccggcccuacucggcgacggcggcugcggcuacuggagguuugggccgcguccgcgcuuuccccuucccucuccccgccuccccgguccccagacuggcucgugcaagccgagucccggggcccgggggucgcgucaacuccgcuggcguaugugugcagauucuccccgagucggagagggaauccgcccagccagccgccuugucaaagcguccuguccacgaccacagagcguuccucugucgcacgcgggccuccugacccccagccccgggccuucuucgcugcaccucggcugcuggcagcuucgauuuuucguuuagggaugcagccgccccggccgggaggugucagccacugccaggugucagggccucagcugucccggaaagaggaguuagacuaguucuugauucuggccucuauaccuagaacuaguugauggaagaggcagaucuugguguuuguuagggagagcuuucaacaauuagaguugccaaaagugcaauggauugcuucucaugagcuucccguuacuagaagcgcucaaauaggaacuggaagaacgcuuacuuauguggaggagaggagauucagcaaucagaaucuccuacucagcaaucagaagaagggacuggauaguaaaccuuuaagauucuaauccauagauuccaugagucuauuucuuggacaugugaccucugcgauuucuuggcaaaaacuaguugcucaaaacguguuuauugauugaaguaaauuaaggacugaucucucauugcagauuauucucuuauagaauuugccacuggggucaacuaauaaucuuuaacaggauacuuaaaauauaguuugguugacaggcaguucuucagggcugccucuauaacaugaaguacauguguuccuaaagcucuauacugcccuuugucgagcacaguuuagagcuguauuacucuuuuuuaucagccagauguagugagagugagaagagucugaggcuggcagcaugucuugauguucauacuaacaccgaaacugcaaauuccagcuacuuuugaugguacuggucucauccuuucuacuuuauagugguuaccuuuuauuccuuucuaaacuugaggcacgcuagagucagacagaaaguucauuugcacugauuaauucauagucaugauuccauaaagguuuccaggucuacgacauggcuguggaacggaaggugcaaaauagcaaaaacugacauuaaauuaaacuuuugaucauggaaagcaagguagaaugaacauucuuuaagauuucuuaggcaguuccccaagaacugaacuguauuguagcauuguguacaacccaccauguuucaagaguuagguaagugcugagauuuuuaucuuugugacacuuuuauuucaugguacuauacaauuuucuuuuucucugugugccaugacauaugccaugaaagacugaaaaaacuugcuuagaauacgaagaguggugcuaagguccuggggaaacagcaaggcauagcagcagagagaaaucggacuuuguuuugggcaugaguuagcauuguuuaggauccugcucaagucaugggcucgacuacuccagcuuucccucuucuuaauucucauuguguuuacugucauuccauucauuuacuuugcuauuuauauuacauauucugguagguucauucauuucuauccauccaguugguacucauggaauguuuacuauuugucagaaguauacaaguaaaggcacucagucuaaugaagggauacagagagaugaacaggcauuauagugugagaauugcuguuaacaguggaaacaaguuuauaaucuaauccuuucauuuaauagagggagaaauugaggccagagaaggggagugacuguagcagaauaaaacauauuaaucugucuuaauaaauggagguguaacauacuguaaaauguacucaucugaauuuuaccuaugugaaugcuuguguaaacaccaucgugaucaagacauguacacuuccggaaccuuagaaguuuuccuauugcgccuuccuagucgguguccacucucuacucucagaaguaauacucuucugaccauuugauugguauuaccuauuuccaaacuucauguacauugagucauacaguaucuggcuuuuuuugcgcaacauaguaucugagagauucacacauuuuguugcgugcauugguaguuugugcauuuagauguuguauagauucuuuuguauuaugccacaauuuuuuccauuuuccuuuugguggcuauuuggguuguuuccacuuuggggcuguuacgaaugaaaccucuguacacauucuuuuuuauguauuuuaguggacauacacacucacuucucuuguguauaugccuggagauggaauugcugggucauaggagagguguaguuauguuaagcuuuaguagauauugccaaacggugauuauaucaguuuccaaucucaccagcaaaauggcaguucugguuguuccacauccucacacuugguauugucagucuuuuucauuuuagacauucuggugagagucuaaugauacuucauuaugguuuuaauuuguauuuuccuaaugauuagagauaaugagaaccuuuucaugugcuuuuuggccguuuggauauccucauuugugaagugccuguucaaaucuuuugccuguuuuuaaaaguuggguugucuuuuacugacuuagaggauuuuauuauguauucugaaugugaguccuuugucagauaugcauacguuagaccucccuuuuccaagguuucacuuucuguggcuuuaguuacccacaaucaaccauggcccaaaauaugaaauggaaauuuccgggugcacacgugcgcacgcacacacacacaacgcaccccacugcuggaguucuagcugagaucaccuugcaucuuuagauaaauuugugaagaauugacguuuuuauaauauugaggcuuaaaauccauacacaguauauuucuccauuuaaguccuuuuugauuucucuuaguguuuuguaguuuucagggcagagguuguacacaucucuuccuagguuguuauuucuuaauucuaauuguagauucuuguggauauuuuacacacauaauuacaucaucugugaauagaugcuguuuuacuucuuucuuuucauccuuuaugccuuuuugguuuucuugcucuguuagacuagcugggaccuucaguauaauguugaauagaaguagugauuguggacauccuuguguuguuugagauauauugaauucaaaggaauuuucuauuuaugaacaagguaacauacaggcuuaccuacuucaauuguugacugcuuuuacuuacuuuuguaggcauggcuaauguaaaagcagccccaaagauaauugacacaggaggaggcuucauuuuagaagaggaagaagaagaagaacagaaaauuggaaaaguuguucaucaaccagguaaagugaguuuuucaaaaauaaguaucuagauugguuauuuugaguaacaugcauaauucuaugcaaagugaugcuaaauaaugccauaacuacuuuaaucagugaguacauuaucuuuauaaaagugauaaaguuuggcaguuuugcuaguagauuaaaaaaacaaucaaagaaacagccaugcauauggaaaugauuauuuaacuuguggcugauguacuuagggguugcugcucucuguuguuuuauaauaggcaggguuagccaguauauugauugguagaauaaauacucaaaauuaucuugauaggcugaaaugaggcaccagaauccaagagauaacauuuaggacauucuuuuauuuaucuguggagaaagaaagcagcuuacaaaguauaagauagaccagcauaaaaagaaggauguaacuaugaucuaagguuagugcuuugguaaaucacuuauauguacacauaucuucacagugaggguacuuucacacucuuugggaaaaagauagaaacacuuuauuuguucauaaguuuggcagccaacagugcaauauaacagcuuuuuauuaaaaaaaaaaaaaaaagaccuauuccagucuuuaguugcagcuacagaaguguugugcauucaucaauguaggugguugcucugcuuugaucuaugugugucuauauuguuguuugcagaagcugagacuugaaggauuaaaauauuuguuuuuauuugcaucagggacugguuuuguggaagacaaaacccagggugggguugggggguggcuggggaugguuucaggaugauucaagcauauuacauuuuauuguguacuuuauuuccauuauuauuacauuguaauauauaaugaaauaauuacacaacucuugcuuaugguagacugccaguuucugagugguaaauguaaaagggagugacaguuugaaaauuaucauuguguuuauuuaggaauucccauuauaaagaauauuuuaaauuagaaaacugcacauuuuaaauguuuugauuaauaaugcuauguaauagcuuccuaauugguauuucuaccacacuuucucuucauucuaaugcauccugguaaauuuuucaaagauaccacuuugacuaucacuagccuuguuccaaaguuuuuaguuuuccuuuugucuauagauaugcuucucuaauauucuacaaaaaaagcaugauuuuuuuguuuguuuguuuucuuaaaguuuggagauuaguguguuauaaugaaggagguaagggaaggcagugauaggaauauuuugaaacaaacaauuaaugacauaaugacaauuccccuuuucuuuuuuuuuucuuugagacagaguuucacucucguugcccaggcuggaguguaauggugcgaucucagcucaccgcaaccucugccuccuggguucaagcgauucuccugccucagccucccgaguagcugggauuauaggcaugcaccaccaggcccagcuaauuuuguacuuuuaguagagacgggguuucuccauguuggucagcuggucuugagcacccaaucucaggugauccacccuccucggccucccaaagugcugggauuacaggcgugagccacugcaccuggccgacaacuccuuuuuucuucuuguuggaaauuguggcaguucugagaguuggagcauucagccuaaagacuucuuaguaaaauuuauuuauuuacauauauauauauauauauauauauauauauuuauuuagaaagagccuugcucugucgccagccuggagugcaguggcaugaucuuggcuuacugcaaccuccaccuccuggguucaagcgauucucuuaccucagccucccaaguagcugggacuacaggcacacacuaccaugccuggcuaauuuuuuuuguuuuuguuuuugagacggaguuucacucuuguugcccaggcuggaaugcaguggggcaaucuuggcuugcugcaaccuccaccucaugggcacaagcgauucuccugcccagccuccagaguagcuggaauuacaggugcccgucacccagcuaauugacaccuggcuaauuuuuggauuuuuuuuguagagacagggcuuugccauguugaccaggcuggugucgaacuccuggacucaagugauccacccaccuuggccucccaaagugcugggauuauaggugugagccacugugccagccuuacuaguaaaauuuaaagacuugcugggagaaacaguucuuacaggauuaaguuccuuagcuaggcauuugaaguccuuaaauaaucuagcuuuaccuuaccuagagugguuuuucugugcugggaguugaggauacauggcugaauacagccucuccccuuaaagaguuuauaauccacaaggugagacaguugaagaagcuauuugcuuuguugguaggggauagaauggagggagacaaaauuuuuuuccauuuggaagugaauucuguuguugucucucuucuauuaccaugcuguuuauugcuuuuucuugugcaauguuggugcccugucuguaagcagaucccuuuuugcccuaccacucugggacuaaucucuuuuguacuuucagcagugcuguggugggcagaauaauggcccccaaagauguccaugccuuaaucacccuggaaccugugaauauauuauccuuaucauagcaaaaaggacuuugcagauaugauuaagguuaaagaccuugacauagggagaauauccuggguuauucagguagacccaauguaagcacacagguuuccuuaaaaguggaagaggggccgggcacgguggcucacgccuguaaucccagcacucugggaggccaaggcagguggaucaccugcggucaggaguucaagaccaaccuggccaacauggcaaaacucugucucuacuaaaaauacaaaaauuagggcuggguacaguggcucaugccuguaaucccagcacuuugggaggcugagguggguggaucacgagguuaggagaucgagaccagccuggccaacaugguaaaaccccaucucuacuaaaaauacaagaauuaacugggcaugguggugcgugccuguaaucccagcuacuugggaggcugaggcaggagaaucgcuugaacccaggaggugaagguugcagugagcugagauugcaccacugcacuaaaaccugagcaacagagcgagauuccaucucaaaaaacaaaacaaaacaaaaacaaaaauuauccgggcaugguggcuugcaccuguaaucccagcuacuugggaggcuaaggcaggagaaucgcuugaacccgagagguggagguuacacugagcugagaucgugccacugcacuccagccuggguggcagagcaagacuccauuucaaaaaaacaaaaaaaguagaagaggaaagccaagagucagagggacaugugauuauggaagaagugggugaugccgugugagaagccaccauugcuggcuaugaagauggaggaaggggucaugagucaaggaaugcaggcagccuauagaagcuggaaaaggcaaggagauggauucuugccuagagccuccagaaaggaacacagcccugccaacaccuugauuuuagccugcugagacccaugucagaauaaacuagagauccgugugauaauaaauguguguuguuuuaagucacucugucugugguaguuucuuauaacuaauguagcacuaauacaaguaccuuguacauggcugggauucagaaauauuuguggaauugcuacguuuuuuucuuuauguuacuuccuuuucuuuuuuccucuuuaauuuuuuuuuuuagauaaacauaaggucuuauuuugucuuuuacuuaaauguauuuaugucaggcauugcauacaugcugauaagcuaauaaaauagaggaaaauauauuguucuagucauaaaaaaggaaacuagaguucauuuuccuuuucuuaggaccuguuauggaauuugauuauguaauaugcgaagaaugugggaaagaauuuauggauucuuaucuuaugaaccacuuugauuugccaacuugugauaacugcagguacuuauuuuagaugguguucuuaauugcuaauguuuauguguagguuuagggcaaaacaaguuauaucuguuuggauuugauauuuucuuaguaauuaugaauuucauuuuggguguuuccuaaaauuucuaugguuucuauuuugccaaauacuguaaaucugugcuuauuaaagcuuaugauauaccccauaaaauaggaaggaugccgaugguucugccauagaaauuuccuuuucuuuuucugcuggccugaguuuuuuuuuguuuuuguuuuuuaacgucucucaguaguaggcugcuaacccuucucuucacccagcccuaaugaucccucuauuucuuaauuauuccaggguguguuacaucuuggucagaggaguggggccuucagugaaaggacaguagcuccgaauaccuuuuucauucaucuuuugcuacccucauagagagaauagaugaggaagaacuauauucuuccauucuuuuucuucuucuagacuuuauccuuuuuuuuuauaucacccagaauaaccuuucucacuucacgugguucuccuaucacuacuguuuacucagccaaaugcuguguugauaucuuuugcacauugaaggucuuaucuuggaaucuuaguuggcccucuuaccuguucccugugcuuacuuugucccuacaguccuaaaucaacuccucaccugccugaaggaccugcccuuucagagucccugcugcagacauugggagccaucaugauuggcuuguugcugagcagaauccuugguagauagagagggagauguggucccuggucucaugaucagauacauggcugggaaugcucuggcaccacagcuggaacuauagauuacaaacucauuucccaccgacacagugguuaaaguccacaguauugucgucauucuuaaaggccaguauagcuuuugggaacugaaacacuacauagaauuuuauuuccaagagaaaauggaagcaacucuuguaccaguuuaaagaaaguugugaauauauuaccuugccauagcaaaaggacuuugcagauaugauuaagguuaaagaccucgagauggggagauuauccuggguuauccagguagaccgaauacaagcacaugagcuuucuuagaaguggaagaggaaagcugagagucagagggacaugcgauuagugaagaagugagugaugcaaugugagaagccaucaucacugccugucaaaguggaaggagggggucguguucaggaaugcagguggccucuagaagcuagaaaaggcaaggagauggauucuuaccuagugccuccagaaaggaacgugguccugccaacaccuugaaaagucuggaaacauuacacuuuuauauuuaaucauaaucaggaacacaguccuccauucuuuuucaacaucaucaaagaugauaguuuuaguaccauauagucuacaugucuccuguuaguuuauacuucugaauuauuuagcuuuuguauagcucuucccaguuuuaacuuuuauguuuuugugauagaauccucugauagaaccuuugauuucuccccucccugaucuguaccugcucuuuaguguuuaccauuucaguaaagccagcuucauucgcuggcuaugucuccacucuccuguguguauuaauuccaaaccuguuuggcucuagguucaccauauccugaauucaucggcaucucauccucucccacugcugccuuagucuaggccaccaucagcucuugccuggaccaccgcaguaguguucuaacuggucucucccccauuaccccuuucgcaccccuagggucuccuuuucauauaguauuuugcucaaaaccuucuagugguuucuaaccauugucuucaccauugcuugcaagguccugacugucucugacuguaucucccaccacuccucaccaucgcuuacuucaggucuucuaguuacacugguccucuugcuguaagcucucuuugcaaaauacaccccugcccuagagccuuuucccuugcuguucccuuugcuaggaauguuuuuuucucuagauaauguaacuuaccagaauaaguaaaagauaaaguauuuuucuguuagaauucuuauguugcuaauuuaaccaugagaguugcaggaaaaaguauuuuauauguccuuuuugcugugugugccccuaaguugcugggcuauuugcaaacuuagcuuauuuaaaauaacuaauuuauauaauggacuuaaucuguuuucagagaugcugaugauaaacacaagcuuauaaccaaaacagaggcaaaacaagaauaucuucugaaagacugugauuuagaaaaaagagagccaccucuuaaauuuauugugaagaagaauccacaucauucacaauggggugauaugaaacucuacuuaaaguuacaggucucuaauaaguuguauuuauuauuuuucacucugguaaauucuuaauaacaaacuagucauaauugguuuggcuuuugcuuacagaguguggaaaaacucuuuucccuaguuuugcauaugcuucacagucauguauaaugacauuuaauaacauguuuucucauuuugcuuuuuucuuuucuuuuuucaaacaauaaggucucacucugucacucaggcuggagugcaguggugagaucauggcucacugcagccuugaccucccgggcucagguaauccuuccaccucagccuucugaguagcaccuggcuaguuuuuuguauuuuuuguagagaugggguuuuaccauauugcccaggcuggucucgaacuccagggcucaagugauccuccugcuuuggccucgcaaagugcugggauuacaggcaugagccgccacgccuggccucauuuugcuucuaauauggcacuuugaaagaaaccuguugcuauugggugauguuaagaguacaauuuggaaacuaaaaaagguuggaaugggagucaggcccuguuuccuuacccucuuucaccuccaucucccaccaaaaaagaaauauuuuaaaaaaagaaaaauuucaagaauuucauaaauaccuaaaaucuaacucuacccaucuggaaugcuagcgaguguccauauagcucuauaaucucagagcagaucgucucaacuccacuugcugcagauggguuauaggugugccaagacggugauccacuuaguggcuaggacugcuagugcccaggccaguuucuuugagucacaagcagccucuuguaucuaccucagagugguacaaauauuguaauauucuuuuugugcuguuagcuuaaaauauugggaggcauugcuuuagagcacaguuugaauauauacuauacuagaaaaucccauaucuccaaauaaaauuaagaagccauauuguaaaacaaaacguguacugaauuucauuaaauacuaagauucuguugauuagaacauucacuauuguuuuauguaccauuaaauauuuuuaaaugccgcugauuaaaaucaacauaugcuuucuuaucacuugaugcuuuuuauacuuggugaaauagugccauuagacuuuauuauaguuugucauauaucacgacuuuugcacacauaaaagggaaaaugcaagugcaaaagacuuaugaagguauuccuaaacuuuacauucagaguccaauucuucugcaccacuuuuugacucacaguuguuaaaguaccauuaagugcauuggugaugcagcauuuucagggauguuaaauugcggaaaacgugaugucucagaauauacgaaauaugaguguaucacuugauuauguuaaauuugaguuuggcuaugcugauuaauauuaugguccuuuuaacauauugugagagguauccugagcauaauucuuaguguguaaauucucuuaaaaucuaaguaaauacuauaaagaguaaagguauauaauguaaaguuuuaaaaguagaaugaagacuuuuuacaucaucuugguaccaaaauuaaaaaaaaauauauccugcagaucagaagucaagucgauagagacaauuauugaucuugaaggagaugaguaguaguaauugguaauuuccugcgguuggagauuuuuggagaugaccucauauuuaggucugauguggcuaaucugucaacaaacuguuucuuuggugagcccaccacaguugaucaaacucacugaccacguguacuuuugauuccugugacaauacagucagaggacaacuuuucuauuuauaaucuaauucagcauacguuuacugacaguuucauagguuuagauagauguuuuauuagaguuguuucugaucauuaauauuuaaaaucuuuaaauuucuaauaaguauuuauaaauuuauacuugaguuagaucauucuuugguaccuuuggauuugacaguuauaacuauaauauuucgcaagucugaaucacaacuuauuuaaauauggauuuuguguuguagauugugaagaggucucuugaaguuugggguagucaagaagcauuagaagaagcaaaggaaguccgacaggaaaaccgagaaaaaaugaaacagaagaaauuugauaaaaaaguaaaagguagauggccacauuuuauaucgugaaggauuguguuuuaccauuuugcaaaaagccuuuagcuagauucuuccuguuuaaugucaccaauagauuggaauguguuuuuuagagguugaaaaaaaugacuuacaguuugcccucaguauguuggucuucaaggcacuaagcucaaaccucacaguacgacauuucugaaaagcauguacgucaucaucuuaaagugaaucauguuuuuauauaggaacaaugugaggaucaggagugguaucacuggucaaggauuuggcaucaauuaaaucuuaaguaugaucaacagguguguuauaaaaaacacaccuaccaacaauccccucuaauugcuuaaaaugaaaagccaugcccuaagucuuagucaucuaauucagcagcuagaaggaacuuuuauuuuauauaugaccaaaagacccagaaagguggagugacuuguuauguagauaguuauuggcagaguugggacuggaagcaggguuuuuugacugaaagucuccaugaaguagucauuucucuauccaugcaucugucuuugcaugcauucccuuguccaucuaucgcugcauuaauuugucccuguuauccauccagguauguaugucuguuaagucugucuguauguucauccauccauccauccaucaauacauccaguauuuacuaagugucagcuaugugccaggcacugugcuaacauaaauucuggagucagaguuugucaggagagaaacuuaaaaucgugcaagugugcuagguaccaugauagugaugaacgugcggugcugcaggagcacagaggucacuuugugcucuaucacagaaucccuaaaagagucuuaaaaaaggaaacauacauguucuucaugcaguaauuaugcagagucccauuguaguguacaguguguagagauaacacauacuuuauguauauauucgguuuuauauauauacuaaauuaauucauugaaagugaacguccuauccauauaauuuugcucauguuuuuaggauucauaagugguuuuggagagugaauaaggucagaugucuuaaaaacaaaaaagcaaaaccaaaaauugaauguaagccuuccuuguugugaggaacacaaguuguuguaauccuucucauugugaggauuuguuuuuccuuugucauuacaaguguaauucaguuacagugcagaaaagagaauuacaaagagcucuuauugcaugauuuuccuacucagagacaaucaucagcaacauuuuaauuuuugcucuuccuguucuuuucuauccuaagauccuuaaauuuuuuuuuaaaauaaaaauggaagcacuguuugacacgaaguuaagcaacuccaugaucaacauccuuauacacaucuuuuuauauaguuacuuagcaauuccugaaucacaagguaaggcacacauucauggcuuuguagagagguuuccuguaauaagcugugccauauaagagcauuucauuaaagaaccuucccaaaauuagccacugcuguauugagaggauuuggaaagaguucugaugaauuuggcccuuuaaucuuuucagugcuuuacaccaguccuuccucuguaguagcaaggagaacccugaaagauaaaguagugaaaaggcauuuuaagaggugcgaaagggaggacagagugauagauuaguuauauacuagccuaggguuuuuuguuaacuccagcuaccugaaaucaccucaacucuuaccucuuugcugccuccuuaaaccauuuccaggugguauuuuggugcagauaauaauacauggauaaaauaauaaguauuaauuaaaaaccuguaucugcaaagugaugaaauauuuuuuaaaacgagggcugucuguacuuucuuagauacuaauucuguaauuuggucagugucaucuaaugguaacuaaauuccuguaauuugacaaacagauugaaagaugauggcauccauuucaucacaugcuuuuuuuaauaagaauucuauguggcauauauauuaguaguaugaacagaacucuuaaaagauuuaguuuucacugguauuacuuuuuaaagaaauauaaacuuuaauauaauuagcuuuuuuucucauuacauuaaauugcugcuguuaaucaccagauaagcuacugucaauuguccucauuuucgaagaguuugaauuugcccugaaguuuuucauagaguuagaccucuugggucugguuucuuuuucaguucgcuuguuauuugaaugaaggaugucuuuugaggacauuuuccaaagugguuacaugagugauauauuuuccaagugucucuguaaauagaaauguuuuacugcuuuugugcauaugaauaccuaaguucuguaacauuacuccacugucuucugguguuuaaugugcagagaggucagugugaugccuucuuuaauuauggcuucuuguugauuuacuuuagagguuguucccgccuuccugaauaggccacaaagggcugagacuggaguagacacuguagagauuagacacaaggagcuuacugugcaguuuucucagaaggcucagaacagagaggaauaaaagcaagucuaaaaguauuuuaguugaaaagaaauuggaaccugguuccucuuggucuucugauuuugauccacaaagaagcugacacaguuuacuucuuuaugggaagguaagagauuauauuuaccugcuuugagaauaugaucuucuacuuuagcaguuugagaauugaucuuacuaccaaaaagaauuuuacaguuuaaauaguauaagguguguauagauagauagauagauagauagauaaaaauaaggugaaagacaagaaaguguuuucuuguuagugaauucaaauuguucugccuuguuagauacaaggcagaaacugcuguucaguuuuuuuaacugguaucaaaacucuguaucaaaauauucaaaggaccgauagagaguauuuggagaguucuuuugaauuuggccuuuuaaucuuuucagugcccuacaccaguccuuccucucuucaguagcaaggagagccuugaaggauaaaguagugaacaggcaucuuaaggagucugaaagagaggacuguuacacauuacagaaaucaguuacagaauauagaaauguuuugauuucaaaacuucaggaugcacaggccuuaauauuagaugggaacguucagcugguucaaauguacagaacguuuuggguuugcaugucuacucuauaaauaagguagagauaaggcauuucuuuaguuauaccagcuuucucuuauuccauacugguagagguuacccuucuaaaaaaaggaaaauaaauucauuuucauuauuuauuacuauguacuuuccucccaaaagagguagguaagaaaucucuuaugggggucccaaguuuguggacauuguacauugugggccugugguuauauuuaugacucuggagucaucucucaagagaguucgggagacucaguucucuguuacucugcuuuaguuuauggaggacuaaagaagaccaaagcaucauauugucauugugucuuuuccuuguaauuuuuuuuccuccuguuaacaaggggcaccaugagucaauacuuacuguccuaccauaaaguauuuagaaguaucuugucucucgcagcuaguugucuuuuaaauuuaccucagaagcagcauuggguuuccaugaauacagaccaccucuuuugcaaaaccaagauguuaaacugaauacaaguuuuagauugguauaaaauaacauuuucauuuaaaaaaggauuuaggagaauuuuuucgucuguaaaaaguauaagcagucccugaauauaucaguaacaagacugcuuacacugaaaauuguuauaaauuuccaugaaaggcaguccuuaguuaauagcuuccagcauugugaaauucuaggccaauggaacuaggagguuggaacgugguaaaccacuguuuugucuccagcuucaauuaggccuucaguacugcguaggaccugcacccaccccagguuuccucagcuccccgaaagucgauuucagaccuacagaccuuuuuucacucuucuaaagccuuaccuuguuuuuaaaacuaccuccuucucauucucagcaguagguaguugauuucugcuuuccuaaguuuuaaguuguuaaaugaaguaaugugaaaaaaguauuuaucuuaaauuuuuuuuauuuaccugauguugacauuugccauauuuacuuuuucuuucacacacacauauuuugccaagccauuuaaguugcagacauugugauucuuauaaacacuucagcauguuucuccucagaacaauggcauucgacugggagcaguggcuuaugccuguaaucccaacacuucuguaaucccaacacuucaggaggccgaggcggguagaucaccugaggccaggaguuugagaccagccuggccaacauggugaaaucuugucucuacuacaaauacaaaaauuagcugggcaugauggugugugccuguagucccagcuacucaggaggcugaggcaagagaauugcuugaaccugggaaguggagguugcagugagcugagauccccccauugcacuccagccugggcaacaagagugaaacccugucucaaaaaacaaaaaacaaugguguucuucuacauagcuaaagaacaacgaucauacucaagaaacuuagcauuaauauaaugcugcuaccuuguguauaauuuaauauucuccaguuguuuugguguccuuuacagcuuuuugucggauccagguguuauucaaggaugaugcauauugauagcugcuuuuaaacuagucccucagccuuuuuugucuuucacgacauugacauuuugcagugcccaggccagcugcuguucagugugucccuccauucagauuuguuagcugcuuguuuccucaguuagacucaggucgaauguuuuugguaggaauacuuucaaggugauguguuugagcauuuaucaguagacacaugguaccagcucugucuuuuaagggagugguaguuugacugcuuaguuaagguggugucugccagguuuuuccauuguaaagguacccuuuauccuuuguaauuagugagaaaucuaauacuaugugaauaucucauuccuuaccuuucacucagugguuuuaguacacagggcugagucuuacuuuaguuauuauauuggauauaaauggugauuuucuauuucuuucacuuucuguaauuguuauuuggcuuuuggaaagaagagcuuuucuucucuuagaaacugauuuuuuuuuaagcaucagcuggacugauuguuucuuauucugaagucaauguauuauaguccauuccagucaugauucauuuugguguugaaauuguccaaaauuugcccaguagaauccccuucaagguagcuccugucuuuuuaaacuauuuuguuuggaaauauuucaaacuuauaaaaaauugcaaggauaauaauacaaagggccacucauauauccuuuuuccagauuaccuacuguuaacacuuuaugcuauuugcaucaucauuugcaugcucuuucuauacauacacaguauuuauuuuuuuccgaaccauuuaagacuaaguuguauacaucaccacccuuuacccuuaaguauuacaguguauauuuccuaauagggauauauuuuguuacauaaccaaaguauauuguuaacuugaguaaauuuaacauugauuuaguauuuaugucuaaucugcccuccauauucuaguuuuguuaguugaucuaauguucuuuuuaguaauuccuuucuagaacagaauccagucuaggauuggguauuggcuuuagguaccaagucuuucuaaacuuuucugggauauuuacacagcucguauuuuuuaugacauugacauuuuugaagaaaagucugcuuccccugcccugcccuucaaaacaugcuucucacuuggggcaguuucugguguguccugcugguuggaugcaggguaugcauuucaggcuagggacaguaagugaugugcuuuucuccgggccucauaucuggaggcacugaugucuaucagcccucagugguaauucugauuuugauuugauaagcaaaaagaaauuguaucccccuagauuuaguguccauccauugauggugcuugcuagaaccagucuuuaguaugaugguuauaagaacugucuucuaauuccagcauuccuucugcauuuaagcaauuggcagucagcauucugcagcauccuuugccccauuuacuuaucauugguaugaauucauuaauuucuguuuuucuccaguggcuuugguucauuucuguccuuacuuuguugcucaaauggucugauuuggccuagugacuagcuuuuguaucuuuugacaugucauuuccuuacuuuuuuuauuuacuuauuuacuuuugagaccuaguauugcucugucacccagguuggagugcaguggcgcaaccucagcucacugcaaccuucaccucccggguucaugcgauucuccugucucagccucccaaguagcugagauuacaggcauaugccaccauguccagcuaauuuuuguguuuucaguagagaugggguuucaccauauuggccaagcuggucucgaacuccugaccucaggugauccaccugccucggccucccaaagugcuagaauuauaggcgugagccaccaugcccagccuuaugucaucauuucuugagcacuccuuucugcuuucuagcacaacacauguaucuguauuucuaugucucugucuauaaauauauguaaaccuugaguuuacacugauacauccaguuuuaaaauuucaugguucauuuuaguuuuacuuauacuggcuuuuuggaugaugagaaaccugguggcucccaugauccuuaauauagugacuugaucaaagcccuaugugugacuaauucccauuacuguugcugccuccucuucuggagggagcccuuuuucuugggcucucucacccuccuauggaugcuugcuugcuccauaggacuggauuguucagaaagggaaagaaggguaaaaaaaaaagaaaaacccaaaccuauccauuuuuaaauacuuucuuauguucuguuguuuuuuucuuugagacagucuugcucugucaccuaggcuggagugcaguggugcaaucauggcucacugcaggcucaaacuccucggcuuaagcaauccucccacuucagccucccaaguagcugggacuacaggcucaugucaccguggcuagcuaauuaaaaaaauuuuuuuaauuuuuuauuuauuuauuuuaagagauugggguuucacuguguugcccaggcuggucuugaacucccaggcucagguaauccucccaaagugcugggauuacaggcaugagccauugcaccuggccccgaauacuuucuuacuuucuggcacaaguuuuucuaggaaugucuaguaaguauuaaagauauggcuuuauucucaccauuauauagccugacauacuggcugaagaguggggagaaaaagucaaagucaauguaaaaccuuagguucaauuauggcuagacagacagacuuuuacuacaaguauuuuuuuuuaguauucagaaaauuuuucuuugguaccucuuuuuaaguacacauaauauucaaauuaggcagagaaguuaguuuagcaugauugcgcugcaguaaaauuuuguaggauuuucagugggauaaggugagaaccaaguugaaaagcagguauuagaauucaaguaggcaacaucuuccuuacauuaucugaaaccagagggcaucuguggaguucugguuagcauaucauuuuuuauuuagaaaauauccuaaguaaaauuuaaaggaaggagggcauuccagaucuauaucuagaaaaaccaaggucuucagaauaugagaggaugcugaaagaaaugaagaguuuggaugaacauuuuuuucuuccagaccaaaaacuaucuagagguauaugcacuaaaauaaugucaaaguacuuuucaugcuagagguauccaucaacuauauaaccuugagcaacuuauaacuucucugugccuugguuuucucaucuguaaaauuggaguaauucuacuuaucuuaaaggguugugaggauuaaaugcauuuaaagugguaagaacacugccuuauacauagcccuguguuuucauccucauaaaagcugaaaauaagguucaaguaguauuuugauacuacuuauagaucuaaaauggaucagggaaaauaugugauuacuugauguauguuauuuuuauagcugagauuauacaagacagcuaucauaaucucccuuagguaaugccacugucaaagauaaugaagaacuggguggaucacuggugagaauagaaguguaaaguguugcuuuuuauuaaaauaugauuuacuugguugcuuucaaagaacccaauauaauuuucuuuguaaaaugauuuugacacgaaguagcagaaaaagcuccaaacauuagaauaugaccaguguccuggcuucacaguuaaacuaucuuugcucaguuucccuacuugcaaaauaaagugaaguaaaaucaaaacucugugguucuuuccagcucuuaacauucugugauucuuauuuuuagcccucuccuaaaauaaugcugucaucuuauaagaacuucaacagacuugaggucuuauugcacaagcacuuuuucuaagaugaaaacauaccagcauagugguagaguucucuacuuucuaguuuucuugcaaagcuugacuugaugcuuauugacguagcuccuaacaggaacuuaaaaacacuccuuuuucuuaauuauuucagcugacuccuuuuccuacuguggcauucuguuaucugaagucaaacguaccugaauguguccuauuguguuacucaacucacuucugaauaugguucuguuuugcauaccaccaacccacauaaccauuucugaaucucuuguuucacacugcuccagugacaacuugauucacaggccgaacuagugagguaagaaaguaaguuugccaaguuuguauaaucaacuuuguuauaaaauuaagguaaacuauauaugguuuaaauacacauagacacacacacauguacauggcugaaagcuugauggaguuggauuuuuggauucaccugaauagcaccacugaaaagaugacuuuaaaauuuuuuuuucagaauugcggcgagcaguaagaagcagcguguggaaaagggagacgauuguucaucaacaugaguauggaccagaagaaaaccuagaagaugacauguaccguaagacuuguacuauguguggccaugaacugacauaugaaaaaaugugauuuuuuaguucagugaccuguuuuauagaauuuuauauuuaaauaaaggaaauuuagauugguccuuuucaaaauucaaaaaaaaaagcaacaucuucauagaugaaugaaacccuuguauaaguaauacuucaguaauaauuauguauguuauggcuuaaaagcaaguuucagugaaggucaccuggccugguugugugcacaaugucaugucugugauugccuucuuacaacagagaugggagcugagugcuagaguaggugcagaagugguaggucagcuacaaauuugaggacaagauaccaaggcaaacccuagauugggguagagggaaaaggguucaacaaaggcugaacuggauucuuaaccaagaaacaaauaauagcaaugguggugcaccacuguaccccagguucuagucauguguuuuuuaggacgauuucugucuccacgaugguggaaacaguggggaacuacugcuggaaaaagcccuaauagcagaaauaaacauugaguuguacgagucuga

SEQ ID NO: 191372 - RNA, 119868 nt, Homo sapiens
aggacccggaagugagggugugagaggccucucuggaaguugucccggguguucgccgcuggagcccgggucgagaggacgaggugccgcugccuggagaauccuccgcugccgucggcucccggagcccagcccuuuccuaacccaacccaaccuagcccagucccagccgccagcgccugucccugucacggaccccagcguuaccaugcauccugccgucuuccuauccuuacccgaccucagaugcucccuucugcuccuggugagugagggaaugacagacccaucgacaaacgcacgaacggccuccggcccucgcccagggggaacacugcuacuccugccccugcuuuuccgucuuuuccugcaguguuuuggagugcacccucccccgcugcccucacucucgccugucggcuuccaggcgcggaguccccgaggccugagaaaccagugucgggggagaaugggagaauuagcccugagggacugauacguagucacggcguaggagcuuccccuucuccccgaaguccggggguuucgguuucgagggcuaguggaccuggugguagcuugaaucggaaaagaccaagcauagaccuagcguuccuucccacccucuccauuugggaagagugugaggucgacaggugcugggguugugugacucucacugggucuagaucccugaagcggugcccggguuggcagaucccucuguuguggcuugaugcgauugguugggaacccggaacuggagacugguuuggauuccacugggagaauagaguuugaaggguggaaggugugguuaccugacaaucucagcucaaggccucccucaaaucuuauugcaacguauuuccccauggaagcagauuucuucuucauugcgccuuauuugaauaugcauucauuccuaacugccuaaccugcucagcaucaucccaucuuaaaagaaucuuucccuagucccucuugccccagaguacgucuugagugugcagacuaauugauccaggcuucaggucaaauugagacaaaagcgaaggacuaaacacguauggcaaaauggcuuauauuuaauugggcuguuaauuauaauguaauauuugaaaguaccuuaauuguaguagauuuuuagaaauucagauuuaaacauuaagaacuacuuucuuuacaauuuaagaaacgauuuagugacgcauaugaagucacacagcuaguuacaggcagagcugggauuagaaacaagucucuugacuuccagugcuuauuccgccauaucccauuaaauguuuaauauuuguguuugaaauaguucuuucuuuucuuuugucacuuggaccuuuucggaaaaagcacuguaaaaaacuaaauggcaugucaaaguacuuuugagaacaaaaaguuguguauaaacauuguaauauuaaaugauagagugucuuauugccacuucuuauaaguauacaacagugaaugacuucuguaucgaggaaaauauucuguauaguguuguuucuuggugauuucauuauacacugugauacauuuuuccuucuagaaguguuagaauaauaccauuauuagagaccacucucuccuuaagaagacuggauacuaaucuuauccacaaaauggcuugaguuaugaauugugugcacuuuuaggaaaucaaaaaaaaagggcaaaaaucuuaagauauuguaaagaaaaguugagacacugaacaggcaaacuauaucagaugcacuuuccucaaaugguaugguuugguuguaaagcuaaguuaugaagaagaaauaauuuauuuuggaauaacucaugcuuuuuauagaaaaaccuaaucuuguuaaauaugaguuuuuucccaaauagaaucuagauuuaacuaaaaucuaagcauuuuguauaauuaucuuucuaagcaaauguaaaggcauaaaaaucuggaaaauauguuagagaauaccuguagauaugaaaaggcugaaaaagccccagaaaagguuuaaacuagaauuacaagucaaacuagauuuaauuggaauacaguguuuaccuaguuuuaauacucauaugcuaguuagcaaauauuuauaaaacaucuauccugucuaaucgcaacuuugaguugcuuacuuaacugguaauucucuccuacugauggaaccuacuuacucaguauucucgcugucuaauaauuuguccucuuuguucccccguguacuuuuuuccuacucuuccaacuuucucucucagaccucaaguuuauuccuucuuacauacagauaaagaaaagccaaguucccauuuagcugaggucaucauuuuuuccuuaaauggccuccucuaaaaagcuguauauucucuuacuaugauaauuuucuucaggcacuuuguaccucaacccuaaagaacuagaccuguucaaauuuagugguguucauauaagauaacaguugaaacauaaucccaaacuucuggaggcaaguagcuaucuuuucccugaucucaaagcauuuuggaauauaucacucugccacaaagccuuucuggauggguaacuaaacacaaaagcucaaugugauaacuuuuuuuccugagcuuuuauauguauauauaucuuuuauauauauauuuauuugcgucuauauagauuuuuauuuacauauauuuagauagauagauuuaauuagcccuuuucugcuuaucuuccuaucuaagguggguuuauucaggguuuuccgcugggaaaaugaucaguaagggggauagaaaucuugccuguuuuuccugcacugguuguguacaaguuuugaaaaggcgagauaagagaaauaagacuaaauuggaaagaaguugucucaugcacccuagguaaccucuucuguaguucagauuuguagcacugcaguccauuuguuuuauugaagauguguucucauuaaucucuugauaaguauguuuauagaucauaauuguuacuagucguaauugucccgcaugugaacacuuaaggguuuugccauuguuguucucgguuuguucaauauguauagguagucaagaaaaguuugcuuaguuuagguagcuauguaaauuugagagcuaaguaaacauuuauuuaaucguuacaaguaccuuaaaaauaagcacaguagaauucagagaugucaguuuuauccuuuaauguuaauaauauauguagauuccagucuucaggaagaguacuuuuggaggcaugcaguuugauuaauaccuaggugagguuuuauuuauuuuguugauuuaacuuacccuagaucaauaguuuacaaagccuggcugcucauuagaaucaucuguggcaguuuuaauaaaaugauaucggggcccaauaccaggucaguuauaucugugagccccagaaauuaguuuuaaaaaaaaauuucccaggugacauacuaaaguaugucccucuaaaagguaagaauuaaacaaaaccacaauaccauuaucacaucuggaaaaauugacagaaauuccuucauaucaucaaauaucuggucaguguuuggguuuuccugauuguuucccuuuuuuuaaaaaaaaauaaacagcauuguucaaagcaagggcuauauaaaguccaucuauuccaauugguucauaugucacuuauaaaacuuuuuaaaucccuagguucucucuccaucucaucauuuuccuuauaauuuguuuaggaaacugauccucuguccuguagcauuugccacauucuggauauugcugauugcauccuugugggguuuuauguuucucuguuccuuguguuuccuguacauuuguaauucaauuuaugugguccuaaccaccagcugcauauauauuguuagguucauuuguuucauuuaucuuucaauuuuuaguuuuuaaaaauuuaccuuuuauuuuauaauuauauaaaaucucuuccaaaacuaaaucuguaaagcuaacuauauuuggauaagucuaauuuguuugucucuuuuacugucuuaucucccucuuaauaaaauagcacuuuuuuuuuuuuuuuuucuugaggcagagucuagcucugucacccaggcuagagugcagaggagugaucacagcucacugcagccucaaccucugaggcugaagcaauccuuucaccucagccuccugaauagcugggacucugggacuacaggugugugcuaccacaccuggcuaauuuuuuuuaauuuuuguagagacaagggucucacuauauuacccaggcuggucuugaacuccuggcucaacugaucugccugccuuccaaaguguuaggauuauaggaaugagccacuguggcagaccuaggaaaauuuuuuuuuaauuuuuuuuuugaguuggagucucacuguguugcccaggcugcagugcaguggcaccaucuugacucauugcaaccucugucuccuggguucaagugauucuccugccucagccuccccauuagcugggauuacaggcgcuugccacugugccuggcuaauuuuuauauuuuuaguagagaugggguuucaccauguuggccaggcuggucucaaacuccugaccugaggugaucugcccgccuuggccucccaaagugcugggauuacaggcaugagccaccacgcccggccuggaauacuuuuuuaaaaacuuuuucaauuuuaugucccuuucuuccuuuuuuuuuuuuaaagguacaagcuauuuguauuuauuuuggcauauauuuguuucucccuccacuuggauuaaauuguagcuuauuagucacacuuuucccccaccuuuuuuuuaacuuaaaauuuuauucuagagaugcggauagaaauuuugccuauuucuuuuuaacugcuuaugcuucacuggauagauaccaguucacuguuguuaccauucuuuugcuguuacagauagcucugcaaacaauagcuugugcuuacguaauuuugauaguguaucuuugagauagauuucuguacuugcaguugcuagggcaaaagguaaauguauauguagcuuuguagguauugcuguauauuugaaauuacucuccguauagggguugugccauuuuaugaccucaccaacaauguaauaguuucccuguagccuugauuaaaaagguauaaugucaaauuauuggguauuugucagucugaugggugagaaaugguaucucaauguauuuuaauuugccugucuuuaauaugagugugaucaagcuucuuagguguaaaagucauuugcauuucuuuuugugugaacugucuuccugucuagccugguuuucuguagaauuguuggucuucuauuucuagacuauauagacacagacacacacaguucuuuuuuuuuccccccccacagacagggucuugcuguguagcccaggcuggagugcaguggccugaucuuggcucacuguagccucaaccucccaggucacgugaugcucccaccuuagccucccaaguagcugggacuacaggcacaagccaccacacccagcuaauuuuuguauuuuuaguagagauaggcuuuugccauguugcccaggcuggucucgaacuccugggcucaagcgauccacccgcuuuggccucccaaaguucugguauuauaggccugagccacugugcccagcccacacagaguucuuaacccuuuauauccuuaguugauucugugaugaugcucacaggguugagaagcacuggaauauacagccauaugugaauucagucauaugucugauagguuaaaauuuguaaaaacccuuggagauguuuaauugcuuacaguuauugaaaacuuuuucuaaacuguauacugugauuuuuaauagcauuauagaagcucaaccuuuaaaugcacuguagcuuacuucauuauuuguuaagacauuuugguuacugguuauuucaaguuuuucacaguuauaaaaaauguacaaaagguaugcauacaaugauguucucugcaaauguucagauacauucucagguuacuuuucuagaauuauauuuuuuggguuauauggugugucuuauauuuagaauuucugauauguuguacuaaauugcccuacugaaaauuuguaccaauguguauuccuaacagugugugacuaugcccacuuccucacacucucaucaguagugaguguuuuuguaaucugugccaauuuacuagaccaaaaaugguaucacaauuuaaauuuacauuucuuugauuacaaccaaaguugaauuuuuuucauauuuauugauaauuuguuuucuugugugcauguuuguauuauggguucuuguuaugugucuucuuuucaaaaaauggcuuacucuucuuccaguaauucagaaugaauguacucacaagauagaguuuaugaacaguggaagguauuauucuuuugccucuucauuagucuccauucaaaaggcaguguaaugcaaaaguagaugucauggcaucuauguaaguuccgacucuuccauuuacuuaaccaucauaaccuugguuaaauuacuuguuuuucuugucuauaacguaagcacauggauuugaugauucaaugauucuuuguguagucuaucuuauuuucaagauagacuacaaaaggguauuccuuuagcuccuacugauuauagacuuauuauuugauuggguaguuccuuuaaaaaucugcuagcuugucagcauguugcacauguguauggggcaugcuuagcaugcuuuugucacagcuuaucugauauugacucuugcuguacucuauuucuucuaaccaagaagauuaaaaacaguuugaguuuuugcaacauuuauugauuuuuagccuaacuuugauuccauagagaggaacucaucuauggcccaggcugcagaaacuuaaucuguaucuuuguuauuauuuuucuuuucugccuaucauuugaaagucuauuugcaaucuacuauggaggagaaaaagaucauugagaugcauaucaugccuucaagaaauuaguaauucagaugaggagagaagauauauauauaaauaauuagacuaccaaaaggaaaguaauggaugccaaagguguuuguagaaguggguuauagauccugcuacucagaagugugauugugagcccaggcaucagcaucauaugagaccuuuuagaucaccucaccucagaccuacugaaucagaaccugcacuuuaagaacuuauacccagaugauucauaugcacauaaaaguucgagaaauacugccauggauguuuggaagaaacaaauuauuucucaguggaggaaucagaguagucuuggaaaaagaugaauuugaauauugccuugaauaguuaaauggaucaacuuauuuucaguccugaauggaaugaagaaaaagggcagugccucucaauaacauaguaaaucuuuucuaucaauugaauacuuguuuuuuauuguuuuauuuuuaagaaaucuuguugucugguuggcugacguggccaaaugucagaauuggcccuaaagaagcuggcaaacccuuuggccaacuucauuaaaacaguuuguuaucaacuuagcaaaaauaaaaaucaugaucuuuaguggguucuaacuagccuucagauuaguccauucaagaggggagaggaauaaaaugccacuuuggagaagucccuucuguaaugcugugggucuugguucuguccuugcaaagacugaaaucgaauucuaacugcuuugggaauccuuggugauauuguggucaccacauucaucucugcaauuccuacaaaccugagauuucaucauuauguagaacuuugagcauuauauuggacucuaauuuuaagucaccugaauuuguagacacgaacauugcuaauauaguagagaaaagcaacaaaaaagcagaagaaacccaucucagaaaaacauuguaguaguauuugagcuaaagaaaaccauaggcugaauaguagaauaccaguacuuuuuccauuucuuccuuauuauagucuaguagugggaccuuuggugaauggauuuaagaaauuuuagaaaaagguuguuaggucauguuugacauccuucugggaaaaauaaauuuuuaaaaauaaaaaagaggucauuaggaauauagauuaugaaugcaucuacaaaauaaaauguuagaguuaaaauuucuuguccuauagacaguacgcacucauauuuacaagccugcucuuuagcuguuuuguuguauauuuuuuuuuuuuugaaacagagucucacuccguugcccaggcuggaaugcaauggcgugaucucggcucacugcagccuccaccuccuggguucuagugauucuccugccucagccucccagguagcugggauuacaggugccugccaccaugcccggcuaauuuuuguguuuuuaguagagacgggguuucaccauguuggccagacuggucucaaacuccugaccucaggugauccaccuaccucagccucccaaaguguuaggauuacagccgugagccacugugccaggccuguuuuguuguauuugaaguuuuaaauaauguagggggaaaugccagcuuuuaaaaauuaccaacacaucauugaagucuaucucuuugcuuauagaacagcugcaaguguaagauaauguauugucauuuggcguuaccuugagagaagaaaccugcacauccucaguuccuuugacuuauuacuggaguucuggcccaaguacaguaaaaugucagcuagccagugauaagcuuacacuucuguaaugauuuuaccucugaaagggcugagaauaaagaauagcuacuuuuuuuuucuuuuuuugcuagucaaaauaauuucuuagaaaacagcuacucaaauggacucauuccucaaacuuucuaaauagcaggaauuuuuacuguaggaguggauauuauuuccucacaggaagucuuguagugugcuaacaacaaaaguauuacaauguuguaaaauacuuaguucuuuguuaguuuaaccuuugaaugaaaugaacaguuucagagacccuaauuuugcuuuagaguuacaguaguccccucuuauccacaggagguaauguuccaagaugcucagugucugccugaaauuguggauuauaccgaacccuauauauacuauguuuuuucuuauacauacauaccuaugauaaaguuuccuuuauaaauuaggcacaguaagagaucaacaauaguaacuaauaauaaaauauacuguucacaguuucuuuauagaagauuuauucuuaaucuagaucuuagccaccucagcguaugauuuauuuucuuuccauuuaaagucaagagcuuucaucuuuucacuuaaggaagcgcuuuauggcuucucuuuggcauaucuuuuuuuuuuuuuuuuuuuuuuugagauggagucucacucugucacccaggcuggagugcgguggcgugauauugguucacugcaaccucugccuccuggguucaagcgauucuucugccucagccuccugaguagcugggauuacaggcacucgccacuacacccagcuaauuuuuguauuuuuaguagauuugggguuuugccaugcuggcuuggcuggucucgaacuccugaccuaaggugauccgccugccuuggcccuccaaagugcugggauuaacaggcaugagccaccacgccuggccucucuuuggcauaucuuaauugccagcaucacuacucuugugcuuuggagccauuauuaaguaaaguauggguuuuugaacacaaguauugugauuccaguaccacuacaguugauaaggggcggguuaugucugcagugggaauaugcuggacaaaaggaugauucacaucccaccuaauuugaagcaagaugguaugagacuucaucacacuacuuagaacugcaugcaauuuaaaacuuauaaaguguuuauuucuggaauuuuccauuuaauguuuucagaucaugguuggauaaaggggacuaauguaaagacugugcuacauuuuuaaagcauguaucuuauuuguuucagaaaucauccaguuuguuuauuuguaccuguacucugguuuuaggauaucuucuggaauauucgaaguauuucuuucccuuaaugaucgcuugaauauauauagacuaaagagaaaacuuuuagaagaauauuuaguuuagggaucagggauuugggcccaaaucuuggaucugcuacucaccacccuucuuucuucuuaacaucucuauuuuccuauuaacuucugaggaauaauacugguauuaugucugacuccuaaguggugguguuauuccaugcuacuauuaugauuuuaugaaacaaaaaguggugaaagguauccccuuuucucauucuuagaucucaguuuguuguacaaugccuuauuauagaguaaaugcuuaauaacaauuuaaguacuguggaaaaagaaaagguagggcuuacgugagaaggaucaggaguguauuaggggaguuguaguuuguaagcaucacgggacaggugagccuugaagcaagugagggaguuagucauuuggauuuccuggaagaagagccuuccaggcagggccguuagucagugcaaagccccuaaugugggagugucccaggcauauucaagaaauagcaaggagagcagcgugauugucauauagugaauaagauacagcauauuagaagaugaagucauuuaguuaaaacauauuuugcaaaaguguacuugcccuuacuauguauguuguuuacugauaauuguuuuucuuuuucuauucugugcuuuauuuuauuuuuuaaaaauugcugaucugacucaguagggaagaacuuccuaacuggguggcugauauuauugaucucuucagccuugccccauuugccucuguugggaguagccuuuguuguuuugauucucuguuacaggaggggucccaacuugcagugugaaaaauacuguuguaguaacuuaaaauguuaaaccaaaagauuuccugacguguuuuuugauucccgaaagugauaacacuuucaugguacagaaaagcauaaugaagaaaaaaaugcguacacuaaccacugauaacauuuuaguguauuuccuuucgguuuuauucugugcauaugcguauggauuuuuaauaguaauguguauauuuugaacaauauaagauugggcucuuuuuguuuaauccugauguagagugguagacuucugguucauagaaauauagaaagaaaagauaccacaugcuuagauguauucuaccacuuggaaauaacuccuagcuugaccauguaacuucaaaaaguuauuuaaccuuucugaguuuccauuuucucacauaucagauagagauaaagaccucuccugcuuaguucuggggcagcuaaugagacugaaugugucuguagugcauuauaagaaacuaaacucuccugguuuuugccacauaauagguguucaauaaauguuaagaugagggacugagugaaugaaugaaugacuaaauagauacccuuuuuuugaaacuuucaaguugucuguccaaugguauuaaaauugugugcacugauguaaugaguucacuugaccagcuuccggccuuuguggucuguggucuucuuauccuaauaauuacauugucauuaugccaacaaaaacagcuuaaaaaugugacuguuaagugaauaaguuaucagcuuagcucuguuuuauaacuguauuuuaauuaguguuauacauaaauuuguuauauuauuuugaaaaaagcuuauggagggaguuguguuuugucguauaguccauugguuuuagaauuaaaggagauuaggguuugaauucuguucugccauuaauuuggacacgucacuuagcuuauuugaaucuuauucauuuaauaaauauucucccuuuuacuguaugccagagacugcaaaguuuuuuuuuuuauuuauaaaauagggauaauguaauuccuacuucacguucagaguugcuaugaugauuuaaagagauaauauacauguuuguaaacuguugauagaagauacuguuagauuaaaauauuuguggaugcuucaaacauguguuuguuguguggauucuuuccccagaaggcuaggugugcaauguauuucccuuucagggagaguugaucaauuauggaaguaguucuauggucuggauuucugggguaacugagaguacuagaagguagagugacuuugaagcuggaaagaccugcuucauuccuagcucccucucuuuuuagcuguugugauaguaggcaaauuucuuuaucuuuuugaauaucaguuuuucuaaaagugggaauaauaauucugcaagauugugagauugagauauaauguauguaaaggacauuguaugaugucuggcauguaggagauacuuguuuguaaaguaauaguagagaaggaaauguuguuaagugaauggagucguugugaaauggagaaagcaccuuagaaaaggauagugcuugugcugaccauccuucugugauuguuaucuuuugacucucugaaaugaguaaaugggugaggcuuuuaauuuuaaaagucaagucuagauauuagugguuucuuaaaguauuuguuaacuugucucuuuccuuugguaaguuaugacauagccuuaucaaaauagugacaacuauaauuaugauugauagaaauaaaaaucuaacuugauaugcauuucagcuuuuaauacaaaagcaaauaaauuccuguaagugguauaaaugaaagugaggaaacaugcguuaugcccugcuguuugaaagguaucauuugcacuacauagaaaaacaucguuucuauuaccuugaacauucaaaaucauucaaaaaagauuaucucugacuguuguaauugacuagguauauggaaaaugaugacaaaucuuuagaaaaauauaaucuuucucuaguugaauuuaguaaggaaagaguagauuauacugcagauuucucauuacugaaaauaugaaaaaauaaaaauuccguuuaaguguggaagauuuuuuguuuuguuuuugagacagaguuucgcucuuguugcccaggcuagagugcaauggcaugaucuuggcucacugcaacuucugccucccagguucaagcaguucuccuaccucagccucccaaguagcugagauuacaggcaugcgccaccauguccagcuaauuuuguauuuuuaguagagacgagguuucaccauguuggccaggcuggucucgaacuccugaucucaggugauccaccugccucggccucccaaagugcugggauuacaggcgugagccacugcacccagccaguguggaagauuucaaauugguaguuaugcaguuucauuugcuccuguaaccuuaacuuacguacaccauaguuaucauaguucuguggucuggaauauugcuuccauggggguauaguuuuuuuacacaaaagcauauguaguauuuacuacuuuuaguaaguuuuggcccuuaagcuaaaucuguuuauagacuugaugaaacuggggauuuaacaaaucuauuuaaguuuagauacuguaaugaagguauuuggugagaaccuguuggcagauaagauugauuaugauggauauuuuaauuugagauaaagaaaaguucauuauauggucuugcuuuucugaucucauuaauaguuacacauauaccuaccauuggaaagauggagaguugguuaaaagaggaggguaaauuguauuuuccauucuacaacgauaaguaaaauuauaaagacuuccuugauacacacuaguuauugucuugaauaaaaaaguguuuuaaaauauauaauaaccgagcccucaguaaauuuuaauagcuuuuaauucugagaaguauccaauauccuguagcaaaauaaucagaggguucuguuuuucuucuucauuuguaccaugaggcaagauaaaccaccuggcuaguaugacugaauuaguuaauugugguaaggcuguuguguuuguugccuuagcuuuuugugguugaugccuuucuuagcuuacuuuauuuggggaauaccccuuucuacaguaguaucuagugucucuggauuaucuuuagcucuuacuucuaaugcaaaacggauugugguauuuaaggaaauaagcagggagcuuuauccauaguuccguaugauacgauuuucggagagucugucacuuauuuuugaauauuacuuugaaguauuaguuaauaaauauucuggaauauuguaaaaauaggauaaaagauguuuucuugguaucuuuaaaugcacuuuuauucagguuguuuaaaugguuuuuaguuuaaagaagcaacaagggugucuucagggcacaauuucuuuuaagagaaauaugaacucuuguauuauuaucaguuuauuaacccauugucagguaaugaaguaauucauaucagucagauauuuuagguaauuaaaaccaauaccauuaaagcaaaacaaguuugguuggaaaucauuuaaaaguauacacagucauccucuuuauguuuagguucugaaaugguguuuguuaaugcccuugugcauaaguccagaguggcacauuguacaagggauggcuaauuuuaucuguuggugacaggcagagucaaugugguuuugcuugauuugcaucugugaaaacuuuuaaguuuguaguuagaaagauuauaaauagaagagcguguugucugacauacuggaggcuaucauacaugauuuaacuuuuuaagugacugugauguauucccuagguuggaguagcuuccuaauuacaaauuauaauauccuuugguaagucuucuguaagacucugagagcauuuccuacuguuaacuaccucauucuucccuguuaggcuauuuucucugguucuuuuaugcuccaguaguuccaucugucuguccgucugucuuucccucuguaucugacuguuuucucuugcuuuuucacgggguggaaaagggaaaaauaucuacauuuaagggacagaagaccguaaggagauaaauguggauacucucuaauguacuaucuuagagcuuuucucccguccuauugcaucuugauagccagucauuuuaauucauaaccacuauucaauuucacuuuugcaucucuauagauuggaguagcuaggagccuguuagugcuuuuauuagugccuugggcaguguuacuuucuugaugcauuaguccuggguguaaaagguagucaaacacgauuuccaaauuucccaugcuaauugguagaaggugucucaucuucugacagcuauuuucccauugacuggagcaaggcauguacuagugaaauugaaguagaucugugacugcacagaaauucuuuucucucaaauagucuucccuuucaguucucagucaccuagguuugaagucuuacacuuuuugacucauuguacuuucaacccuucucauggcuuuuuauuuuuugcuguagcugauaucaaccccccuaucuggcuuucaguggucuauuuuauauacaccuugcuuuuuuccuuuaauaauguauuuuggaggucuuuccauuaguacauagagaauguccuuauuuuuauuuucauaguggcauagaauuccauuguauugaugcauuguaauuuauccacuaucuaguugaugaauauucagguuguuuccaaucuuuugcuauuacaaauaauauuacagugaauagcauuauauguucaucaucuuuguucaccuuuuuuuuuauugggauguugucuuuuccuuacccauuuccagagcuuuuuauaauuuagggaaauucuuuuuauguuuucucaguuucuuuucucuuucuuuuguuuauucauucuuucuauuauuuguuaugugguuuuguguaguaagugugcuuguguuugugguuucaucaaucuuuuauggcuuuggguuaugauucauaauuagaaauuccuucuccauuccaagauuugaaaguaauucucauguauuuucuuuggcuacuuuugugguuucauuggaaauauguaaaucuuuauauuuauuugaaauauauucucaugaggauuuagagcaugcuuuuuaauauacaguuaaccccuugaacaauauagguuugaacugcauggaucuacuuauacguggauuuuuuuuuuuuuuccuacaguaggcccuccauaucuggcaaguuucacguccacagccaaaugcagaucuaaaauacuguauucauagaaugcgaagccugaggauguggaggaccaauuuuuuguaucuauggguuccacagggcuaauuguggguccugagcaugcauggauuuugguggaguguccugguaccaaucuccuguagguacccauggacgacuguauauguuuuuucagguggcugccuguuguuccaaaccaguuuauugaagugccugucuuuucucucugacuugagguguauagcaugucuuuauuugggguuauuaguggacuuuaucuucaguuccuuuuuucugcauauauauauauauauauuauuuuuuauauuucacucuaaguucugggauacaugugcugaaugugcagguuuguuacauagguauacaugugccauggugguuuucugcuuauauuuuagaaugggcuuuuuugguuuaaaaaaacauuuugguauuuuauucauuacauugcauguauauuuuaacugagggaggcuugacugcucuaugauguuuccuguucaugaaggugguguauauuucuacaagcucaaguguccuuuuauguccuuugggauaauuuaaaaguuuuuuugcuuuuuuacauuuuuuuguuuauuccuagauauuugguuccuuuuuuguugcauuacaaauaggcuuuuuuccucuucuauuauauacucuaguuguuuuguguguguguauguuauuaauuuuguauauuaaucuuauacucugauacacagucucuaacuguuugugguguuauuuuaguuaauuuguuuuugguugucauguaugcaguuaugugauuugcagugaguggcaauuuuaucuccuccuuucucauuuuuauaccuacaacguuuuuccuaauugcuuugucuuguacuuccaaaaauguuaaaugaauguuaaauaaugguguucuuaaugacauuccugucuuguucuaaauuuaguaauaaugccuuuaguauuuccccaauagacgugauuauggcuuugggcugagacagauguauauuuuuucuguuaagugacuagcauuuuaaaucaggaaugcuguuggacuuugucaaauaccuuuuuagcaucuauugagaugauuauaucagauuuaacauuaauaaaucucacuuaggucauuuuuauuaauauuuaugguuuuuuuuuuacuugaucugucauugaaaugagagaaguaaauuaaaauuuauguuacagauucauuucucuuucuacuuguaucucccauaauuucugcuuuacagauguugcugcugugcuauuucgcauauagauguuuacaacuauuacacugucauuguaaauugugcuguuagcuuuugaaagagcccuuuucuuuuugucuuauuaaaugcuuuuuggccccauuccacuuuguuuaguaacuaaagauggguaucccccagcuuuuccauuauuugcauuugcuaguauuauuuuauuuauuuuuuaauuuccaaccuguuggaauuacuaucuuuuauagguauaucucuuguuuucagaauagaguuggguuuuacucugugaccuacuaugaaaacuuuuaauagaucaguuaaaccuuuuauaauuacugauauaaauucuuuuauaauuacugauauagauguauuuagucuugauuuucauauuuuuuuuucaguuuuucuaaauauauuuuacuaugcaaucuagguuuuuuguuuauuuugaaaaguaguucuuuucauauauaggaagcuuuuuuucuuauauugguaaucacuauaauuaaaucuuauauuccucaaugugugucauucuacauacuggcaggauacucaucuuuauuaagaugcuguauuauguuaguuuccuguacccacguuugcaaggcagcucauuggaggaucaacuccauagcucuuuacagucuugccccaaccuaaccuuccaucuuuaucuuccaaugaggcacuacaugaacuuccauagccaggauucacuacucucuucauccauagaaacuacucguugauccaacccaugcagugcucccugccuuuuuuuggcccugucuguaaauuuucucuguaaugcuuucuauuagccuuacaguauaugcaucauacauauuauguacuuuuuauacuagaucauuaaaaucucccuaagugaauuguaggcccuugcaggacagaauguaucuugaauuuccuucaggccuuagcuggugcagugcuuucaucuucauagguucucaucugaggacugccaugagcuuguggaagaguagguagauauguucuugaugagcuguauaugauagaauuuucaucaauuuguagaagagaaaggugagcagauguucaguccuaaaggugagcagauguucaguccuguaaggaaaaccuucuagcggcauuacuuuacaauggauuggguuuuccuguaagcucucugucauagcaagcguucaauuguaggguaaauggccauucugccggggaugcuguuaaggagaaagagaauugaaagggaaagaguauucuaaaaguagguaaacuagggcucgcuucaucuuuguaauucugaauaccuaugauuuugaccuaaauaaagcagaaaccauagaggauuuauuuauuuaauauggggauugaugaauugacaaggauaauaugauaggaaauuaaacaauaauacacuuacuuuauauauaacugaauaaucuuugaaguuuaugauucuguuuuuuuuuuuuuuguuuuuuuuaaagacagcacucacucugucacccaggcuagagugcagugcugcagucauaguacaauguaaccuagaacuccugggcuccaaugauuuuccugccucagccucccaagaagcuaggacuacaggcauacaccacuaugcccaguuaauuuuuuauguuuacagugagagaggggucuugcugugcugacuaggcuggucucuaacuccuggccucaagauccuccugccucugcagugcugggauuauaggcaugagccacugcuccuggccugauucuauuuuccagugcucuuuuuacaucucaugauauaaacaaaauuaaaaauuauaauauauauuuuuauggcuuucauguuugaucauuucuuagacuacugaaagaguccuguuaagaagagggucagccaggcgugguggcagugaacaauauguuuguauuaggguucucuagaaaagcagaacuaauagggugucuguguguguguguguguguguguguguguguguguguguguguaaaggggaguuuauuaaggagcauuaacucacacaaucacaggguuccacaauaggcugucugcaagcugaggagcaaggagagccagucugagugcgaaagcugaaguacuuggagucugauguuugaggacaggaagcauccagcacuggagaaggauguaggcugggaagcuaaaccagucuagcuuuuucacauuuuucugccugcuuuauguccuggccaugcuggcagcugauuaaauagugcccacccagauuaggggugggucugccuuucccagcccacugacucagauguuaaucuccuuuggcaacaccaucacagacauacccaagauuaauacuuugcauccuucaagccaaucaaguugacacucaguguuaaccaucacaaguccaccccuuaucaacuugaacccauauauaucuccugagaucauacauaaucuuuaaauaaaggcaaugauaaagucauaauuaugccuaacauaauacaacuauccuucgcacaaccugaaaggcaccaauccccaacccaaauacuacuacauaaaguuaacauacuuaaaugcugauaugaagucaauaaaucucaugucacgugauaaauaaaaugaagauauuuuucuuuacuuuuuuuuuucuuuuuuuguuuuuugagaugaagucuugcucgucacccaggcuggagugcaauggcaugaucuuggcucacugcagccuccgcuuccuggguucaaaggauucuccugccucagccucccaaguagcugggaucacaggugccugcuaccacgcccagcuaauuuuuguauuuuuaguagagacaggguuucccuauguuggccaggcuggucuugaacucccagccucaggcaauccaccugccacugccucccaaagugcugggauuacaggcaugagccgcugcacccggacuuuuuuuuuuuuuuuuugauagagucuugcucugucacccaggcuggagugcagaggcgcaaucucaguucacugcaaccuccaccucccagguuugagucauucuccugccucacccuccugaguagcugggauuacaguugcccaccaccacgccuggcuaauuuuuguauuuuugguagagagagaguuucaccacguuggccaggcuggucuugaacuccugacuucagaugaucugcccuccucagccucccaaaguacuggaauuacaggcaugagccaccgcaccuggccugaagauauuuucuuaguacaaguguauacauacaugcacaaacguuuuuaacaaaaggaggaaauacucaugacaguuacaguccucauuucugcagcuggccacauggucguaacugguauugaugacugccuuguucuacccauucuguauuuccuuugcuuucagcaagcaccucagcagguugugguuuuuuuuccuggugguuguguuuuuuuuccugguggagugacccaaaccuucauuccugaagugucugggccauuuguaguucugccuggauugggcuguugugguuaaucacaaggcauaguaauacuaagagacacccuaacagaucuccuguauuccauguauacucuuccuuaccucuguuauggaguaguagacugauugcaucuucauagucugggucagucaccccagccaacacuguaccucccuucuuagccuguuggcuuaaagauaggaggaguucaaaguguccagcuggcaaccugaacuuccaguuuaauggaauuguuguugugucauuccucccucuggaacuaagacaucuaggccagcagaacguaauguugugggaacacaaagcaaaaauuuugcuaguggaucacuaggggugauggugaguggugccacuuccaccccuugauuacuggauccaugaauccuggcuaugggagaaauaguaccauauauuggauguugauucagagcauacauggccuucuggagaacuuugcccgagcccugcaaaguauugucaccuaguuggcguuguaauugugacuucaaaaggcgauuccaucguucugucaauccagcugcuucaggaugauggagaacaugguaacaccaaugaauuucaugagcaugaguccacugccacacuucuuuaguuguaaagugagcgucuuugucagaggcaaugcuguguggaauacccugacaguggauaaggcaugccucgaguccacggaugguagucuuggcagaagcauugugugcagguuaggcaaacccauaucuggaguaagugucuauuccagugaggacaaaccucugcccuuuccaugauagaagagguccaguauaaucaaccugccaccagguagcuggcugaucacccugaggaaaggugccuuauugagggcucaguguuggucucugcugcuggcaaacugggcacucagcaguggccaaagccaggucagccuuggugaguggaaguccauguugcugagcccauggguaaccuccaucccugccaccauggccacuuuguucauggggcccauugggcgaugacagggguggcuggggaaggaggcuuagugguguccacagaauggaucauccuauccacuugguuauuaaaauccuccucugccgaagucacccguuggugagcacucacaugggauacaaauaucuucacaauuuuugaccacucaaagaaguucauccacauaccucuucccccaauuucuuugucaccaauuuuccaagucacugaccauccccauuggcuacagcccaugaaucaguauauaaucacauaucuagccauuucuccuuccaugcaaagugcacagccagguacacugcuugaaguuuugcccacugggaagauuucccuucuccgcuguccuuuacggauauccuagaaaggggcuauggugcugcagcuguccacuuuuggguggugccugcauaucaugcagaaccaucugugaaccaggcccuagucuucucuuccucugucagcugaucauagggaacuccccaugaggccauuggugcagguuggggaagagaaggcaggguggcaggaguggagaccaugggcauuugagccacuuccucauguaacuuauuugugccuucaggaccugcuugagcccgaucguguauguaucacuuccauuugcugauggaaugcugcugugcaugacccacuuuauggcuagaugggucagaaagcacccaguucaugauaggcaguucuggucucauggugacuugaagaccuauagucaaacauucaguuuacaccaaagcucacuaacaggccaagagcugucucucaaaaggagaguaguuaucugcagaagauggcagggccuugcuccaaaauccuagaggccuccacugugauucaccuauaggggccugacaaaggcugcagacagcaucccuaucugccacugagaccucaagcaccauuggaucugcuggguuauauggcccaaguggcagaacagcuugcacagcagccuggaccuguugcagagccgucuucuguucuugacuccacucaaaacucgcaaccuuuugagucacucgauaaaugggcuggaguaauacacccaaaagaggaauauguugccuccaaaauccaaauaggcccacuagguguugugccuguuucuugguuguaggaggggccaaaugcagcaacuuauccuuuaccuuagaaggaauaucucgacaggccccacaccacugaaacccuagaaauuuuacugaguuagaacgucccuaaauuuaagucagauuuauuucucauccucuggcaugcagaugucucaccaagaagucccgugugucugcuacuucuugcucucuggauccaguuaacauaaugucaucaaugugauggaccagugugauaucuuguggaagugaaaagcaaucagggucucuccgaauaagauuaugacacagagcuggagaguugauauccccccaagguaggacaguaaagguauauugcuggccuugccagcugaaggcaaauagcuucuggugggccuuauggaaaggaauggagaaaaaagcauuugucaaaucaauggcugcauaccggguaccgggagauguguuaauuuguucaaguaaugaaaccacaucugguacagcugcugcaguuggaguuaccacuugguuaagcuuacgauaauccucugucauucuccaagauccaucuaucuucugcacaggccagauaggagaguagaauggggaugugcugggaaucaccacccuugcgucuuucaaguccuugauggugacacuaaucucugcagucccuccaaggaugcgauauuguuuuugacuuaccauuuuucuagguagaggcagcucuaauggcuuccauuuggcuuuucccaccaucaucgcccucacccuaccagucagggagccaauguggggguucugccagcugcuaagugugucucugccaauuaggcauucuggcaccuggaaaaugaccacaggaugaguccggggacccacuggacccucuguaagucagaccugagcuaaaaguccauuaacuaccugaccuccauaagccccuacuuuaacuggaggaccacgaugacauuuuggguccccuggaaucaacaucagcucagauccaguguccaguaguccccaaaaugucugauuauuucccuuucuccaaugcacaguuacccugguaaaaggccagaggucuccuuggggaaggaugggacaaagauucacugcauaaauuguugguaguguagugggguccuuccucaaggggacucagccuccccuucauucaagggguucugggucuauaaacuggcucaagucuggaaauugaucgaggggccaugauucucgguuuauaauucaaauuagucuuuuguccauucgaccuacaaguuuuuuccuuauauaaauuaaguaggaaugcaguaggcuuccuaucaauuucacuccuaggaacaccgugauuaauuagccaaugcuagagcucuacaugagucagaauauucugaauaguguuauucagugugauaacccagcagucuugaacguuuuuggcaccaggcagugguuuuguggaagacugacggggguggggaggauaguuucaggaugaaacugcggacuaguacuggucuguagccuuggguuuggggacuccugugauaacccacuuuggacauuuggcucuagcgaaauuuaccuuuucagaaagauuaauccccaaaagucuuagcuuuguaaugauggaguguguugaaaagcauggaucauggcuuuuuaagggauuuccaaaggagauuuucucuccaaaauauuuugagcaguauuguuugaauaaguguauaauagucuuuagagcaguauuuuuggaacugcaaacugggauacauuaauuuguuguauugggcuuacauucaacauuaauuaaaaggauaggaauagaaaauacuacugugcauugaauguaguaaggauagguaguuuugagaaacuuuuauuuguguuucuguuuccuggacugcaguguaaaguguauuucuugcuguggaucauggucauaaaaaguuugaaaagccucugcuguuagaugauaacacacauuuggauauuaacuucuuagagguuaguauauguagucucaccuauguagaauguaauugaaaauuucuguugcuguguauuugucaaaaaugugagaaugauuucuugugaaacaguuuuuaguccaguaaugauuuuaauguuuaucuucaauggaagacaaauuccacugaaagaaggcgucuccacaucucugcugaaucuuagaacaucagaaucaaaagcagccuuagauuauuaguucagcuuauuuauggacaaauagaacucugaggucaggagguagagaaaugcaugccuaagguuacauugugagugguagagcugguaccaaaaccuaggucucuugacucccaacucauagacugcagaaggucaauuguaguuuaaucauaaucucaacuaauucuauguaacaguuauaaaagcaagcuuuuaugagaguucauauucagaagaaaacaaugaccaauuguuuaguuuuuuuaaaaaaaacuugaucaugcauuacuuuuaaaauucucuuuggcuauagaaugugaaauucuuaauuugaauuauguaagcuuauacucucuuugaaaccguacuugggaaguuuugaguuuguuacaggguacuuauuuuuaaaucaucugccucuugacugaaaugaacuguuaccagauccaaaucaccacuuaaaauugcuugaaauguuugucaacugcuucauuaaagcccaaaggcagcauauauucagugggcaauuuugaagagucagcaugaaguucaaacauuaggaaauuaaggacauccuauaccucauuauuuuaauuaauacauguuauaaaaaucuaaaauucagaaggauucaacguuugaagguuguggaugacucagggacuuggaagauugcccuucuuaccucuaagguugauugacugccucaaaacuccagaagauagagaguuagagaacuuuuuguaaucccagcacuucgagaggcagagugggcagaucaccugaggucaggaguuugagaccagccuggccaacauggugaaaccucgucucuacuaaaaacaaaaaauuagccagacgugguggcgcacacuuguaaucccagcuacucaggaggcugaggcaggagaaucgcuugaaccagggaggcgaagguugcagugagccaagaucgcuccauugcacuccagcuuggacaacaagagcaaaacucuaucucaaaagaagaaaagagagaguuagagaacuuuuuuguuuuuuaguucuguuuuuuagaaaaaugaguucucuuccuuugucccugcuuguuggucuuuucucucuaccucccaaaugguuuugaggauuaaaguaaacaguauauuccuaauugugccaaugcuuacuucuucuuucuguaccuccaucucacagcaaguacaaaagugaggacagacaugagcaaaggagauagauuccuaaauucagauuuccuuuuaacacaccaaggucauucucugauuagcuuuuugguaaaagugcuuagaaagcugaacuacuaugugguaguaaugaagaucaaccuuagugacccuuaauauauaagaaagcuuugagacugucacugggaguauuuuagacuaaaugaaagauaaaucuguuugcuuuacaaagcuaauucaaacaguauguguggcagaugggacagcauuaaagauucuucuaaugaucauuaauuaggauaggcaccucaagaaguauauggccucucaaggacuacuucugauugauauuuagaauuaauuugguuagaaguaacaauguaauuuuuaaaacacagagguuuauuuuuuuucuggagacagaguuucacucuuguugcccaggcuagagugcaauggcgugaucucagcucacagcaacuuccaccucccggguuaaagugauucuccugcuucagcaucccaaguagcugggauuacaggcauccgcaaccacgcccagcuaauuuuuuguauuuuuaguagagacaggguuucaccauguuggccagguugcucucaaacuccugaccucaugugaucccccugccucagccucccaaagugcugggauuacaggcgugagcuacugugccuggccaaaaaauacagaucuuuaaagucaguaguggauuaauacuuuggauauauauaguaauggaaucauuaggggauuugguaauaaaaacauuuuuacccaagaauacguacaguacucuacuuaagaauaagaaacuaggaagucugagagugauucuggaacuaagugacuguggaaaauaaguaagccaagguuucacugaagacaguuuuuccuuaaaggccauuuacucacccaaaaacagucagggccacauguuuaguaaugaaauaaaggcauucuuugacacauaggagauauuuuccucauacuuuggaguguagaaaugugugugccaauagcaacagcuaguaaaagggcuaaagaauguuauauguuugcuggaugugguggcacaugccuguagucccagcuacuugggaggcugaggugggaggauugcuagagcccaggagguggaggucgcagugagccgagaucaugccacugcacuccagccuaggugacagaacaagaccuugucucaaaaaaaaaaaaaaaaaaaccuuauauaauuuaggagauacuacaaucuguugaguauaaacuuugaaaaauuguguaaaagucaagugaaaacauugguauuuccaaaguuuaguauaccaauacuauagcucaccugcuauaguauauugccugaguuucugaguuucugucccugucucacuucucuguuccuccuuuaucucccaaauacuugacuccuugugcuuaacuccuugucucagagucuacuucuggggggaggccaaaugaagauaggcuaucauuguuuucuguaaaauuuccugucauccgauauggcagcuugcauccucauggugucauuuuacaagauguuccucuauagccaauguuucuuauacacuaguuucuugggcuugauuaaauugagaucauguucaaauugguuguuguuaagaauauuuacaaguggugcuuucuguuucguauugcaucccaucaagaagcagaauacuugguuguuccacuuuuagugauguuaaaagauuguucaguaacaguguggauacauucauucugcacuaaaauuaauucaaagcuucaugaaaacccaggcaaaaacagaguacugacauacaaguaaucucaugguuuaaugcccagcaguuaucuucuuuagagaauauauaaugacuuugcaggaauuauggaugacuuuuaaauuaaaauauuugaaugagagaaccuucuuucucucuuuuauuuuuaaugugaaaaugaaguuuguaagauuaauguaaccauguacaaauuauguuuuucacagugucuagcauguugacacugugaugacucagugaaauauuuguggaaggagugagugaacaaaagauguauguaccaacauguauguagauucucuuaagguaacuuucucucaucaaguuuccuggguaagaauuacagugcagcacaaaguagaauggucacaauucucaucuugacuuuucuuccaauucccaugcuuuguuaguacugccauugcuagaaguuugaguuuuagaagagcaaaauguggugauuuuaagagaauaauuuuuuuccgcacauugagaaguucacccccagcucugaaaaacuuuuuauaacaaaaauauacucuuugaaggucagagaaaaauacauugucuguuccagguaaauuaguuaaucucauuuuuaaauacgcugaagaacgaaacacagauaacaucaguuuuuaauggaaauucaugcaugaucaaauaacuaaaauucaagaaaaaguaugaauugcaacaaauuuuguuucuuuuuauuuguccaugauuguuuuuacuggcagaauuugagauuaaggauuuguauuaucuauauuugaacuuuuuggagguauggaauuuguuuucucaagcauuucugcaccauauuuugacuuauuuaacgaagaaaucuuauaauuuuuuuuuuauuugaacuggguaauucauacuauuagaaauaaauauaucuauuuugagauggagucucacucugucacccaggcuggagugcacuggcucaaucucagcucacugcaaccuccauuuccuggguucaagugauuuuccugccucagcuuuccaaguagggagagacagccuuaguaaauaucuuuguaccuauauaauuauuaaugucugaaaguaguuuuguagaguauucuaagaaauggauuugcacaguaaguagagcaggcacuuacaaauauauauacaguacauauaaaugcuucuuuucuuuuuucuuuuuuuugguugguuugguuuuuuucuuuuuuuuuuuuauugaucauucuuggguguuucucgcagagggggauuuggcagggucauaggacaauaauggagggagggucagcagauaaacaagugaacaaaggucucugguuuuccuaggcagaggacccugcggccuuccgcaguguuugugucccuggguacaugagauuagggaguggugaugacucuuaaggagcaugcugccuucaagcaucuguuuaacaaagcacaucuugcaccgcccuuaauccauuuaacccugaguggacacagcacauguuucagagagcacaggguuggggguaaggucacagauccacaggaucccacggcagaagaauuuuucuuaguacagaacaaaaugaaaagacucccaugucuacuucuuucuacacagacacggcaaccauccguuuucucaaucuuuuccccaccuuuccccccuuuccauuccacaaaaacgccauugucaucauggcccguucucagugagcuguuggguacaccucccagacggggcggcuggccgggcagaggggcuccucacuucccaguaggggcggccgggcagaggcgccccucaccucccggacggggcggcuggccgggugggggguugacucccccaccucccucccggacggggcggcuggccggguggggggcugacccccccaccucccucccggacggggcagccggccgggcugggggcugacccccccaccucccuccccgacggggcggcuggccgggcggggggcugaacccccaccucccucccggacggggcggcuggccgggcagaggggcuccucacuucccaguaggggcggccgggcagaggcaccucucaccucccggacggggcggcuggcccggcggcuggccgggcagggggcugacccccccaccucccucccggacggggcggcuggccgggcggggggcugacccccccaccucccucccggacggggcagcuggccggguagaggggcuccucacuucccaguaggggcggcugggcagaggcgccccucaccuuccguacggggcggcuggccgggcgcagggcugaccccccuaccucccucccggacggggcugcuggccggggagaggggcuccucacuucccaguuggggcggcugggcagaggcgccccucaccuccuggauggggcagcuggccgggcggggggcugacucccccaccucccucccggauggggcggcuggccgggcgggggacugacccccccaccucccucccggacggggcggcuggccuggcgggggcugacccccaccucccucccggacgggguggcugccgggcggagacgcuccucacuucccagacggggugguugccgggcggaggggcuccucacuucucaggcggggcggcugccgggcggaggggcuccucacuucucagacggggcggccaggcagagacgcuccccacaucucagacgaugggcggcugggcagagacgcuccucacuucccagaugggauggcggccgggaagaggcgcuccucacuuccuagaugggauggcggccgggcagagacgcuccucacuuuccagacugggcagccaggcagaggggcuccucaacucccagacgaugggcggccaggcagagacgcuccucacuucccagacgggguggcggccgggcagaggcugcaaucucagcacuuugggaggccaaggcaggcggcugggagguggagguuguggcgagccgagaucacgccacugcacuccagccugggcaccauugagcacugagugaaccagacuccgucugcaaucccggcaccucgggaggccgaggcuggcggaucacucgcgguuaggagcuggagaccagcccggccaacacagcgaaaccccgucuccaccaaaaaaauacgaaaaccagucaggcgcggcggcgcgcgccugcagucgcaggcacugggcaggcugaggcaggagaaucaggcagggagguugcagugagccgagauggcagcaguacaguccagcuuccgcucggcaucagagggagacuguggaaagagagggagagggagaccguggggagagggagagggagagggagagcgagagggagagcgagagcgagagcgguuguuugguuuuuuuagagacaggcucucacucuguccagaaaucuuauaauucuucuaguguuucuuuauaaaugcagguugguucucacaugaccaagauggguugcacugaugcuauaggaagguuguacuacugaacaauuuaaggguuaaaguggcuucccaguguuauucuauacuuaguccuauuuuuccccucucuuugaacuucuaguucauuauagugcuucugggaaugugaauagugugagaugugccuugauugauacccaacuucaaggcccuuauaguuccugucagccucagcuucuuuucuccagggacauuucaacaucuccugcuccuugaagccaacuggaaaccuuuauacuucucuuaucugcgagcuuaaugcgaaacugaaagcaagaguggacugauuggagucagggaagugguccccagggaggagaagcagccuaggucucagggcauugggacuucagaugguaggcugacuugucaaucuagauuagaaauggaagauaacuguugccugguacauugcuuguuuuuugcuauaggagagacauaguuuguaaagaaagggcucugagaaucucccaacagaaaggcaagucaaugaaagauuuagcaaaaauacacuaagcuauuacagcagaaugccuagcagauguacugccaacugagaacaguaaugccacagggaaagaaacaucccuuauugaagcuucuauuuuaugacagugauuucaugcagaaauaucuguuuaagcuguuuuuuugagcagaagacaguauacuuuaaaaaauuaacaucuauguacaucucugauagguuacagauucauucuacauuuuucuaaaagcacagcaauuugcaugucaaugcauugucacagaugagucuuacuuguacuuguguucauauuugaggaucaaaaacauuguacagaguuuaaaaugaauuuacacgcuugcuccuagaguaaaaaaaauugcuuuccaaaacaguauuccugaacuuuagugugcauaggaaucaacugggcaucuuacugaaguggagcuucucauucagugggucuagaguggggccuaguauucucuauuucucacaagcuccuaggugauaccagcguggcaguuucagagaccacacuuuaaauaucaagguuuuaagauauugagcuuuaaauaaacaaacucacuagaaauacuucuuguuuucuaaacucauuuacuaagauauucuaagaaaacacuugacaccuagcuaaugcgucuaugaauuagaaaucuuauuaacaggaguaauguuugauaaccucuuuuaccugauguuuuauuagccucuaguccugaaagucucaaaucauuuauuuucaugacugaauuaaaaaccuuaaauuauagcacuguacaagaaguguugaauuuuuauccacuaauguaauauaacucuucuucuguuuugugguaauuuauggaugauuugcuuuauuccaccaugcagcuuuauuaggguauaauugacaaaaauuguguauauuuaugauguacaaugagauauuuugauauauguauacauuguuaaaugauuacaugaagcuaauuaccauaucugucaccucacauacuuauuuuuuuuuguugugagaauauuauagacucucuuaggaauuuucaaguauauaguacagucacgcauggcaugaugacggggauauguucugagaaaugugucauuaggcaauuuugucauugugcaaacgucauagaauauacuuacacaaaccuagaugguauagccuacuacacaucugggcuauauggaauagccuauuacucuuaggcuacuuguauaguauguuaauguacugaauauuguagguaauuguaauacaaugguauuuguguaucuaaacguagaaaagacacaguaaaaauauaguauaaaagauaaaaaguuauacacauguauagggcacuuaacaugaaugaaacuugcaggacuagaaguugcucugggugagucagugagugaugagugaaugagaaggccuaaguuauuacuguaccuuacuguagucuuuauaaacaguaaacuuacgcaauacuaaacguauuuuaaaauaucuuuuuucuuuaauacuaaauuaacuagcuuacuguaacuuuuuaacuguauaaacguuugacucuuuuguuauaauauggagguuaaaauaccaacacguuacauagcuguacaaaaacaucuuucuuuauaaccucauucuguuugcuuguuuuauuaaaauauuuuuuucuuuuuagcuuuuuuguugaaaaccaagacaaaaauacacacauuagccuagaccuacacagggucaggauuaucaagacaucaagaggcuccaggaauuuuucagcuucauuauaaucuuaugggaccacugucauauauguagccucucauuaaccaaaacauuuuuaugcagugugacuguaugugcugaagugccuggaaaucguaccaaagaacagcugggggaaccaacuguuaaguagugauguagagggguuucugcaauaggugggaagauccuuugugagauuccuucuaagucuguggaucaucaccaaguggugugcuuuuugcuauuauauaauuaaaaccaaauuauaguauagacuuuauuuuuauuugauaaccucaguuuccucaaacauguuaaaauguuuguucgcaauuucaauuucuggaccuuuuccuccuacuucucauauccaauaucgucucucuaaauucuuaguguguuaacaucaucuaccuauucauccaucuaaucauucauuuaguacauauuugaauguuucuuguguacaaacaggguacagugaucugugggauacaaaauugaauaagguggucucuacuuucaagguacuccccgucuguuggaggaaguaagacaccagugcaaauaacuaauuuaaggauagaauuaauuuguuucuuaaagacagaauaauauguuaacacccuauagaaagugcucuugguguucagagcagggagagauauaaauuuuuaauaaccaucuaauggaagaaaacauucuuuccuugcugaagaagcuccugcuauugaaagcuagccuuucacuuuuauuagucuuuuaaaugaauuuggguaugguauuugccauuuuacugguaugccuuuuuauaugagaucccaucacuaggcugaaauguuguaauaguugguacaguaaaugcauggaggaguuaucuaaugaauuaugagagaugauuaaagaugccacucugcucugcuuucuuggcaagaaaaugagcuaauaagcuggagagaaugaccaaguuguaaaauacuuccuaaguucauaucuguauauuuguauauguugucuaaauauuucaucauuagagacuauauucuucaugacuauuaagaucuaugaaaauuuccauguaaguuuuuauuuuguuuuuaacguaaauuuaaaaguuuuauucaagucuaaauugaaaacaaaaauuaaugaucccuaucaaaagcuuuauggucuggagucauacuuuauuuuacuuaagcacuauagcauuugacacaugaagauguuuucccgggagaaucuuguugcugcccagggcugacaggaaaaaaaacaauuuguccgacuaguggagcuuacuaacaguucaaauaaacaacccgucuuucccuucauacugcauauuaauagaaauguuaaugauaagcuaacaggaaacugccuccuuuacacccuacagggagcagagauuacugggucagagaguuuucuugcuuugggcccucuuaacaaacacaacuguuagcaaaauaccaaucuuaucacuugcauauuuauuagcacaguauuuuuaaaguaauaguuaucuauuuaauacagccaaauugaucauugccucauuuuugccauuacuuagcauguaaauauuuuugccauguaaguauuucaagguaaaaucaauuucccucucucucucucuuuuuuuuuuuuuuuuuugugagacaggguccuguucugucauccaggcuggagugcaguggcacaaucauagcucacugcaaacucgaacuucuggguucaagugauccaguggccucagccuccccaguagcuaggacuacaggcaugugccaccaugccuggcuaauuuuuuaaguuuuuuguagagacagggucuugcuauguugccuaggcaggucuuaaacuucuggccucaagggguccuccugccuuggccucccaaagugcugggauuauaggcaugagucacuguguccagcuaguaaaaagcuauuaacuuuagauuuuaaacauauauucucucuacauauuuugauagaugauaauuaacucuucaaaaauauuucagaauaaccaaaagaguggauuuggaguguucccaacacaaagaaaugauagauguuugagugauggcuauaccacuuacccagauuugagguagcgcacaccaugccguaugcauuugugcccucaguaccuaguagacacuguaaauauuauugaauuauuuaaugacuugacuucaauaaugccaacuucauuguucuaugauaauauuuuucugccuucuuaaguuuuucuuuagcacacagguguaaaaucuugcuauuaccaauauuauuggguuccacaguuaucuagaacuggucagauacuuaugaagccaggaucuguuauuaagacauugauaauguagaguagaaaagauuucuuacccaucucuagguucauaucugagacuccuauaauaaaagguagauuaacaagagaaaagcauacaaauuuauuuaauauaaguuuuacaugacaugggagccuucagaaauuacaacccaaagaagugggaaaaacuuuauuuuuauucauagguugauguacagacauacgacuggacaaaggggguaugaucuaauaguaauaaacuggggaaacuguuaguuuagauucuucuugguaucucuguguccgcagagauugggauauuccuuuucucagggucuagaggauacgucucuuagcggggucuuaagaccuacuuuagaguaaugucagagaauuauuuuaugaccuguuuuagggaagaagggcaggagaaggucagggagaccuuuuugcuucugcuauuuccucaaaugccaaugugccauauuuuggaguaauguguucuaaaccccaucaauaguaacuaaugacuagugagggaagucugaucuuucuaguuaauguuugaggcacugaaaauaaugaaauuaguuuuauaagucaaauauuuggagauuugcaauuauuuagccuacuuuuaggagaguauaauuuauugguugcuaacagacaugauaguuauuggcuacaccguuaaugguaauuuaaaaauaagacaguguuauccuuaggccuuuccuaagaacagaauaaauauauauauuuauauauauuucuauaaauauauauauuucuauaaauauauacguuucuauaaauauauacguuucuauaaauauauacguuucuauaaauauauacguuucuauaaauauauacauuucuauaaauauauauuuauacauauuuuauaaauauuuauauauauauuuauuuauauauuuugagacggagucuugcucuguugcccaggcuggagugcaguggugcaaucucagcucacugcaaccuccaccuccuggguucaagugauucuccugccucagccucccgagcagcugggacuacgggcaccugccaccaugcccggcuaauuuuuguauuuuuaguagagacaggguuucaccauguuggccaggauggucucgaucuuuugaccucguugugaucugcccgccuuggccucucaaagugcugggauuacaggcaugagccaccaugcccagcccagaaauauuuuuaaaaauuaguugggcuuauguauauacuagcaucauuguaucucuuuauagcauuuagauugaauuguuggugaauuauaaaaguuuugagucugucauaagugcugaaguauucaggaaaugggugggcaaaggaauagucuucagcacuuugaucagagccugacauuaguugucauucaguaaaaagcaaugauuuaguaagugaauuuccauacacaaacucuauuucaaacaaaaaucucuucaggcagcaaacaccaagucauugaaguuggaaacuaaaaauaaaauacacuaaauuuuacuuuuuaaaauaaguaaacauuugcuaguuuaguuuaaaauuuuauauuuucuuuguuuuguagaugggaggcuaagauuuucuuugauaaacuugaacuuuggauuucagguucauuaaagugcaaaaacauucuuauuuucuuuuuaauagccucucauguaacacauuguugucaccaauaagugaaaauuauaccggaagggcuuuugguuuacaacuugcaaaagucuuucuugcauucuucauuauuuucuucugucuuagaaacauggcaggauagaaucagcagacuuagcuuugguuuuuauguuuauacuuuaaacacugauaaucucacaaauuuuuucuuguggugcuauaaaguucuugaaaguguuaauuugaaaagauauguauauucccaguuuuccuaauuccuuagaagcuauuuuguauauuugcaaguauagaaaguuuuauuugaccaauuucuagguuugagaagcuaauauuucuccuauuucauuuaucuaguaaaagauuagacuagauaauaaagauucaauucaauugauguauaauuuucuaaggaacaaguggaaucacacauuuauuuuuagacuucgcuuuuacguauuugucuuuuguggacacauuuauuaauuucucauuuuuuaaauuuucagguaacuuggguuuuuacuccuguaacaacugaaauaacaagucuugauacagagaauauagaugaaauuuuaaguaaguaccucaauauuuuuaaaguguacucuuucuucucuauagagaguuaguuuauauauacaaaaaaaaaacccaauaaaaucucaguuagcuagcacagaugaagagcuggcauucugauuaauuccaugacuuucugaauuaucaaagcacuuuugguuacuuuuaguguuuuuuauuuauuuaacuugauauagauaccauucuuaacaauucacgaaauguuuugauaagccuacuuagagaccaauaguucucacugugcagaacuaaauguuaaugaccuuaggacacagccuagacuuuuuuuucuuuuuucccuuuaauuagaucaccuauucugaucucuuuuauuguuauugguccaguuaagcucaguacuuuuuuuauuuuuuauuuuagagaaagggucuugcuuugucacccagacuggagugcaguggcaugauaauauuauagcucacuucagccuugaccaccuccugggcucaagcaauccucuuuccucaaccuuccaaguuagcuaggacuacaggugggcuccacugcacguagcuaauuuuaaauuuuucuuguagagacauggucuugcuauguugcccaggcuggucuugaauuccugaccucaagcaguccucucaucuuggccucccaaagugcuggguuuacaggcaugaaccaccacacuuggccuaauaaguuuuuuacugaaugguuuguuugcugacaaugugguuguggauauaauuaacuugagagaaaccauuucuuguuuuuuaaaaauaguaaaggaaaggugaagaugugguugauagaaaaucguaacuuaggagcuuuaagaaaauguacagugugcauaaaugauuucuuuuuuuaauccuccaucugacacauauaauagaggcaaaaggaguuacaacauucauugaguguaauauauuauguuccuggaccuuuaaaugcuaaaagucuauuccugucuuauggagucucuuuagaggagugguuccaugaacuuuagcauguaucagaaccaccuggaacacuuauuaauaucuauacugcuaggaaacugcuagaccccuaccuaaagauuugcauuucuuaaggauuuacauuucugugaguucccaggugauguugguguuucugguccaggaaccacaguuugugaaccacugcuuuagagcgaauaagcaaguauauaaaaaguaacuugaagguaaaaagggaagaaaggaauugaaacucacaugucauucucacuucugucaucuuuccaauucuagaauaucuuuguguuuuauuuucaugagugcuugaggacuuuacguuucucugaauuagggauaggcaaaaagcacuacaucuuucucaugucuuuacaucuugaugugcaaaugaugcuguuauuuuuguaggggggaauaacuuaaauggauaggaauuaaaaaacuggcgucuugugcaacacuauuaguuguagauuacuuguugcaacuaggugguauaugugagguuuaaaaauaacuuaguuauacaggucuuuucugugaugugggauuuuauuugcagaacuaauucucaguuauucaugaauauggaagaucaaaaaauaaaauacagaucauuccacuuuacuuuuuaugaucguagcuuacuugccuuaucuggacuuuauuucacauuugcuuuaaauucauuuaagaugcaacgaaggaagcccggugugauggcucaugccuguaaucccagcacuuuggaagguuaaggugggagguugcuugaggccaggaguucgagaccagccugggcaauauaaccagauccugucucuacaaaaaaauacaaaaauuagccagguguggugguguuugccuguaguccuagcuacuugggagggugaagugggaggaucacgucaacccaggaguuugaggcugcacuggguuuugaucaugccacugcacucuagccugggcaauagagugagacccagucuccauaaaauaaaagauacagugaacuuauaaagauaaagcauacagagaaaagagacaaaguuucccauaaauuauauaagcuguccaugacucuagguuucugagugagagauaauaguuacuguguuuuuuuaaguggacccuuauauuggacaaagaucauaaugaaacuguauguuuaauuaugucaaaauuauuacaaauaucuuauuugguuuugucuuucaauuucagacaaugcugauguugcuuuaguaaauuuuuaugcugacugguaaguaaucuuauuguuuggguuugguuuuguuuuuacuugcuaaagguuaauuuuucuuugcuagaaaggggaagggaaggcuuuuucuauuucaagacaguauuccauacauaaagucaauuaaguuucauccacaagggaaguaguuuaauuugguaaggauuucuguuuuaagaaagaaauagagcugauucuguuaucuuauaucuuaaaacaaguaacauauaacucaaauaugacucucuccacccccgacucaaagggaacacauauugcaauuccguauuuguccugacuguggaagaaggguaguguuuauaagucaugauuuggguaugucaaguuuagaaggaaaaauaauguugacauuuuuaaauuuauagaaucugcugccucugucuuuuguguuuauacaguacccuauguaccacuuucuuuuucuuacuaaauguuuugucuuuucuuguuugugcccuagcaaacaaacuuugagggcagagauaauggcauacucaguauucccagcaucuagaacaacaugguauauaguagauguuacagaauauggcauggagauaggaagaagggagauucagcuggaaagauucugaaacacaagggagauuuagcuggaaagauucagcauagucuuuaucccuagacacucuguaucuuaucugacccuuuaaggcuuacuaccuacuggcugucacuaccauacuccaggccacaguccugucauuuacuuaaaauucaugcuacagucuccucauuucuuuucugugccucuagucuuacguaucuccauucuguucucuacaauguaagccagaguuaucuuucuuacaguguaaauaagauuaguuuauaccccuucuuaaagcccuuaaaauguuuccauuaccuuuggguuaaaguuuaaauccuuuacuuugacccagaaggccccuuaugaacuggucucuuauucccucuguagcuguuaugucuggccucucuccacuuccacauucugcuccaguuauacuaaacuucuuucaauuccuauaaaauucuguauuucaucacuggacugugaggcaugauauuuccccugccuggauggaucauucuucugucgcccacuucuuuacuuaguuaaguucuaaucuuucaagucuuagauuagaugccauuuucuucagguuaucuuccuggaucaauacaccuaccccuacucuugacucugauuaggagcccuucuguuauuuccgguaacacccauacuuacccaaucauaacacuuguaggcuauaauccuaguuggugacucucuacuacauuguuugcucugugagaauacauaccauaguuuuauuuucaacuuuaauccccaagcacuuugcuuaaaauguggcugauaaguacauaaugucuacugaaugaauguauauaugguaugauuauuuaaagaacuuuaguaaaaaguugaagauacacagagaaaaugcuguuuauaaaauaugucucaaagguagcauuuuucaaaguaaauuaggguugucaagauguauuaauagccaaaaaauuugguagaagauuauguaguccaauccauuuuaaaauaagaaaacugagauccaggggauugaaguacuuucccaagguuacccaacuagaugaugucugaagaaaaacuagaacgacuuucuccugacugagagauuuuguguguugcaagaaaggguaauagaaugugcugcugaucuuuugaaaaaacugaauuggaaacauggacugaguuauuugggaaaacauuaccuaaagaauaccuuaaguuguugaugaauuaauacucuuuuauauggcugaaaaagcuuggguaauuggcuguaagacauagacuuaauacuauguggccucaaagucuagacucugaguucauucuggaaguuauggauguggcacaguuuaauaauucuguaauagaggugcuuaaaaauacugcagcuccuugaguaauacuguaguaggugguuaauaaugcuguuuugugccagacuauuuuuuaaaaauuaccuaauauuuaugggaacauaguagguauauauauuuauggggcacaugagauauuuugauagagguguacaaaguaggauaaucacauggcugggcacaguggcucacgccuguaaucccagcacuuuggaaggccgaggcgggcaggucaccugaggucaggaguuccagacuagccugacgaacauggugaaaccccgucuuuacuaaaaauacaaaaaauuagccggacguggcaggcaccuguaaucccagcuacuugggaggcugaggcaggagaauugcuugaagccagcaggcggagguugcggugagcugagaucacacgguugcacuccagccugagugacagagcgagacuccgucucaaacaaaaacaaaaacaaacaaaaaaaacacacaucaggguaaauggaguauucauuaauucaaggauucaucauuuuuguuacaaacauuccaguuuuacucuuuuaguuauuuaaaaauguacaauacauuucuguuuagucauccugcuagaucuuauucauucuaacuauauuuuuguacucauuaaccauccccauccagacucuuuacauagguuuuuuuuaaugcucagaacuacucuguagguagguauuauaauuuccuuuuagguugaggaauugaggcucagaagggucauauggcuaguaagugguggaacugggauuuaaauucagguaugccuaacugcaaagcuuauuuuuuucucuaacuagaucauauuaguaagugcccucaaaaugucucugcaaagacuuaucuauuugguagauuuguuaaggauugauuuaagcacuagauggaagauuagguuuagaugacccuuaggcccuuuuaauagauccauugcuuuugugauguuccuuuuauaaauguaacauuuccauguguauggauacacauguaugaagguacaguaauuauggaauugaacuuuuauuucauuuucccuuuucgucuuuugguacagguugaguaucccuuaucugaaauacuugagaccagaaguguuucaguuuuuggauuuuuucagauuugguaauguuugccuuauacuuacugguucaacaucccuaaccccaaaaauacgaaauccaaaaugcuucaaugugcauuuccuuugagcaucuugucagugcucaaacaguuuuagauuuugaagcauuuugaauuuuuagauuaggggcauucaaccuguauuaagacagguccuauuuuaaacaugaaccaugcuuaaauacuuaaugaguggcaaacuggacaaucuagagaaaagaagcccuugauguguuuuuuuacgucgcccuuaagccauaaagaggcuugcccgcucuuucuucacuaggucagaucuaaauuuuucaagaaaccauuaaucagccccuacuccuugccucccuugcccuccagcuaccuuauuuucagcgaacuguaagaacccacaaaccugcgguccuagccgcuccaguuccuccauucuaucaauuuauugauuuaauacauauauugaauguuuauuagaauacauagucaaauaagacacgguccaugauguccacagaccccauccucuuaucccugaugggagagauuuaagaaugcuaaaagaggaaagagccacuugaaagcaagagauugaagauacagaugugucuccuugauauauucuaggacaucuccuuaggaagucaggugagugggcuagaagagauauauauauacaagaagaaauagggaggaaguauaauguuugcauccuuucacaggcuuuccaauauuuuuauuguauuaaagcuaauauguaugaacuaauuacauguggauuaaacuguucacugacaucauuuaaguaaauuugguggaaaagggcucuggaagcaacaguagcaauuguaguuuguuuacauauucuuaauacuucuuccguaagagaauggccauucuaacccagcugguugcuaauucugauucuuccccuucuuauugggucccuuuaauuaccuagaacauagucauccaugacaugauguuuaggucaaugacagaagucccauauauaauaccguauuuuuacuguaacuuuucuguguuuagauaccugcuauuguguuacaguugccuacaguauuuaguauauuaacaugugguacagguuuguagccuaggagcaguaggaggcuguauacccuauaguguaggugcaugcuaggcuauaccaucuagguuuguguaaguauacuuuaugauguucacguaaugaagaaaucgccuaaugguguauuucugaguguaucccugucguuaaacaccacaugacuguauuugugaaauguuuggcuugauuaagggacaguuagaaguaacaaguuuguagaauauuguggggguuugugccuuguguuuaaaguaaaagaaaaaagaaaauauagacaggaagucuugguuaggaauuuaagauauuugcuucuggacuuacuguauuuaguauguuuacagauauaaaagcccauuuuaucaagggguaaauuuugaggggaaauaguuaauuauauaccauauauucuuuuaauauaacuuauuuauuuaguguguuaacuugccugugagauuugauagaacuagccagguggagaggucuaauauuugcaauacaguuaaaauauuuuacacaauagucuaaaauuuuauuauuuugaggugggaggauugcuugagcccuggagguggagggugcagugagcucagauugugccccugcccuccaacuugggcaacagaaugagacccugucucaaaaaaaauuaaaaauaaauaaaauagagaaagcuaauuuuucauaaauguucaagccucaguaguuacaaauccuaacaguacuuuguagagggcuuauuucagacuuguuuuaugaccucugcaagagauccuuagcugugugcuccauaauacuggcaauugucuuaagaugaauaaaaccaaaaucuauuauacauucuuagaauugguauacagucuuugaacuuaaaauugucuucaucuccauugaacgaugucaggguccaugauuaaauuaagugugugauuaucucgcagagucguuuauuaugccuauaucaaaugucagugggcaauaacggaaauaagauuuuauuacuucugcuuuucauuucuaauuggcauccuucucuguguauaggugucguuucagucagauguugcauccaauuuuugaggaagcuuccgaugucauuaaggaagaauuuccaaaugaaaaucaaguaguguuugccagaguugauugugaucagcacuguaaguaccucaauaggaagucuagaagagacugucccaucccaaacacaggcacacauacacauuuuuucuuuucuuuucuuuucuuuuuuuuuccuuuucuuuuuuuuuuuaaaugcucugcuuuuaaguggagaacaaaccgaaaagguucuagugaccuugguuaaauuguuacuauuuaauuuuuauguacuuagaacacuacuuuccauuuugcuugugugaagguuuuuuuguuguuauuuaaaaaauuacaguaggucaagcguagggaacaaaacuagcaguguuuucuaccaaagcaaauaccaaaaucaguaaauaagauugaaauguaguauuagaagaaaaaauggauuucuguuaguuuuagaaucaugugaaaauaccauuuauagucauuucaaauaagauagucucagauuuuuguguguuucuguuuuugaaaagauucuguuuugaaaagauucugguuuagacuauuuuugagucuaauuagcuguagcaacugauuauaauuauuaagaguguuaagaaacuuagcuuaggcucuuaaaauccaaccucuugcauuuugcuuguccugguggagcauucucuauaaaauccucaugguuuuucguauacaugaaggauuugucuaacuugaacuagugaucuugcuagugguguuuccuccuguguguucccauuauacuugaacuuuccucucucaucgugcuaaacucauuguauuucguaguucugguucauugugucuuaguugucuuaucagcugcauugucuguucauuaaggcaggaauuuuuuuuucuuucuuuuuuuaaugcucacuuuuaagaggagaccaaaccacuuauuaaucucugugucucaagcaucugacaguugcugggagacagagacugcucacgaaaagcuauugcauugaguuauuuguaaguuggugugaauacagaacugucucccauucuucaaguuuucuauuuuuuuauacuuaaccuacugauuaaaauuaguauguguguacacacaccuaacuuuucauuuuacugaugaggaaauggauaugaaguggcuuaaucaauguuacauagcucagugucugguaaagcccgaauuugaauccugauuuucugaccaaaugccuucauuugcucuuuucuguucaaacauuuuggggaguuauugguauagcuuugcgcuaggcagcaaggcauuuuccaauaguaaaucauuucacagucuucugagccccaccccauauuucugucugcugaaauucauaacuagauagggugaagggagcaauaaaagguugucaguacaggcaugggcuacauuuucacacugcuucccagaucuuuucuccgaccuuucgcugacagagaacaugauguuuuugguguggguucucauuucaaaucuuucuauucuuuauguauuuaauuagauguuacagugcagauaagacuuccuacuuuuacugaauuugaaccauaaaauuggaaauuaugcucuaaagcuuacauucauugggaagaaaauuuaauacuuauauccuugaaccauaaauaucauuuauuccaucuuuuaaacagauaacuuuugaagaaaaucugacaucauugcuaguaagcuuucuuuuuaugggggcaaauagcacaguucagaugcuuuucaauccaccagcaaguuaucugagguauuaugcauauuuugagguauuaugcaucucucugaauauuuuuucucuucuauguaauucuuuuaaagaaaugauuguuaugaaacccuuauugauuaauguauuuacauuuuccacagucucuuuagagauuguaagacaaacuguaguuuuguuaaccucuuaugugccaauuagauuguagagguuuuggacuggaagaaccuuaagaauucuguguucuaaagagaaaugccuuuuaggcagauuauucuguggucgaauuuuuuuuuuuccuaaccauuuaaacaacuuuaauuuauauacugauauacguaucagugcuuugaaaaauagauuguucaauccuaaagcaguuuuuaaaagagauuuauugagguauaauugacauauguuacacaaauuuaaauuuuauaauuuuauagguuuugauacauguguguauccaugaaaccaucaccacaaucaagauauugagcauagcugucauccuccaaaauuuuccuugugccccucugugaucccugucugucccuucuauaccucaccuucaucauccuuaaggaccaucuacuuuccaucacuggagauugguuugcauuuucuagaauuuuauauaagugaaucauacaguaugagguuuuuuuugucuggguuuuuuuuuuuuucuggacuuaguauguuuauuuugagauuguuucauguugcauauauuauuucuuauuauuuaguggcauucuauuguguggcuauauaccacaauuuguuuaucuguucacuuccugacagacauuuggguuguuucgacuugcuggcuauuacaaguaaagcuguuaugaacauucagauauaaaucuuuauacaaauaaggauuacaaauaaagcuguuauaaacauucagauauaaaucuuuauacauauguuuucauuuuuccugagcaaauaccuagaugugaaaugcuaggucauaugguagguccauguuuaacuuuuuaagaaacugccaaacuauuuuccaaaguauuuguucuauuuuauauacccacuaauaguacaugagaguuccaguuguuccauauucuugucaaaacuuggaguggauagucuauuuaauuuuacauauuccaauaugugugaaguggugucuccuugugguuuaauuugcauuuuucuaauaauuaaugacguugagaauauucuuacauguuuauauacauucauguaucugugaugaugugucuguucaaauauuacacauuuuuuauuggauuguuuauuuucuuauugaaauuuguuuauuuauuuguuugcgacagggucucacugucucgcccaggcuguagugcaguggcacaaucuuggcucacugcagucucggaccuuccaggccccaguggccuuuccaccacagccccccaaguagcaugugccaccacacccagcuaauuuaaaaaaauauuuuuagagacaggucuccuuauguugcccaggcuggucucaaacuccugggcuaaagugauuguuccuccucggcuucugaaagugcugggauuacaagcaugagccacugugcccugcccucugaguuuugagaguucuuuauauauugugaauacaagucuuuuuucacauauguaauuugcaaauauuuucgcccauucuacccuuguauuuuuuuaaaaaaauuguaacauauacauaaaauuacuaucuuaccauuuuaaauuguacaauuuaauacuguuaaauguauucacauuguugugcaaccagucuccaguucuucaucuugcaaaacugaagcucuacacccguuaaacaacagcuucccauugcccauucuccccagccccuggcaaccacuuuucuaccuucuuuuucuacaaaugcgauuacucuggguacuccacauaaguggaaucauacaguaucugucuuuuugugacuggcauauuucacuuagcauaauguccgcaaggcucauucguguuguagcaugcgucagaauuucccuacuuuuuaaggcugaauaauauuucgugguauguauauaccacgauuuguuuaucauccaucaagaacacugguugauucugccccuuggcuauugugaauaauggugcuaugaacaugaguguacuaauaucucuuugagaccuuuaaagaaaguucccaguuuuuuuuuaauauauauccaggaguggaauugcuagaucauaugguaguuuuuaauuuuuugaagaaacaucauaccaucuuucacagcagcuguaucauuuuacauuuucauuaggaguaccuaaggguugcaguuucuccacacccucaccugcacucuuauuuucucuuuguuguuguuuuuauuuuuuuuaaauuuuauuauuauuauacuuuaaguuuuaggguacaugugcacaacgugcagguuuguuaacauauguauaaaugugccauguuggugugcugcacccauuaacucgucauuuagcauuagguauaucuccuaaugcuaucccuccccccuccacccacccaacuccugggcucaagggauccucccacucagccuccugaguagcugggacuacggugugugugacucugugggcucuauuuucuguuuuuguucguuuguuuguuuauagcagccauacuaaugggugugagaugguaucucauuguguugguuugcauuucccuaauaauuagugauguucaguauuuuuucacaugcuuauuggucauuuguauaucuuccuuggagaaauauuuauucaacuccuuugcccauuuuaaaaucagguuauuuggguuuuuguuguugauguugaguuguaggaguucuuuguauauucuagauauucaccccucauauauaugauuugcaaauaaauucuccuguucuauagguugccuuuucacucuguuaauuguguccuuugagucauagaaauuuuugaugguaauguggucuaucuuauguauuuuuacauugguugacugugcuuuagauguuauauccaagauauaauugcaaucuaaugucaugaagcuuuacucuccuauguuuucuucuaagaguuuuagaguguuuagagaguuuaagaguguuaggucuuauauucaggucuuucauuuauuuugaguuaauuuuuguguauggaacaagguaagggcccaacuuuauuauuuugcauguguacuucuagguuuuccagcaucauuuauugaagagccuguucuuuccccauugaauggccuuggcauccucaucaaaaaucauuuuacuauauauuugagggguuauuucuggacucuguaccauggucuguaugucuguuuuaugccaguuccacacuuuuugauuacuguagucuugcaguauguuuugaaaucaggaaguaugagaccuccaacuugagugucuuuugaagagaagauguucuuaauguuggugcagucuuacugucaguuuuuaaaauggauuauaguuuugauguuguaucuaagaagucuuugccucacacaggaucacaaagauuuucugcuauguuuucuuuuauaaaugugguaguaugaagguuuauacuuaugucugugauccauuuggaauuaauuuuuacauguggcauaguguaugaauuggaguucaauuguuugcauaugguucuggcauuauuuguugaaaagacuauccuuucuucacugucauugcaucuugcugaaauaaacugacacuguaugugugggucuauuuuuguucugucucuucuauacuguugaucuguuugugcuuauaccaguacuucguagauuacuauagcuuauaaagaguuuugaagucuggucagguaaagcuuucaacuuuguacuuuuuuuucagaguuguuuggcaguucugguugauuuagauuuccauuuaacuuuuagaaucagcuuguuaauuuuuaaugacaacauaaaaggcgacugggauuuuaacugggguuacuuugaauccucagggcaauuugugggaaauuguuauuuuaaugauacugauucuucgaauccaugaagauuguauaucucuccauuuauuuaggcauuuucaguuucuuccagcaaugcuuugugguuuuucagccuacaugucuuggauagcuuuaucagauuuauuccuaaguauuucuuauuuuuuugaugcuauuguaaaugauacuuuaaacuuuauuucuggaauaauuguagaucauauguagauuauaguugcaaaaauaauacagagaauucccuuauauuccuuaccuauuuugcccuaacaucaacaucuuauauuacuauggcacauuuggauuuuauuuggauuuuaucccucuuccacuuaauaucuuuuuguuguuguuguucuagaguaucacuuuuaggcauaaugucuuccugguuaccuuugaucuauuuguuucucagucuucauuuuuuacaaccuugacaguuuugaguaauauucuuuaagaauuuuguagaauguccuucauuuugggcuugccugguauuuuuuuucucauguuuuggucaucuuuugugagaucucucaguaaguauuucuuauuuuggggugcuguuauaaauggcauugauuguuaaauuuuaauuuuuaguuuuuuuguugcuaguuuauagaaauaagauugauuuuuuauauugacccuauauacuaaaacuuauuagcuccaauaaguuuuauaaauacaguccauagauuuucuacuuagacaauuagguuuuuuuugcaaauuaaaagcuuuaauucuuguggucuguauuuccuuacaguauucuuuccaaccaaguguaccuacuuguugcuuuaggauuaguuuuuguuaggcagaagaucuguaagaagcuuccuagcaaggacagaagguggccucagaaucaagauaucaucaugcccacguaugucuuguuuguaucaaucaccugucugguauuauguuagccuacucuguccugcccuugaguacuuuagucugucugccuugcuuccaacucacugcuucacugagaccuuuuauccaaagucacaguauuauuucuuggaaaaguuccuguaaaaaguuucuagucaaauugccugggaaaaaacccuacuacuuauugagugcuuacuugauuuuagacauguucuuucggauauuuuaguuaucuuuaccacgacgcauuacaccucuaguuaaguaguauuauucauuuaacaacaaaaaaauuuaugccuaccuuauguaaugcuauguggaagguucuauagcuacagcaaugaaccaaacacacccagaaaggcaagagaguacaauacacaaucgcaaauugugauaucuauucugacgggaagguauugaaugcuacaaaaugaugagucugacuuagucugcagggauagggaagacguuuucgaggaaaugauuaaaaaaagugaaggaagaguaggaauuuucaagugaaguaguggaagaagaguguuuuagauggaaguagcaguagaugugaaguuucugagguaggagagagcacugaccuuucagagaguuggacuguguuaccauuuuacugaugaagaggcugaaagauacagagaggcuaaguuauuucccaagguugcauaguaaauggagggagccagacuggaacccaggacgauacagcuuuuaucaguuaacuaugcuauuugaaagucaaaauaaaguaauuuaaauugaauuccccauagaaauggagaauucgcccauuucugaauaaaaacaacuuaaaauguccuauuacagguuauaaaauagucuguuuaaauagucuauaaugggucauuauauaaauaaaaaugcaauugcaauuuuuugguaaguuugaaauuuuacaaauuuuuagaaacuugguauuuuaaaaguccugaaccuguaguuugucauugauuaaggaaaaagcuaggagcgccuuacuuccuuggaguuuuugaaaaaguauguguaagaagcuagaaaucugcaguauacagaguauugugauauuguuaauuguaauuugcuuauuuucacuguaauaaaugaccuucaacacaauuauugaauuuuuaaaaacuuucuuugaauaggcuuuugccagcauuuugaggaaugcuuggaguugagcuacuugauggcuucuagaaacugacccacaguucucugugugguuguccugaguuuuucauuuucauucauuuaagaauuucguuuaauauguucauacuguucuguccauuaaaaaaaaaaagaauuucauuuaauauucuagccuauggaaacaacuaguaguagcagcagcagcagugauguuaauaaugacaauaauaaugauaaaauggcucuaugagaguagagaccuuauguuuuuaccuuucuauuccuagcacuggaaugguaucuagcacauaguagguguucaguuguaauuguugaacagauggauagauaaaugaauaguaaacaguaccagcacuuaugaacuguuuuguaggcacuacaguuaucauuauuuuccaaaaaugaaauaaauacugccauaguuuauacccagucuaacucaucauugaucguaaggcaaaauuuuauguacaaaagaaaaaaugaacuacaacacaaagcuuucuuaucaguuauauuuuuaauucauaugugauaaacauuuaugagauacagaguaauauuugaauacauguauauaauguuuaaugguuacaucaggauaauccucucuucuaguacucaaaaauauacaauaaauuauuauuaacuacagucacccuacagugcuguagaacaacacuagaacuuauuucuccugucuagagguaauuuauuuuuaucuaacuuuuguagauacauaguaggguguauauuuuuauggauuacaagaauuuuuuuuuuuucuguuugagacagagucuugcucugucucccaggcuggaguacaguggcgcguucucagcucacugcaacuucugccuccaguggucaagcgauucuugugccucagccacuugaguagcugggauuacaggugugcgccaccacggccagcuaauuuuuguagauuuaguagagacagggucucaccauguuggccaggcuggucucgaacuccugaccucaagugauccacccgccucagccucccaaaguucugggacuacaggcgugagccacugcgccaggccaaaagauauuuugaaguccguaauagucacaucaggguauccaugacuucaagcauuuauccuuugucuuuaaaacgauugagaucgaaucauacgguuuaaguuauuuuuaaaaguacaauuaaauuaguuucuacuauagucacccuguugugcuagcaaauacuaugucuuauuuaucuuuuuuuuuuuuuuuuuuuuuuuuuuuuuuuuugagacagagucucgcucuguugcccaggcuggagugcaguggcgcuaucucggcucacugcaagcuccaccuccuagguucaggccauucuccugccucagccuccugaguagcugggacuacaggugcccgccaccaugccuggcuaauuuuuuguauuuuuaguagagacuggguuucaccauguuagccaggauggucucgauuuccugaccucaugauucgcccgcuucggccucccaaagugcugggauuacaggcaugagccacugcgcccggccuauugauucuuucaaacuacuuuuuuguacccauucaccaucccucccugacccucgacuacccuuuccacccuuugguaaccauccuucuaugcucuaucuccaugaguucaguuguuuuaaguuuuagcucccacaguuaagugagaacaugcaauguuuuccugugccuggcuuauuucacuuaaccuaguaaccuccaguuccauccauguuguugcaagugacaggaucucauucuuuuuuuuauggauuaguaauacuccauuauguguauguaccacauuuucucuauccauuuguuugucaauggacacuuagguugcuuccaaaucuagccuguucugaauagugcugcaaugaacaugggagugcaaaugucucuugcauauacugauuuccuuuccuuuggguguauaccuagcauugggaucaugggaucauauggucguucuauuuuuacuuuuuuugagucaccuccaaacuguucuccauagcgauuguacuaauauacauuccuaccaacagugcaagaggguucucuuuucaccuuauacucgucagcauuugauugccugucuuuugaaugaaagcuauauuaacuggggugagauaguaucucauuguaguuuugauuugcauuucuuugacgaucagugauguugugcacguuuuuauauaccuguuucccauuuguauguuuucauuugagaaaugucuauucaaauauuuugcuuauuauuuaaucagauuauuacauuuuugaguauagaguuguuugaguucccuauauauuuucauuauuaaucccuugucagauggauaguuggcaaauauuuucuccaguuauguggguugucuuuucacuuuguugauuguuuccuuugcugugcgaaagcuuuuuaacuugaugugaucccauuuguccauuuauuuacuuugguugccugugccuaucggagauugcucaagaagucuuugcccacuccaguguccuggagaguuuccccaauguuuucuuguaguaguuucauaguuugaagucugagauuuaagucguuaauccauuuugauuugauuuuuuguguauggcaagagauaggggucuaguuucauucuucugcauauggauauccaguucuuccaguaccauuuauugaagagacuguccuuuccccaguguguguucuuggaaccuuugucaaaaauguguucacuguagauauauggauuuauuucuggauuuucuguugcacugauauaucugucuguuuuuuguuuguuuauuguuguuguuguuguuguuguuuugagucggaaucuugcucugucgcggggcuggagugcaguggcgcaaucucggcucacugcaaccuccaccucccagguucaagugauucuucugccucagccucccaaguaacugggacuacaggcacgugccaccauacccaacuaauuaguguauuuuugguagagaugggguuucaccauguuggccaggauggucucgaucucuugaucucgugauccaccagccucagccucccaaaguguugagauuacaggcgugagccacugcgccuggccugugucuguucuuuaugccaguaucaugcuguuuugguuauagguuggugcaaaaguaauugcgauuuuugcccuuuuuuuuuuauggcaaaaaaccgcaauuacuuuugugccaaccuaauacuauaccucuguaguauaauuugaagucaggugaugggauuccuccaguuuuguucuuuuugcuuaagauaacuuuggcuauucugcgucuuuugugguuccauauaaacuuuaggauuguuuuucuauuucugugaagaaugucauugguauuuugauagggauugcauugaauagguagauugcuuuugguaguaauaacauuuucacaauauugauucuuccaauccauaaacauagaauuucuuuccuuuuuuugucccuuucaguuucuuccaucgauguuuuauaauuaucauuguagagaucuuucauuucuuugguuaauuccuagguauuuuauuuuauuuguagcuauuguaaaugggauuacauuuuuauuucuuuuuuagauuguucacuguuagcguauaaaaaugcuacugauuuuuguaaguugauuuuguaucuugcaacuuuauugaauuuguuuaucaguucuuauaguuuuuuaguggucuuuagguuuuucaaaauauaagaucauauuauuuacaaacaaggauauuuugacuuuuuccuuucuaauuuggauucccuuuauaucuuucucucaucugacugcucuagcuacgacuuccaguacuauguugaauaauagugacagugggcauccuuguauuccaaaucuuagaggaaaggcuuucaguuuuuccccauucaguaugauacuagcugugggucuauuguacauugucuucauuaaguugagauauguuccuucucugcaaguuccuuggggguguuuaucaugaaggaauguugaauuuuaucaaaugcuuuuucagcaucaauugaaauaaucauauguuuuuuauccuucauuuucuugauauaauguaucacauugauugaucugcauauguugaaccaucauccuuacaucccagagauaaaucucacuuggucaugauuaaugaucuuucuaauguacuguugaauuugguuugcugguauuuuguggaggauuuuugcaucaauauuuauuggccuguaguuuuccuuguguggaugugccuuuguccgguuuuagugucaggauaauacuguucucauagaauaagucuggaaguauucccuccuccuuuguuuuuuggaauaguuugaguaggauugguaucaguucuuccuuaaauguuugggaggauucagcagugaaaccaucagguccugggcuuuuuuuuugccagaagcuuucuuauuauggcuucgaucucauuauuuguuauuggucgguucagguuuuggauuucuucauggcucaaucuugguagguuguaugugucuaggaaugugucaguuucuucuagauuuuccaauuuauuggcaaauaguugcacacaguagcugcuaaugauccuuagaauuucugugguaucaguugugaugucuccuuuuucauuucugauguuauuuauuuaggucuucgcucuuuuuuucauagucuggcuaaagguuugucaauuuuguaaaacuuaccaaaaaaccaacuuuuuguuaccugugcuuuuguauugucuuuuucaauucaauuucauuuauuucuguccugaucuuuauuauuucuuuucuucuacuaauuuuggguuugguuugaucuugcuuuucuaauucuuuaagagguaucauuagguuauuuauuggaaguuuuuucuuauuuuuugauguagccauaaacuucucucuuaguucuacuuuugcugaaucccauagguuuugguauguuguauuuccauuauuauuuguuucaauaaaauuuucaauuuccuucuuaauuucuucauugaccacuggucauucaggagcauauuaauuuccauguaauuguauaauuucuaagauuucucuuguuauccauuucuaguuuuauuccauugucaucagaggagaugcuugagauaauuucaauuuuuuugaacguuuuaagacuuguuuuguaaccuaacauguggucuguccuugagaaugagcuuugugaugaggaaaagaauguguauucggcagccauuggaugaaauguucuguaaauaucuguuagguccauuugguuuauagugcagguuaacugugauguuuccuuguugauuuucugucuggaagaucuguccaagacugaaaguaggguauuuaagucuccagcuauuauuguguuggggucucucuuuagcuauaauaauacuugcuuuauauaucuggauguuccaguguugggugcguauauauuuacauuguauuacaugcauuacauauguauaugcauuguauuuacauuuguuauauccucuugcugaauugacccauuugucauuauaugugaccuucuuugucucuucuuauaguuuuugucuugaaaucuauuuugucugauauaaguauagugaucuugcucuuuuuugguuuccauuggcauggaauaucuuuuuccauuucuuuauuuucagucuauguaugucuuuagagguagaguguguuuuuuguaagcaacagaucuuugggucuuguuuuuuuuuaaauccauuacaccagucugugucuuuugauugaagaguuuaguucauuuauauucaguguuauuauugauaaguaaaggcauacgccuuccauuuuguuauuucuuuucucauuguuuuguggucuucucuuccuucuuuccuuccuugcugucuuccuuuuagugaaggugauuuucucuggugauaugauuucauuucuuuuuauuuuuuauuuaucaguuguauguuugauuugagguuaccauguggcuuccagauacuaucguauaacucauuauuuuaagcugauaacacugcauaaacaaaugaacaagcaaaaagagaacuaauaaaaacuguacacuuuaacgucaucucccugcuuuuuaacuuuuuguuguuucuguuuauaucucuguguacuuuuugucuugaaaaguuguugggguuauuauuuuuugauuggucccuaauuuagucuuuuuacuuaaaaguaguugacacaccgcaauuaguguuauaauauuuucuguuugucuguguacuuucuauuuucugugacuuuaguacguucagaugauuucuuauuauuaacgucuuuuucuuucucauuaauauacucacguuaacguuucuuguaggacacaucugauguugaugaaaucccucagguuuuguuugugugggaaagucuuuauuucucuuucauauuugaaggauguuuuugccacuauaauaauagugggauguuaucccacuauucugggauaaaagucuuuuuccuucagcaguuugaauauaucaugcuacccucuucuggcacguaagguuuccacugaaaagucugcugccagaccuauuggaguuccauuuuauguuauuucuuucuuuucucuugcugcugguuauucaggccaaagggcucuucaguaagcaggugaugaauccugucgaguggguccuucuuuucaaagcagcagguucccuuccagcccaggauguaucuagaaaugucauccaggagcuagggccuggaaagggugcuucacgacugucuggugcccugucuugcugugacugagcugguaucccagaugcgagacaaaguccucaacauucuucccucuccucuccuugagcagaaggaaggggucucuuuuggaguggugagcuaugcagucugggguuaacggaggggugaugccagcagccccuuaagccauccugguuggugucucaguaggucauauaucugcccgccauguccauuggcucugaguccaguucagcccuaagacuugccaagaaguugcaguucuuguggccuacacugccuuucaaguuuauuuaggggcccagagcacuguggcacaaggugguaauguuugccagaacucaaguucugacugcugagaugggugauuuuccucuggcuugggcuaguuuaaauacucccuccaugugugggcgucagcugaguucuguucaauuuugcuuucugcuauaacagggaagcccugaguucaaggcaaugucucacaauugcugugcucuccuucucccaaucacuguuuauuguacugugcagcugcugccaggggaugagugaggggugguguuggugauucaagacaguuuuuucuaccuucucacugccuguuucagugaaacgaaguuaaaacuagguagugugaguguucaccugauuuuugguucuuaugaaggugcuuguuuuguguagauaguuguuaaauuggugucuuugcaggagggacaauugguggagcuuucuguuucaccaucuugcuccgccucucucuagagguaauuuuuuuuaaucuguuaagcaaucucucccuauccuccccuccccacuaccccucccacccucuaauaaccacaguucuacucucuacuuauaugagcucaacucucuuagcuccgacauaugaaugagaacaugcaguauuuauuuuucugugccuggcuuauuucacuuaacauaauguccucuaguuccauuuauguugccacaaaugacaggauuucauccuuuuuuguucauuuucaacuuuuauuuuagaaucggggguacauggggguauaugugcaggauuauuacaguaaggcauauugcgguguuuugagauuugggguauaacugcaccugucaaccugcugugagcagaguacccaauagguagcuuuuuaguccuugccccacuugcuuuugccucucucuaguaguccacagugucuauuguucucaucuuuauguccauguauaccuaauguuuugcucccauuuaaaagugagaacaugcaguauuuuguuuucuguuucuguguuaguucacuuaggauaauggccuccagcugcauccagguugcugcaaaggacaugauuucauucuuauauauguggcugcauaguguaccauggcauauauguaccacauuuucuuuuucagucugccauugauggacaccugcagaggaaaugauuuuguugauuuuuauggcugcauaguaaucaguuguguauauguaccacauuuucuuuauccaguccacuguugauggauaccuagguugguucugugguuuugcuauugugaauagugcugcgaggaacauaugcaugcauguguccuuuugguaggacaauuuauuuuccuuuggguauauccccaguaaugggauugcuggguugaauggcaguucaacucuuaguucuuugugaaaucuccacacugcucuccacaguuggaguaguuuacuuucccaucaacaguuguuuaagugccucauuuucucuucagccuugccaucaucuguucuuuuuugacuuuuuaacaaaagcuauucugacuggcauggggugguaucucauugugguuuugauuugcauuucuuugaugauuagcgauaauaagcauuuuuucauauguuuguuggcugcuuguaugucgucuuuugaaaagugucuguucacauccuuuguccacuuuuuguuuuuuuauuuacuuuuuguuuuuauuuuuauucuuauuuuuuuaagacagaguuucggucuuguugcccaggcuggagugcaauggcacaauccuggcucacugcagccucugccuaccggguucaagcaauucuccugccucagccuccuaaauagcugggauuacaggcacaugccaccaugccgggcuaauuuuguauuuuuaguagagauggcguuucaccauguugccuaggcuggucuugaacaccugaccucaggugauccauccaccuuggccucccaaagugcugggauuacaggccuuugccuacuuuuuaaugggguuauucguguuuuguuuauugauuuaauaaguuccuuauagauucuagauauuagaccuuuguugagugcaucauuugcaaauauuuucuuccauacuguagguuguuuguuugcuuccuugguaguuuuucuugcaguucagaggcucuuuaguuuaauuaggucccacuuaccaguuuuuguuuuuguugcaguugcuuuuggugucuuagccauaaauuuuuugccaaggccaaugaugagaaagguauuuccuagguuuucuuauaggauuuuuauagucugaugucauauguuuaagucuuuaaucugucuugacuuaaguuuuguauaugaugauauguagagguccaguuucauucuuuugcauauggauagccaguuauuccaauaccauuuauugaauagagagucuucuuccauugcuuauuuuuguugauuuuguagaagaucaggugguuguaaguguguggcuuuauuucugaguucucuauucuguuccuuuauucuaugugucuguuuuuguacugguaucuuacuguucugguuaucauagccuuguaguauaguuugaaguccaguaauacgaugccucuggcuuuguucuuuuugccuagguuugcuuuggcuauugaggcucuuuuuugguucuguaugaauuuacaauaguuuuuucuaauucuguggaaaugaauugauaucguuaaaauggccauacugcccaaaacaauuuacagauuaauacuauuccugucuuucucuuuuugacuggcuggguuguauuucuuuuucuuuuucuuuguuuuuuguuuuuuuguuuuuuuuaauuaagugaaagcaaauuaauuaggaaagcaagggaauaaaagaaauggcugcugcauaggcagagcagccgcaagggcugcuggcuggcuauuuuuaugguuacuucuuuauuauaugcuaaacaaaggguggauuauuugaguuuucuaggaaaguggugggcaauuccuggaacuuccugccuuuuuuagaucauguaagguaacuuccugacauugccgugucauuuguaaacugucauggugcugcugggaguguuuuguuuuuuagcaugauaaugcauuauauuaauaauuaucauaaugagcacugaggaugaccagaguucacuuucauugucaucuugguuuuguuggguuuuggccagcuucuuuacugcaaccugcaagguuuuugugaucuguaucuugugccaaccuccuaucucauccuaugacuuagaaugccuaaccuccugagaaugcagcucaguaagccucagccuuauuuuacccaaccccuaugcaacauggagucacucugguuugaacgccucugacagaguugaccugguugaguggccucuggcauauuuucccucucucuuuuacaagggaacccuuaauccuaaggauuguagagggacaaagauccauauucuguaacuugagcuugaauaggggcaaugauauuccugccuaccuauuagagucucuuguauucaggguagagaggagcugagucagaaagcauugauaugucgagggccauucauaacucugaguucuaauaaaaguugauauccaucccucuugcuucugaguaccagccagagaugacugguugauucacaggaauaagcagagucagucucaauagcagaaaaaaccucaaaaacaacugaugagacagguguaccauaguucucucuccaguccucauuuuuacuaaagauaaaucaugguaagacugcuuugcuuuauuauacuuggccuaguuauuuguauaaagugcagcaagaauaauuauuuuucacacaggcuuucuuaauuggcuuuaaugggauuuucuuucauagaaggaaucucagguuagacuuuuuuaaaaaguugagcccagccauggguuuguauccucaaauaccugugaguuuaguaaauuccuuuccucuugaggucccaagauaacuuggggcuccuuggccuaucagaaagugacauucuuuacuuaccacaggucagaaaccauguacagggacuguguagacaagguguaaggccaguuuucucaaggggcuuuuauuggcucuacaagucaacguugauuccuuaaaggaaagcacaccauucuagucaaagccuugguaaaauaacaaauuuuuccaauugugucaugaugcaaaagaaaacauucuuauugcacuuaugcaaauaauuguauugccauaaguuaagaauacuuacaaauaguuuccaaauucuggagaaaucagguagaaacaaauaugcuccaaauuuuguucacaggaguauacuuuacuuaauuauuaaaagcuguuaauagcucaaaagaagaguuuccuugauucuuaaaaacuaaacaaaggaucagcaacauuuuaagcaaaaagucaaaaaagauuauuuuuguccucuauuaguuagguccaugugguuaauaccugucuugcuuaauagucacgaacauuucagcucuccaugaguccugaaugcuuuuuccucuaaagucagaaucuccaaagaucagaaaccugcauucaagaauaccuguuagaguucuagaguugauuauaaaaccaccuucugaagaggaucaauacaagacaacauugucuguggaugccaaaaagucuuaggacagccacuauuaaagccacaauugacaaguuaauuuugcuuacuucugugccauacaacaauuuuacauaucaauuauaauuauuaauaacauagacuaagucauuucagaguaauaggaguuucuuauaauuuuagaacacauaccaguaacauauuuauacaaauacggcccaaagaaagccaaauaccaucucauauuuggcaaugcuucuuguaugauuuucauaccaaauaagccaaauaugucauuuuuugacuuuaggggaccuaauaucuaaaagauuaauuaggucagaaaagacauaauuuauaacuugauuuaagcacuuauuaguuuuaagccaauagaugcuuuuuuuacacuacacacaacauauauaaauacacagaagaucuaguaguuguaagauuuuuuacuucccaguuuuuuaauuggauuacuggcuucaggguggagcccuggaggaacagggccagggaagugugcaguuucuacagccuaauaagcgggcauagcuggaaugcaaaauagaucccccaaauuaagggucccauuuuuauaccagauccuggaucccaaaaaaaagagggagccagcccaucucccaugggagucuuaucucucaguggggugugaggacauuuucauaccuucuagggggccaagagcaugcuucucuaauccaaaagugcagagucaaguauuaaacuauaacugccauuaagcaugcccaaaaauacauuucuuaaguaguucucucauaauucaaaguaauuucugauaccuuccaaagucaaaaacgucagauaacauaaugcaaaacagaacagaaccuuagauuuugagaggaaucuuagcuauuucuaauuucuaggguuucaugaggaaaacagagguuuuucccaaaacagggucugucgugccuccucuguuuuucccagggaaucccaggcuguuagagcuugaauaucugcuuuuaauuaagcuaacuuuuaaccauagcacucuuaaaaaaaaacaguucuuuuaaauuucuuauuaucugacuuuagccaggccaaaugaccaguauuucuggguuuugaacuuuaccaaagguaaccuccaaggugcucagagaaaggaaaauucaagaugguucguggagagggagggagucaacaaaugauaaaggucuuacagauaucaaaccagaaaggacuuauucccuaagccaggaauugaacccucaaccugugccaccauugugaaaagacaaagccuuagcuacuaagcuacagcauuggacaguuucuauugcucuucccugaaggaggcuagagcagucaguuuugagcuugcaaaggcuuuuaauggcuuaagauaauuuuuugagcaaacuaugacauggaccccaaaacuccuguucccuggauggcagagaccaacagaaaguacugacccauucuuacaaggucaagcucccaaagacauagaacaaaaugagaaggaaacuucagcauuuuuuuuuuucagguacuugcagcaaagucuguaauuaaccaguuuuccaggcuggcuugaaccugggcuuaugggauccuaagcccguguucuguccauaaagguauucuucuuuaugacagagcaauguagaaagacaaaguugcagcacaaaguacaccagauucgcuacaguagccacucugcuuaguaugcaauauggaauuggcaagguucaaacuugcccucagaugggcccugucaucuuuaauccaaccucugcugucauguggucucagggcacagaggauaggaaagggagaaaagcauucauugccugcagcaagguggggaaggcaaggugcucagggaggccagagaaagaccuacuuauugcagugacacucaaucaaaaguucaggcggucacuugucaguugcaaagggguuuuccaacagucucaccagcuuucaaguuuccccuuuuggggagaaaaaaggcucuccauguccagugauccuguacaugccuaauccugucacccacagcugucagcgaagaguacaaggcagauuaauccaaagagaauagugguuaacuccccauaaugccaaauccauucauagcugagaggaacuuuacugaguggggccucuaacucccuaaauuuuaggaaguauucuaaccauccuaagcugggccuugaacccaaguuccaccagauguccuugccuuuuauuaagaggggccuuuaacccacucuuuuuuaggagacacucuaacuccccucaguugggccucuaacccaaucccauccuuuacccggauaccccacuacuuacccagaguuggccauuuggugcugcagucuguuuccuuuuggguuggggguuuccucaauaucgucccuccaugguucaccaggaggauauuaccagaaaggaguccugauccagaccccuagagaagauucuuggaucucaagaaagaauuugaugugaauccauagaguaaagugaaagcaaguuuauuaggaaaguaagggaauaaaagaauggcuacuccauaggcagagcagcccugaguuguauuuuauuguguauauguaccacauuuucuuuuuucuuuguuuuugagacugagucucgcucuguugccaggcuggagugcaguggcaugaucucggcuuacugcaaccucugccuucuggguucaagugauucucccgccucagccuccugaguagcuggaacuacaggugcgcaccaccacgcccggcuaauuuuuguauuuuuaguagagacgggguuucgccauguuggccaggauggucucaaucucuugaccucaugaucugcccgccucggucucccaaagugcugggauuacaggcaugagccaccgcacccggccccacauuuucuuuauccauucaucuguugauggccacuuagguugauuucauauuuugacuauuguaaauagugcugcaguaaacacgguggugcagauauguccuugcuauacugauuuccuuuucuuuggauaaauacacaguaauggaauugcuagaucaugugguaguucuauuuuuagguuuugaggaaccuccauuuugucuuccauaguggcugugcuacguuacugucucaucaacaacaugugaauguuucccuuucuccaaauccucugcaguauuaauuauuuucacauuuuuguuaauagccauucuaacuggggugaaaugauaucucauugugguuucgauuuguauguaaccacaugauuagugaaacugacaauuuuuuuucacaugcuuuuuggccauuuguaugucuuuugagaaauguuuguugagaugccauguccuuuuuaaaauaggauuuuguugucguuguuguugcuuguauauucuggauguuaaucccuuaucagaugauuaguuuacagauauuuccacuaauucucagguugccucuucacucuguugaguguuucccuugcccuacagaagcuuuuuaguuugauaaaaucccauuugucuauuuuugcuuuuuuuuuugccugugcauuuaaagcaguauccauaaaaaucuuugcacagaccaaugugcuaaagcauuuccccuauguuuucuucuacugguuuuauaguuucgggucuuagauuuaugucuuuaauccaucuugaguugauuuuuguuuauggugagagauagggacacuuagaauuuuuuuauaccuauugugaaaacuauuuuagacucagaaauagauuuuaaaaauucugucauuauugugugugccuuaaaaggaaaauaaauuuguucaaguuauucugaaacuagagucugacucuugugcaucauuucucaacugagucgaguuuuuuguuuuuguuuuuguuuuuuuacacaguauuggccuccaugccauuaagaguauugguaaugcucuacucucucuaggaauuucuuccaagcugcuaaaacccauucugcaaguauugaugcuaucacuuuacuauuugacuaaccucagaguuuauuuuuucugaauugaaauauaucucugcuaguuaagcaacuuuucuucaaaguuaccaaaauauaagccaaaauguuaauagugguuuucuccaguggugguuggaagugguucuuguuuucuucuuuguaacugucugcuuuccaaaauuucgaaacacacauagacacacauguacacaugcauguacauaugcacacaauuaaaacauggccuugcuucaacuugcuucacaucuuaucuucugcagucuuaucauuuggggaauucaggagcguaauucauuauucuccuugguggucaugcuugcugccuugaaucuagaaagucccaucagucagccccuggugggaccagguucucugcugaccuccaguggccuuaggcuguauggcacuaagcaagaggcauucauaugcuugcuggucagugcagaacagacccacacuuguguuuuuaggaaaguacuuuguaauuguccuugauuagguagcacaugcacccauauaccugaguuacucuuaccugucuuccagugcaacucgaaccuuacuuauuggaaauugagaagcuuuuuauaggaacuauauauaaauaucauaguaagaacaagaaaauaugaagugaagacuuuaugugcauagaacagaauuuggaugagcaguuaagccugaguucugagugaacuucuaggcuuugcuuauuaguuuucuguugagguauuuuguuuuguuuuuuggggauguuugucuuuuugggguuuuuuuguuuguuuugaggggugcaguuugggaaugggaagaaguacauaggcagcagugguccuucuccuggaaccagaagaacaauaagacuuuccuguugaaaugaucugccucuuuguauuuucugccauggauaaccauugcagggagagacguugcugaaacgaguaugaggcaauuuccccauuuggaacccugcuggguauuagugaggcaggcaggcaggacccaucaaggaaaaguaagugaccauuggagcaaaaauauaugcuaauuuuccaaucagugagcuguuaaccuucugggauuuauaauuccucugacauccauuuuaacauuugaucuauccaguuaauuuuaaaaacccauuuauuauaccccuuaagucauuuuuuguuauauugucaaagugucacauucuaauuaucuuaaaaucacuuuuggccaaagcuuguaaaauaaaaaaaaaagcauuaugucugagauuacugaucaauguaauuuuaagguuuuugcuucuuaauaauuaaacgccacugcauuaugcagcauaccugcugccaggauguuguuugagaaugaagcaaaugaauaucuaaucccauaauaguuuucaaauauuuuaaaucuuuuucucucuguaaccagaauuuuaaagcaaccuaaagauuguaauguuuguuaauagacucuugugauuuuugccacaacuauuacaguacuagucucccugguucucuacuacuuccaggugaauuuuuugaaagcccagcucuacagcucaguggcugcuuaucacaacacuggauaaaauucaaacuccaucagcuuagugcuuaagacccucuagaguccgucucuaaccuuauuuauucuacuccugguuuaugcauacuugcuguuagcacacuacuuucucauugcgcccccuaauucaucaaguuuagaaaguugaaagcauuauauugucuccuauagugcaucuugcuguccauuuucauacugauacuuaggacacagguggaaaauauauguuuuguauuagacuaguuucuuugcuucugaguccaucucauauccucucugccagauccuuuggguauuaaaaagucuuaggguauuaaaaaagauuacuugacuucuuguugacaaaguaggcaccagcuaggcuaguuuaccuuuauuaacauugaauauuggaccuaaaugaaaccuacuaggaauauuuuacuuucacaggguuucauauuauugaauuuuaguuuaaaacauuuuuauuauuacugauuuuuugccaguaugaaagacaaaauguuaucugggaguuuuaauuuguaacuuucugauuacaacugaacauauguaauaguuuauuggcaaucuguguuucuuucauaaacugauagcuuuaacucacuuaucuuuuugguagucuuuuuuuaguucauucuuuuuauauucugaauauuaaucaguugucucuaguacaugucacaaguaccuuucuuccugucugucuuaaaaauucguguuuuucuuuuaaugucuagaugcuuccuaaucuuuguggcuucaaaaucuggcaaaugucuuggcugcauguggucuugauacaggguugcagguccuuuccaaaguagacguugucuccuaaguaccaggaggccauaggagauuuuucgucuuugugacccaacuccccagguuuguauaucaccccagcacucagcagauguccucuggagacauuucucuugccuaugcagguauaauucucagcccuaaaucugcaacugcaggcuuaauuuccaaaacaaauuacacaggaaaccuauaagaaagaaaauggcuagugaucuuugcuuaccuuaggaaugguucuuccuuuccuggaaugucaguuccuuuagucuucauuguuuucaugauuucugguaucuuaaaaauaugauacaaaguuuuuucuaguuguugcaguaggaccaacacauuuuugcuucccacuacacccugcuugaaaauggaaauccauuuguagauucccuuuuggauuuucugugaacucaauaaaaacaccugcaaguaaugacauuucuuccuuuacagucuuuuauuauuauuauuauuuugaccaagaacuccaaaucaguauuauauagaagugauagcaggcaucuuuuuucuuuuuugaucucagcaugaaagcuguuaguauaucaccauuucaguuguuuguuauaucagcuuuuaguauaucacaagucaguuguuuauuuaaauauccuuuuuuucaauuaaggaaguucucuuccuaguuugcuaagaguguuuaagcaugaaugaauauagauuuuuaucaaauguuuuucugcuuuugagagauaacaaaauuugucucuuucauucugucaguguugugauguacauuaauugguuuucaaauauuuaucuaaacugaagugcuagacuaaauccagcuuuauugugauguauuauccuuuguauguagugcuaaguuuguuaauauuucuauucaaguuuugcaucuauauucuugaguaagauuaacaaauacuuuuuuuuucucauaauuuucuugucaggauucccgugaagauuacguugaccucaaaaacuaguugggaaguguucccuguuuuuguauucucuggaauaguuuguguaaaauugccauuauuggcuccuuaaauguuugguagaauuuacuggugaagaugugugggaauggaguuuucuuuguggaaaggcuuugaauuagauuuggguucuuuaauaauuguaggauuauuuuuugagauggggucuuucuauguuucccagucuagucuugaacuccugggcucgagcaaaccuccugccucaaucuuaccauagccggggcuaugggcaugugucacuguaccuggcaauaauuuuaggaccauuuauaucuucuguuucuucuagugucaguuuugauuaguuauauuuucaugggaauuaugugaaucaucaaacuuauuggaauuaacuuacugauaauagcuaucaguggaaggagcuuagaaguauauuuuuugaaagagaacaacaugaggucauaccaguacuuccaauucaaauuauaggguuuuuacuuaauuacucaguuuuauauauguuuuccuuaugcugaaaaucuugauucuuaauggcauuagcaugauuacucaugugcuuuaucuguaauauauguguauguauuuaauuucaaaauaacaaugacaguauuaaauuguuuuaaaauuucauuuuguuuuaauguuaaacauuuccaugguuccaaagucaaaacuauaaaaccaaaguauagucagggaauucaucccugaccucuccauuuucucccauugguguuuuuuuuuuguggguagaggagagacaacuauauaagcaaacauauauagacauguaaauaugugugcauguauauacauauguauuuauauuucuuccccaaguuucuucucccuauuucuuacacaaaauauuugaccuguacacacucuucugcaccuggcuuuuuuuuuuuuuuaacuugucuugaagauugcuccuuagcagcaaacagagaucuuuuuuauuucuuuauauuacagccuaguacuucauuauauggguaccauacuuuauucagccagucuccuauugauggacauuuagagaaauaguaacuuuguuguuguuguuguuguuguuguuguuguuguuguuguugagucaggguuucacucugucacccagucuggagugcacuggcacgaucuugguucacugcagccuccuccucccagguucaagagauucucgugccucagccaccagauagcugggauuacaggcaugugccaccaugccugguuaauuuuuguauuuuuaguagagacaaggucuugccauguuggccaggcuggucucaaacuccugaccucaagugauccacccgccucauucucccaaacuucugggauuacaggcaugagccccugggccuggccaaaauaguaacuuuuaaaaaggcauuuuccauucucaagacuacaacacuguaguguaggccauuagaacuauuugaucuaauuuuuuaaaacuuuuuguuuauacaucaugcaaaaauucauuuuauggcuaggcacaguggcucacaacuguaaucccagcuuugggaggcugaggcgggaggauugcuugagcucaggaguucaagacugaccugggcaacauagugagaccucaucucuacaaaaaauaauuaaaaauuaaaaaaauuuaagauuagccaggcaugguggcacacaccuguugucccagcuacucuggaggcugaagugggagaauugcuuacgucuaggaaguuaaggccguggugagcugugaucgugccacuguacuccagccugggugacagagcaagacccugucuucaaaaaaaaaaaaaagaaaucaaaguuucuuauuuuuuuuuuuuuuaugauuucucagguuauuuaucauuguaaguaggauaagcucaagucuuuguggcuugugcuuuauuacaggugucucuauuuuauuuaaaagccuucuacuuguuuaugguaccacucucucauuucucaauuuguaguaccaauuuaaucucauuaaauccuugcucagguaauaggacccaucaucuuuauagcaccccaaagacauagucucuccuuguaauuuaucagguugaaaagggacauauaguugauauguaucuauuaugcaucugcuucaaggaaguaccagcuccuaaagcagacagauuauugucuauguuaauuauguauaaauuaaaaugucuucagauuucugugauuugaugaauaaagcauucuucucaaucucaguaugaccaguuguucccguuguuuauucauauuugucuucuguuuaaagaauuuuaguaaucaugauuucuacuuuauaaauccacauggaauuugccaaagugcuauauaaucuuaguuacuucguuugccaaaguguuauauaaucuuuuccuccagccccccuucugagagcucauauuccauuuuaaccucuaauauauuuuuaguauuuuugauugccuaugcuagagagaauaaaguacaaccuugacuaaacaaaauauuguaaguacuuuugccucuuccuggaccaugcaaagacuuuagaauauuuaacauaacuuaccuccccuccccagcuuauaugcugcugucagguauuuuaaugucugucgaaccccauaaggcauuauugcuguuuuuuguagucauuauucaugugccaugcuuacuguggcgucuguuguauuauuuaauuugauacuuaagacaaucuuaugugguagaaaugauuauccuuauauaauagaugagaacuaaggcauggagaguuuaugcaguuuaccaguucacauggccaguaagucgcaaauuaggauuuaaacccaguccagaaccuggucucuuaaauaauguaaacucaaguccugauuauuauuauuuuuuucucucucacugaaaaacaaugacuugaaccaaaaaguucucacuaagcaauuguaagauuuuugaccauuaggcaaacaggcuugcccugacuacauaugaggguaaauaauuuuuuuucauucuuuuagcugacauagcccagagauacaggauaagcaaauacccaacccucaaauuguuucguaaugggaugaugaugaagagagaauacaggggucagcgaucagugaaagcauuggcagauuacaucaggcaacaaaaaagugaccccauucaagaaauucgggacuuagcagaaaucaccacucuugauguaaguuguaacuuuugcuagauuaaacaaacauucccugauuaauguaaacaaauucuaaugcaaacaaaaaaucuggacauucuccuauagucuauugcaguggauuugacauacguauacuuaaugaguugaauuuuuuugaauuaaucucaaggcaaaugcuuauguuauacugaacuucuggauaaaagauauagcaugcaguaaagcuguacuaauuugaauuaauugagcacaaaggaaagccucaauuauaaagaaauggaaguuaaaagucaaguauauacaaccagagcuucuguauuuuucuuguggagagcuucagggugucugcucuaauuacuuuuguaugagcucuuuuuaugaguuuuaauguccucuuaaauagccucuucuuaauaauaaguuuagcacaccccuuucuuuguacacuagguaguguuuuaaagauaacaaacaacaaaagcaaaaacaauugaguuugggcuuuaucacaaucaccaaucaucacugucagguuugagauuugacuuuacccuacuugcaagcuaagcuaaccaauuaccauuucauggauucuuuuagaagacacaagacugcugggucagagacaaaggacuuuauugcucacaucacagcaaguagugugagcauguuugcauuuguuuccuugcccuccaaauccuauggaggcaauacagagggcuccccagauggauaccugcacaugcacuggguuaugucacaggaaagggacacugggcuuggggaacucacuauuucagagcaagcaguaacccugcuauuuguccuggcuagaggcauuaccucguauuuccguguugcucgcuacaagcacaacucugagaaauggccuggauaaaggauagucagggucuugcauuuuuugguguacccaguaagauggguaggagugugagagagccauggaggagucucuccaacagucacaaguuaugauugauacauuguuuuaacacauuuuagaauuaguccccuuacuuaggaaaagauugucacugaucaaauaguuaucuauuucuuaagaauuuugaacgcuggaaggaaauguuuaugauuguauuuauuauaguuaagauuguuuucaacccaauguaaucuuuaacaguuuuggacuagguguuaaaaacuaaauaugcauuuauagucauacuucauuugaacaaugacuggacuuguuuagguacuaagauaacggguaaaugaaauaacauguuuauaaaacuauguauguuugcaaaauaauugcauacuuuauuuuacagcgcagcaaaagaaauaucauuggauauuuugagcaaaaggacucggacaacuauagaguuuuugaacgaguagcgaauauuuugcaugaugacugugccuuucuuucugcauuuggguaaguaucuuauuuaaaaguguguuaguggguugguuggcugccauguuaaauugcuguuguauuuggucauuuccugaagaugaucuuuccaaaaaugaucucaauccuuuuaaaaucacuaaacagucuuuauaccugucucugaauucuuuuuaagguuuuaaaagucuguuuuucuuucuguaguauuaucuauuucagaaugugggcaagagggaaaaaauggacaaguuaacaauuaacuaauucaugcuuuuauucaacucauuuacuaacucuuacccuaugucagacaaaaugcuaaucugugggguaaccacagugaaacaacacacugucuuucuuguuaagaagcaugaguuuuaucgucuucauucaucuccaucucuccaccaccuuuuuuuauagaucuucccugucucaggggaacaauucuuucuaaggcuaaccucuucacugauguccuuguaacugguguccuucaaacuccucuggggcuuugauccaucaguuguuccugcuuguguuuucaaccugacccuuuucaagaacugcuuuccuuuucugaaaacacgcuucuuucuuuccugaccugccucuucucuuaagcuauaauuucaccuuucuuuuucuuuuuauuuuuuucaaagauuaguuuaugccuggcuaccuugauuuucuuaaauucuaaccaguaaaaaacuuaaccuuuuggaagcuaacuuucaccuccauugcucuaaugaaacuugucucuacacagucacaaaaugacuucuuaauuaccaaaucgaguggccuuuuaaacaucuuacuccuuuucaauuccucugaagggugugauguucaacuaccuuuuucuuuuuuugcugugucaacacuuacauugaaucccccugguuugcucccuaccugucugaauucugugacuuuaucucccuuuuuuuuuucuuuuucucaagauggaaucauuuuugugguucuguucuugacccucucuccucauuggagguuaucucaaccauccuuugacuuccaugcaguauuauuucucuuuucauuggcucaugacuauuaggcuuaacuguaguagcuaucuugaauggagccuggaugucuggcacaauauauccucuccauuuuuugaccuuuauuguuuguccuugcuuuaaugcuuuugugagauuuuguuuguauguuuuauugugcgcauuaucaguuuuuuguuuuuuaagcgauugaggucucaccauguugcccaggauggucuugaacuccuggccucaagugauccucccacgucugccuccaaaagugcugggauuauaggcaugagccacagugcccaacccauauucauuaaaugcugcaagcacaguccugcagcagagccugaaucuggaagugcuucucccagaugucaucucaucagaaaguccuugccugauaacuuuauuuaaaguagcacuaccauuauuuaauuugucauucuuuacuuauuccacuuauuuucuucauagcauuuuuuuguaaccaccaaagauaaauauaucuacuuguuagucugucucuacucaccaaaauguaaacuccaugagagagagaguuuugauaguuuuguucacucccguuuauccaaugccaagaccauagcugguacaaaggaagcacauaguaaauaguuauugaauuaauuaauuaauggaacacauuuuuuucuguucccacgguuaucaaucuagguuagcaccccuugccucuaucuccuggacuacucuaguuagaaacuagagauaaaucaguguucaauuaaucuaaaaauugauuacaaaaauaauuuguuguaguacucuacaaauguuuauuaagcaacuucugugugccagauacuguacuagguucaggaaacaacaauggacaaauaaacaaaaaauuacuuauuuauggaacuauauuuuagugauguggguuauuucguuuuuguuuuuuuuuaauuaguccaugugaccaaaccaaugaccuugaucccuaguugccggaaaacagucuggggucaaaaacaaccuuuuagugcuaaaacucccaaucuaaacuuacacaaaacacaaaaacaacuaacuaaaauuuuccuuuaaaaagucugccucauauuaaacguuuucuuuaaauguauacuuuucuugguauugcauagucuuguaauagggaagaugauggauaaguauauauuucaagucuguaauuccuacauugcaaaauucugucauucagguuuauuacuauuucucccuuccuauagggauguuucaaaaccggaaagauauaguggcgacaacauaaucuacaaaccaccagggguaaguugcuauuucuuaauguuguaugauaagauauaauuuaaauacaugcguaagauguaguuuuauauguguuaauguucauagacuaauagaacuuuagaauugaaaggaaguuugaagcaucaucuugugcugaucuaaacccuucaaaaugaaggugggaccacagaagccuaaagucacacaggcauuagaguagcagagcuggcauuagaguagcagagcuggcauuagaguagcagagcuggcauuagggaucuccugacucucaggccuuuucuaucucucuggcauucagucugggagccagauuuuuaaaaugcuccaguugucugugauugucacuucuacccguauuguacuagccaaacucccaaaucuucugggguauaaauuuacuugguaccugccagauaauaaggagcagcuagguuguuuuuaaccugugggguaagaaguuuuaaguagcugcuuaggcccuaccaggugaugguagccauaacuaagaggcaaaaaucguagcacauguuaucccaaauucaccaagcgucugccauugcaauuuuuuuuacauaccaaaaaaaauugaaauuuauggauauuuuuucaauuuauaguuuucauuuuaauguuguuuacaguguuuugacacugagauuuuuaauuuuuaugcagucagauaaaugaauuucuugcuuagaaaguucauauucuauuuugaauucacauagguguuugcuuauauuuuuugcaaguacauuucuuugaguagcuuacuuaguaucaucaucucuagauuaucagaauccaguaccuaucucucagugguagugugguuguucagagcaugggcucuggugguaucagacuggguuugaaugucaaaugugccaccuucuuaguauguuacucugggaaaguuucuucgcuuccccgcgcuucaguuucuuaauuaguaaaaacgggaugauaaaaacaguacuugcuuuauugggauguugggaagauuaaaugaaucaacacauauaaaauguucacaaccaugccuagacccaguaaguuuacugauuaauauuagcuauuauuuuuaucaucauuuuagacacuucauagauaauugauuuugaguuaauguagaaacagauauguagguaauaaaagaaauagucgugccuuacauccauauagcaucuuguauguuucaaggcuuuuucacuauccacauuuucuucuaaaagaagaaauuucuaaaauuuucagcucuuaggaauagcuaaauuaauucauuuggagaauucuuuucacaaugccuuccugccuuuggugaagauacugauaaagaguuaauugaccuaaauccaagaaaaagcaauaggcuugggugucacagguuagauuauuagcucccugguaaucacagaauuaucugcuuuuugccacccauggcccucuuucuuggaaguuccaugaucuauguuucuuuuguauuaccaguagauuuucuggguucauggauggauauaagaauguacuuuuuagccugggcaacauaacaagaccccaucucugcauaaaauaaaauaauuagcuuggcgugguggcauguaccuguagucccagcuacucuggaggcugagguaagagaauugcuugagcccaggaggucaaggcugcagugagccaugaucaugucacuguacuccagccugggugacagagugagaccuugcuuuaaaaaauauaaagaaaaaaaauaagaauauacuuuugccagcacagguuagauuuaauuuuuuuuuucuguuuuguaauagcauucugcuccggauaugguguacuugggagcuaugacaaauuuugaugugacuuacaauuggauucaagauaaauguguuccucuuguccgagaaauaacauuugaaaauggagagguaugggcuuucuacugugcauuguuacuuuaaauucaaaugucugaaaccacaagcuuccuccaccugucuuacuauguuaacagaguuaugaauuguaagaaucauauagugaacauaacuauaucauagcuguuucuguaauauacaccagugauucuucaccuuugcuaucccagaaccccucuguuacauuuccaguaauaguaguaguucacuacagccuucaaaaugaguuugaaaaugccuuucaggugauucugauacccaucuguugguugaggaucccuguuuagguggauguccuuuagaacaaggguccccauacccugggccgcagaccuguaucaguccacggccugcuaggaagagggcugcccagcgagagagcauuacggccugagcucugccuccugucagaucaguggcagcauuagauugucauacgaaugugaacccuguugugaacugugcaugugagggaucuagggugcauucuccuuaugagaaucuaacuaaugccugaugaucugagguggaacaguuucaucccgaaaucauaucccccacccugaucaguggaaaaauugucuuccaugaaaccagucccuggugccaaaaaggugggggacugcugcuuuaggagcaaugcuuugcagauuuuaguuacaauuauuucuauacaaugaauaauccuuugccacuagaagauuuuucuguuuuuuguaaagcaguuaauguugucuuuuccauuauaaauaaugaaagcagguagcagugauagguaaccgaccucagucaucccaugcaucugaaaucaagcccaucgaaauucuuacaacucccaccaaaauaaaacuuaaaaaccuaagaggcuggaggaacaaguacaaagaguuaugucuguaaggaccucucuccuuucuuuacuuuauguaagacauaucuuucauuccaggucuuuuguuuuuaaaaccaauggccuaagaaugcaaguuuuuaaaaacuuuguauuagguacaguuuuuaaaaacuuuguguaugcauauacacuucaaagaauuguaaguguauaaaucacaguuuaaauaucuggucccccaaaauuaucacagaguaaacauacccauauaaucacuacuuagagugguauggaccaaauauuuguguguccuaauauucauauguugaaauccuaauccccaaugugacaguauuagggaaugaauccuccauucaugagauggaguccucaugaaugggauuagugaacucauaaaagagaccucagagaguuauguagcucucuuucugccaugugaggauacaaugagaaguaggcagucugcagccuagaagacagcucucacuagaacugaccaugcuggcacccugauuuuggauuuccagccuccagaaugaugagaaaugaauuucuguuaauuuguaagccacccaguuuaugguacuuuaauauagcagcccaaacuaagagagaggguggacaauuuuuuucaacaaagggucagauaguaaguauguuagccuuugcaguucauauaaucucuguggcagcuacucagcuuugcaguuguagcacaaaaguaaccuuagacaauauguaaacaaaugagcguggcuguguuucaauaaagcucuuucuggacaaauaauuuucacaugcugugaaauauuaaauuuuuuucccaauuauuuaaaaauguaaagaccagggccuugugccauggcucacgccuguaaucccagcacuuugggaggccaaggugggugggucaccugaggucgggaguucgagaccagccuggcuaacuaacauggugaaacccccgucucuacuaaaaaugcaaaauuagccaggcgugguggcaggcgccuguaaucccagcuacucgggaggcugaggcaggagaaucacuugaauccaggaggcagagguugcagugagccaggauccaccacugcacuccagccugggcgacagagugagaccccgucccuccaaaaaagaaaaacaaaaaacaaaaaacaacuaaagaccaauuuuagcuuguggaccuaacagaaucaggcagcaagucagauuugacccauggcuauaauuugccaaucccugagcuaagucaagaaauaaaguauuuccaaaccccuugucuuccuucucaguuauuacccccacuuaccaucuucauaaucaccauacuuauuuucaauaggacuauaggaagcuuuuccuguuuuugaaccuaaaauggaaucaugucuuuugugucuggcuucuuucacucaacuuuauauuuauggaguucauucauauugcaugaagcuguaguucauucauuuucaugcugaauauaauucccuauauaaauauaacacaauauauccauucuacuauugguggacauuuagacugcuuccagauuuugacuaccgugaauaaugcugcuaugaacauucuuuaucuaugucuuuggugaauauaugcacagauuucuacuggauauauauaccuaugaauagaauugcugagucauagggcauauauacauucaauuuuaguggauaccaguuuuuccaaagugguuuuagcaguuuacauuccuaccaguaguauaucaaaguucacauugcuccacguccuuacccacauuugauaccagcuauuuacauuuuuaaucuauuuugguguauguguaguagagucucauugugguuuuaauuuauauuucccugaugaucagugggauugagcacuaucaguugccuuuuccggaaagacagauggucguagaagaaaagcagcuuaaaaugccaugcuuaauguucuggguuuccuucuauuccagucuuggcccauaauucuuuuuuuuuuuuuuucacucuuagaugcuuucaaaaaguguuuuauuauuauuauuauuauuacucugguuuuucuaauuuucccaguaguaagauuaguccagauuacauccauuauuacuccagaaugcaauuuuuagcacuauagcuuaaccuaauuguaauacaacaaaaccuggaguucuuaagaaagaguauaauuucagauuugaugucuucuguuacuaagguguauguauauuguuaagugcuuucagauuuggagauaauauaugugaauucuccaagauucccugaaucuuuccagaggcuuccagcucuuagaucuuacuaucucuuucucccuuucuuggggaagagagagcaacacuuaacuuuugggacugaccauugugagcaaaccagaaugcucuuugcccccucuuugucuugagaaugcauucuugggguauuuuugaucugcguccauugccauuuccaacacuuagacugggauauauaaggcaaaaagaaaacccaaggaacugaguacuauuucuuggauccuuaaguccuuagccagucugcuuucuuuuauuugcuucucagggccuuauguuuguuuauauaauguccaggauuuuuagcugaacuuccugggagaaauagagaaaagugucuacuucaucuuucuggaagcagaagucuaugccaacagcauuuaaaaacucuuuaaaagacuuuuuuuuaccugauuuaaacguugccuuugcauuuuaguacauaaaaauaaguuaguauuuuuaugucagcaugguacauuuuugguauaccuuuuccaccauaaaauaauauuuaauucuuauuaagcuuguagcaauuucaaaucaaauguaugaauguuuguaugagauucucugggugugucugcuuggacagaucauugcaaaccuaaaucaucuuacauuggcucuuugcugaguguuucauagaaagaggauuagugcugccaggauccaguuuaacaugucagaauaccccacugggacauccuacuuguuuauaauagcuauuucucaaaucaagguucuaaaaauggcuucucaugaaaugugauuaauauauuuuuaagccugcaagcuuaaauaucauaaacuuaucaggcucuauugcacuagauaugcaauagauauugcaauagauaugcaaauucauugcauaucuuaaugcaaugccauauuuuaaaauauuuuggaauuuugaauuauagaagacuuuugagugaaaauucuaacacaagccuuuucuuggaaagucucuuuuuuuugguuugaagaaguugcuuuaccaaauuuucuaguuucuuuuguuccugagauucuuugguucuacuuccuuuuccccaguuuuuuagaauuucggggaguauuucuaauuugaaaaucugaaaugcuccaaaauccaaaauuuuuugagcaccuacaugacacucuuggagcauuucagaguuuuagauuagggaugcugcagcgguaagaauaaugcaaauauuucaaaauccaaaacacuucugaucccaagcauuuugaauaagagauacucaaccuuuauuucuauaugacagcuuggcauuuuaaguccauucuuagugaccagaguauuuuuuuauucaguaauguucuguugcuuuuuucaguguuauuuuugaaccugcuucucaaaguaguauuucccuggauucugaguaauucauauuguuaagaugcaucuugagucauuguaguuguuuuauauguaguuuuuugagaugguuugaauaaauaugcucagauugggugucuuucuaucuuuaauuaugugucauuaccccccaugacacacuggaugcucagguacaggaguucaaauguuuggaccaaauaguggcuuucaaaccauuuuucauuguaaggcaaaguaagacauuuucacuaguauauacauaauucucauuuuucauugaauaauacccuucuaugugcacugcacucaauuuuauauucucuucuuuucuuuuuaauacuggauauauagauuggacauagcaugcauaaucuugucuugccuccaucucuuuccuaucauuaauagcauuuuaagguagauaagacauuucacagaauucaaaauacugcuccuacaauuugaguguuuggccacaaggugucaguggugugucauaguuuuauaguaccagaagccuagaagagauugggauuuaagcucccucugcuuuuuaaugcacauucauacuuauguuuuuuuuuaacuuagaauuuauuaauagaauaguuaaguacaagcaauuguaaagcagaccguuugaaguccuuuauaucaaacuuuaaggaaguaaacauuuaaaaaauauuucuuuauauuugaauuguuagucuuuuccauuuugaucuuaaacuugguuuugaaagagaggguggauuagacuuuuucugcuaacaguuuauaaaaaugaauguccuggcuuucuuuuuuuugcuuuucucuuuuuuuuuuuuuuugagauggaguuucgcucuugucgcucaggcuggagugcaauggugcgaucucggcucacuguaaccucugccccccagguucaagggauucuccugccucagccuccugaguagcugggauuacaggcgcccaccaccacgcccaacuaauauuuguaauuuuaguagagacaagguuucaccauguuggucaaucuggucucgaacucugaccucaggugauccacccgccucagacucccaaagugcugggauuacaggugugagccaccgugcccagccugucccugguuuucuuacuucuguaggccucagguauguuuaguuggauuacuuacaauuuuuaaaaaaauuugcauucacucauuuaguccucagaggcccaggaaaauuuaagaauuugucaugacuauuugccugcugugguaguucuugcagggguaguuuuuaaaaccagauuuaaagguauagaccuggaaaaucuuaaacagugaaacggcaucucccuuccccgugguuguuggcacaucuaauaauucuugagauuuauuauguuguaagcaaccauuuaaccauuuaaccaaccauuaaaucauguaaucuguggggaaggaucuguuuccuguaaaucugguugucuugauauucuucuccuuaaucuuuuaacauuuguuugguaaagaauaugcuuguauggacauaguaaacuuggaagccuaagcagcaugaauuaccaccuauuuagcaacauuuguuuauuuauugauauauguugauugugaggaaaagagaaaugaaauaagauugucuucaagggguuuucaguuuaauauuucauauguacagauaacguaacacaaagucaugccccgugccacaugaggggcacugauaaaaugcucuuggaguuuagaaaaaagaauuuuccauugauaaaaugcucuuggaguuuagaaaaaagaauuuuccuuugacagggauggaguggaaugagagaugacuuuagagaagcggcauuacguccugaaaagaaaagugcuaagagagaagcagaaguacuaaagaaaaugggaaaacaggagaaggagguuagagaggaggggacuaggcauuaguuuugaguauuuaagguacuuguuuagaauuugaaauggagauauuaagcaggcagauggaaaccuaggcuuggauuuuguacuggagcugggcuuguagacacagauaagcgaucaguuagaaguagugaucaaaacuguugaacuacaugaacuugucaggcuagagcagagaaguccaaagacagucauugagaccagcaucaguuaauggaugggggaagaaaaaaugugaguccaagagauaaaagaugaggaagaaaaaaaucagcuuacuaaaagaugaaugugaugccaggggguggggagaggggagaugggaaucacuacuaauggguaugugguuucuuuuugaagugauaaaaaauauucuggggcugggcgcaguggcucaugccuguaaucccagcacuuugggaggccgagggggauggaucaugaggucaggagauugagaccauccuggccaacauggugaaaccccaucuccacuaaauauacaaaaaaauuagcugggcauggugaugugcacuuguugucccagcuacucaggaggcugagacaggagaaucguuugaacacgggaggcagagguuccagugagccaagauugcacuagugcacuccagcuugggcuacagagugagacuccgucucaaaaaaaaagcucuagaauuaguggugauguuugcacaaccuugugaauauaauuaaaaccacaaaauuguacacuuaaaaaugaugggcuggguguguugccucauaccuguaauuccagcacuuugggaggcugaggcaggcagauugcuugagcccaggaguuugggaccaaccugagcaacauggcgaaaucccaucucuacaaaaaauaacaaaaaugagcugggcauggucaugcauguuuguaguccucacuauuugggaggcugaggugagaggaucaccugagccuggggaggucgaggcuguacuccagccugggcgacacagugagacccugucuccaaaaaaacaauggugaaauuuaugguaugcuaauuguaucucaguuuuuuaaaaaaauaaauguaacaagaggcuuaauaauugaucuuauauacaagugaaauaggcuuaaauauggagaugagagccagaagaaaacuuuuaauccuguaaaauaggucccaguuuguuuuuuaaaaaauaaaggacauuuguacuuucuggugagguaguuccuagauuuauggagagauccucaaaaggauaguugaugaaaauaauuuuguuaugagacccuuucuggacuuuuucugaugagucagaacuuagcauuuguuggggagaauaaaugauuaaaucugucuacauaucacauuuuauuuaaucaugucuacccauuguaguauucuccaauuacaacaauaaaaauuuuaauagcacuuuauaauuuucaaggugcuuuucuguguguauaaauaaagagguauauaaaaauauauagggguagguauuuauuaauaauguuaauuguauauugguugagaauuaguuaaauaauggagguuuuguuuuuuacccuggauaaaacacuucaagcuuuggguaaguuuuauauguaaguguaaugguuuuugcaaccuuagaauauaaaaaaauacaaaaaauuuugcaaaucagauuuauuuauugcugauauacuguuuuucacuguuacuugugaagacugaaaauacuagucauguuuaccccacucuaaaauuaacaccuugguaaagaaccagcauaguucaccucuauaugucaugaauucaacagccuaacccugaagucucauaucccauacuggcuaacagacagugggggcagaucaguuucugcagcaaagcagggcauguggguccucugacugucuggguacuugagguggggaggggagugaauucagucuucuguucaggcuaauguuuauucacaccacugggccuuuuuuuucccccgggauauugcaacuauugcauuacauggguuggguucaaaauuguuccuaccuagaaaauagcuacaacugaauggagaagccugauaauucucauugaaugcuucucucuacaggaauugacagaagaaggacugccuuuucucauacucuuucacaugaaagaagauacagaaaguuuagaaauauuccagaaugaaguagcucggcaauuaauaagugaaaaagguagacagauuaagguguuuauuuucaucauuucuuucucucuuuucuuuuuuucccuuucaucaucuccucucccauuucugucaaaucacauaaacauauuuggguuaaaaacuuauuuuaacacauucaaaugugaugguaaggaggcauuaguagagagauaauaugagguaguguuuuuuuguuuguuuguuuucuaaccauuacuauuuuggagagaaaaaucaaagugcaugaaaagcagggucaugaaugagcauuaguucugggcacuugccuucauugcuugugugaccccuuuuccaauggacauucccagagauguugcugagagagcuuacacagucugauuaacauuuauuucuaaaugaaagaaaguugaguaguugucuguggauuucuccaaagcauuuaauggaauuugaggugucaccagcuuuuccucuguaguuagggaagaaagucaaacaaaauaaacuaaagguacucuauagagcugcccauuuuagucacauacuaucuugcagguugaauucgacuaaaaaucaaccaguaugacuggaauaggcuggaaugaaaauggucccaugagaauggcucauauaucaacuugaacuuccugccuagaaccugauaaucugcaaaguaaaugauugcccauuuaaggaaaguaaaaaauucauuauagccuucaaauuugcacuaagucaauaugauuucuaaagaaguuauacucugugcccuaagaacuaaaagccuaccuauuuuaaguguuagauauuuagguuuuaguuuuucugaucuauauuacucuuaagaauguugggugcuuuuuuuuuaguaugucacuuuuugugagcuugcaaucuuacaaaaauauuuucaagaaaauuugaauuuaccucucaaaauucuuuuuucuuaaagguacaauaaacuuuuuacaugccgauugugacaaauuuagacauccucuucugcacauacagaaaacuccagcagauuguccuguaaucgcuauugacagcuuuaggcauauguauguguuuggagacuucaaagauguauugugaguauucauuuuguuuuuuaaaaauuacugauauguuuuucaaaaaugaacugaaaauaguuguuugaauauuuuaaauaauccuauguuggaacaguaagacuuuguuaacuggaugggagagguuugggugacugcugcuuuuuuucacuauagagugugguauaauuaugaacauuaugauauagccuuguagaaauaccaacauuaagugauuagaauugauaaugaaugcuuggaugauuagugauuaaugcuugggaaucaaucucucaaagaaaauuuuugucuugugagaaauuagcucuucauugaguuuggucuuuaccaagcacauugagaaaaauagcuuauaaccuuaggccaggguaaaggaaauugguaauauugcuguucauucgugacuucacauagcaagaacauuaguaguauuuaugaaucuugcuauuacuaggcguuucuaauggcauauagcuaugaacuguuccaagaauagguaagcuuucugacucaauucucagauauuuauaguauuaauauauguacaagccuuguagcuacuacagauacugaauuuuuaucagcuuugugagguguuaaauacagugguuaaaaauguagauguuucuuauacgaaaaguuuaagcaauacagguauucaaguuagacauuuuauuuugaaaauucauuuaaaugccauuuuuaucucaaaagauuaaauuacacagaggaugauuuguaguccuauggcagaaugaauuaccccacugaguucuaaauauuucaguggagaugugguuguuugguagaagauucccaauccuaaaauuaccuaggaagccuagauuugaguccagccuugggaaagucacuuaccuccucuguucuuguuucuucguauauaaaaaaugguuaaugauaccaccuaccuaaugggauuguuauaaaaacuaaugagaaauaaugauuauguuauaaaccauaaaguagugagaaaucuuaguuguucuuacuuuaucuaugcucagaaagauaccauucaagcuaucaauucauuaaauauuuagcuaucucuucuguaugacagacauugugcuaagaaccaaggguuuuuacugagacugggucccugcccucaaagaauucauaaccaaguagaggaaagggacaaccagguuaacaggcaauuguguuuuacuaagggauaagugcucugacagagaucaacagaguaguaccugauccaggauuucuggcgauauugaugccgaagguagguauaaaguuuuguagaaguuuaucccgaggugagaaggagauggggcuuagagaaaggugaccuuggcaagaacaaguucaagggcuguuggugaauauaaauggaaaggugaaugcugagggaugaggucaagagaacuaacacaugaaaguccuuacaugcuguguuaaggaauuuugacuuuauccugaaaaccaugaagagccaaugaaagguuuuaaucagggaaugacauaaucagauuguuuuuuaaagauuacucuggcugcaauuuggaaaauagauuagagggggucaaaauaaaaucuaggagacuguucaguaaucuagucaagaguugauuaugaaaguuaaucucaauggacaucagcaagaugacagaaaaggacuuuccauguucgucuccacacagaaacaucaaguugaacauacauccaugcagaaaaauaccuucacaagagcuaaggaaaccaggucagagauaguaguaccugagaguaguaaagaaaugaugcauugaagaggcuaaaaaggacaguuuuaugcuacuugcaccaccccucccccaaccccaggcagcacaguauggagagagauacccuucauguggggaaaggagaaggaaguuagcacugaacuuuuccucagacccaaacacuuggcuuguccugguaaaacccagugccagaaaggcuucuguggccccagacuccaggcugguacccaugaacugagcauuuagucccauccuggugccaggcaauaucuccaagccccaggcuggauuccaaagcugcaggcccgaggccugcccagcagacucagucucuggaccuauuccagcaccaggccaaacccaguggcuucaggcuccagaccagcugcccacagcccugaucaugaggcuagcacucacagacccaggguucaggcuuauccuaguagacuccagugauggaccagccuccauggacccaaguucuaggacuacacuuguggauccagguuucagacuggccccuaaagccccaggacccaggcuagacuuugcagaccugacccccaggccagcaccugcacacucagccuccaggccaacacaaguggacccaggcucuagccagacuccuaagcucuaggcuuucagccagccucaguggcuucagauaccaggccagcaaccaugauccuacacuccagacaagcugccauagaucgugauuccacaccugccccagcacuaggucagcugcagguuccaaggacccaagaucuagguuugcuccaguagacagagaguccaaguucacccuaguaggcccugguucuaggccagucuccauggacggaagcuccaggacuaucucugcagacccaggcuccaggccagccccuguggacucuugacccaggcccacucccacagacucagccuaucccaguggacccaggcaccaggcucaucccagugccuggcuggccccugcagacucaggcucaaggccuaccccagugccaggucagcucuaguggacccaggcuucagacccacccucuuagaugcaggcccauuccacagaaccagacaacagguccacuccuguggacccaaguuucaggcuuaacuccauggacccaggcaccaagcucacccaccugcugacccaggcaccaggccagccagugugaagacucuuaagagcaagccaaccuauggaccauagcaggcagcuggacuagaaucccugaauugacugacuagugaagggcuuucccagacaaagccagucaaagacuagaauaagucucuacaucuucaaaugcccagacaucaauguaaggcaacaagaaaugaaaaaccaaggagacauaaacguaacaucaccaaaagagcacaauaaucucccagaagcugacccaaagaaauggagauguaugaacugccugacaaagaauucagaauaauuguuuuaaaaaguaacauccaugaacuucaagaaaauacugagaaacaauucaaugaaaucaggaaagcaaguuaccaaaaugagaaguuuaccagagagauugaaauuauauauuucuuaaaaauuaaacaaauucuagagcugaagaacacaaugaaugaaaagaaaauguaauagcaucaccaacagaauugaacaauuagaagaaagaauuuaaaccugaacauacagguuauuugaaaacauacagaagaaaaaaagaaugaagaaaguuuauggaauuaaugggacagcaccaaaagaguaaauauucaaguuauaggaguaaaugaaggagaaaggagaaauaaagggguagaaagcuuauuuaaaauaaaaaaagcuuugcaaaucugaggaaagguauaaguaucuagguacaggaaagucaaagaacuccaaucagauuuaguccaaagacuacgccaacacauaaacuguugaaaaucagggacacagggaagauucugaaagcagcaagagaagauuaugaaagcagcaagagaagauuaugaaagcagcaagagaagauucugaaagcagcaagagaagagcaaauaacauauaaaggggaguuccaguacagcuagcagcaguuuucucaucagaauccuuauagaccaggagagagugggaugauauguucaaagucuuuaaggaagaaaacugccaaccagcaauauuauauuaauaccuggcaaagcuguccuucagaaaugagagcuaaagacuuucccagaugaacaaaagcugagggaguucauuaccaucagaccugucuuaaaaagaaugcuaaaagggaguucuucaggcugaaagaaaaggacaguaaguacuaacaugaaaacgugaaaguauaaaacucacuggugaaaguaaguauacagucaaauucagaauacucuaauucuguaauggugguauauaaaucacuuauagcuuugguaugaaggauaaaagacagaacuauuaaaauaauaauagcuacaauaauuuuagggauacacaauauaaaaagauguaaauuaugacaccagaaauuuaaaaugugaggaggguagaguaaaaguguaguuuuuuuuuuuaugugaauaaaguuuuuaucagcuuaaaauagccuguuaugagcauaggacauagugaagaaauguacaaaauaaaauaaaaauuuuaaaaacccuauuauaauuauauuuuacguaaaucucaugguaaccacaaagcaaaaaacuuuaguaaauacacgaaagauaaaaauuaaggaauaaagccuaccacuagagaaaaucaccuaaucacaaaggaagacaagaagagaggaagaaagcaacaaaggaucuacaaaacaaccagugaacaauuaacaaaauggcaguagucuuuacccaucaauaauuaauuugaauguaaaugucuuaaauucuccagucaaaagacagagacuggcugaauggauaaaaagccaauacccaacuauaaacugccuacaagagauucgcuucaccuauaagggacacagguagacuaaaagugaagggagguaaacagauauucgggacauauggaaaccaaaagagggcaggguagcuauaauuauauaacauuuaagucaaaaacuguaaagcaaggucauuauguaaauauaaagagaucaauucagcaagaggauauaauaauuacaaauauaucugcaugcaacauuggaacaccaaaauauauaaagaaaauauuaauagaucugaaaggagacuauaauacaguaauaguaggggacuucaauacccuacuuuuucagcaagggccacaucauccagacagaaaaauagggaaauuuuggacuuaaauaguuuuagcucaaagggaccuaacauacuuauauagaacauucuauucaacugaagcaagauacacauucuucucaagugcccauggaacauucuucaggauagaucauauguuaggccacaaacaagucuuaccaaauuuaagaagauuaaaauuguaucaaauaucuuuucugaccacaaugguaugaagcuagaaaucaauaacugggaguaaauuggaaaauucacaaauaccuagaaaucaaacauguuacugaacaaccaguggagcaaagaagaauuuaaaagggaaauuuuaaauuaucuuuuaaaaaauggaaauggaaauacaacauaccaaacaaaacuuaugggaagcagcaaaaauaguuuuaggaaggaaguuuuauagcaagaaacaccuacaucagaaaacaagaaagaucucaaccuaacauuacaucucaaggaacuagaaaaagaacaaaccaagcccaaauuuaguagaaggaagaaaauaauaaagaucagaagaaauaaaugaaauugagauuagaaaaacaauagaaaagagcaacaaaacuauagcugguuuuuuaaaaagauaaaauuuuaaaacuuuuagcuagaauuaaagagagaagucucaaaaaauaagaaaugaaagaggagacauuacaacugauacuacagaaauacaaaagaauaagaggcuacuaugaauaauuaugucaacaaauuaauaauguagaagaaaauacuaggcacauacaaucuaccaagguggaaucaugaaacagaaaaucuaaacagaccaauagcaaccaauaacaaauaagagauugaaucaguaaugaaaagucuaccaucaaagaaaagcccaggaccugaugaccauucuuucuaaaacuaccaaaaaauugaagaagggagaaaguuuuuuuuuuuuuuuuuuugauacaggaucuugcuuuaucacucaggcuggcgugcaguggagcaaucauaacucacugcagccucaaauuccugggcucaaguaaucccaccucaagccucccgaguaggugggacuacaggcaugugccaccaugcccaccuaauuuuuuuuuuacuuuuuauagagauggauucuugcuguuuuccaggcugguuucaagcuccuggccuggccugaagugauccucccacuuacggccuuccaaagcacugggauuagagacaugagccacugcaccggccugggagaacacucuuaaacacauucaaagucagacuaggacacuacaagaaaagaaaauuacaggguaauauccuugauaaacauagaugcaaaaguccucaacaaaauccuagcaaacuagagacccugguuauggucaauugauuuuugacgauggugcaaaaaaggugcacuuuucccagcaccaaaaagagagagaaaagagagucucuucaauaaauggugcuggaaaaagcggggggaaacuggauaucuacaugcagaagaaugaaauuagacccucaucucgccccguauacaaauaucaucucaaaauagauuaaagacauuaacauaagaucugaaauuuuaagaguacugaagaaaacagggaaagcuucaugacauuagugugggccacaaauuuuuggauaugaccccaaaagcacaggcaauaaaagcaaaaauagaaaaauuggauuacgucaaacuaaaaaguuucugcacagugaaggaaaucuacaaagugaaaaaaacaaccuacagaaugggaaaaaggauuugcaaaccauacaucugaugagggguuaauacuuaaaauauauaaagaauccaaacaaaucaauaguaagaaaacaaccugauugaaaauggguaaggcaucugaauaaacauuucucaaaauaagacacacaagcggccaauagguauaugaaaaagugcucaacaucacuaaucaucaaagauauuagaauggugucuuugacaacccauggagugggagaaaaucuucacaaucuauacgucugacaaaggacuaacauccagaaucgacaaugaacuuaaaucaguaagaaaaaaacaaauaaucucaucaaaaagugggcuaaggacaugaauagacaguucucaaaagauacacaaauggccaacaaacauaugaaaaaaugaucaacaucgagaggacggccuugagcggagggggaggggcgggggacagggucggggggcggagcccuggccucccagcgcgguacacugugccucaggugcgccguguccacgccccgccgcugugggaacggccgugcgcucccugcaggcggucauccgccuccugccccgggccucaccaaggagcagcugcgcccgcugcccacgcacgacuacuuccaguucuuugccgccgaccugagauccagaauauaaaaacuuuuuagaaaccuacuguguggaggaagagaagaccagugccaacccugagacugcugggggagauggaggcgaagacaagagagcucauugcuagaagaacuacaccuauuuuggaauauauuaaaaauagaaaauuagaaaagcagagaauucgagaagagaagcgagaagaacggaggaggagagagaaaagaaacguuugcgggaagaggaaaaaagaaaagagaugcaaaaaaugagauaaaccgaagaaaauugcagagaaguaaggauuaaggucacacagcagcagugacaaagagcacagggauguggagagaucucaagaaaaagaaucugaagcacaaagacagcauguggaugacggcaggaggcacagagcucaccacgagccugacuggcuuuccagaaggcgugaagauuagcagagaugggggagccgggacagcggggcuccgagggaggccguggagagaccaggaagagugcagaggugugaugacgguccggcacccagaaaggagugacuggcaaacgaggaccggccggccuugcagcuguaugauccgggagcucgcguguggcggaagcgggaggaacugcaaggcaaaagguucggggacagauccugagaacagggaagaggcagaaugagucacugcgugcaccagcccuccguggacgagcgaggguaucccagaaauguguaaaugaccccgagugugacugggaaggagaacuuacuccuuaccaggaaacuggaagcuaaaaauacagagggugacauagaaacacacagaaaccauucuaaagaaaguagugaucaugucuuaaauuaagcagaauucucacggauuuuaaccauuccuguuauacacuaguauuuguuguuuagccaaaacagaaaaugacuuccauuggacaguagaaaaauguguguaaaauagggaagaaaguuaguauuggaucagugcaaguccugaagcacuuucagugcugugagaacgacacccacuuuggguuucauucuuuuguaagcagaggagcugucagucgcuugugcuucucgguggccucugagcuguggugucgaguaaagagcaguucuuguuuguuacaaccuuugugagucagccaugccugcaaagugugcuguguuuuaguccugguaggaauauauaucaacaguucacacuguauaaaacccaauagcuucaacuauugcccuuucaacaguuuugccacugaccggaugaaaaugguuucacagucuuuggauggaugcauuugugguuuguaaccauuacgguuuaaaccaugguuuaaggauuugcccaaauaacagaaauuuuguucgggaagggauaaauuugguaaagcauauagagccugccuuugcguuuuagacacuuuauuuguaaauaacuuaaaauagcuuucugaaacugugcauucuacaguuuuuuccuuucagugaaauuguuaaauguuaauguauuuuuggcacugcgauuuuaaccauuuauuaaauaaaaauuuuguuaaaaaaaugcuaaacaucacuaaugaucaucagggaaaugcaaauaaaaacuacaaugcaauaccaccuuauuucugcaagaauggccauaauaaaaaaauuuuaaaaaguagauguuggcguggauguggugaucaggcaacacugcuggugggaauguagacuaguacagccgcuguggaaaacaguguggagauuccuuuaagaacugaaaguagaacuaccauuugauacagcaaucccgcuacuggguaucuacccagaggaaaggaagucauuauaugaaaaagauacuucgcacgcauguuuauagcagcacaauucacaauugcaagaucauggaaccaacccaaaugcccaucagucaacaagucgauaaacugugguguguguauaugugcauauauauauauauauacacacacauauacauacguguguauguguacauauacauguguguguguauauguauguguauauauauacauauauauauauauguauauauauacacauacacgauggaauacugcucagccauaaaaaggaaugaacagcauuuacagugaucuggaugagauuggagacuauuauucuaagugaagcaacucaggaauggaaaaccaaacauuguauguucuuacugauaugugggagcuaagcuaugaggacacaaaggcuuaagaauaaaacaauggacuuuggggacuugugaggaagggugggaggugggugagggauaaaagacuacaaauaggguguaguguauacugcucuggugaugggugcaccaaaaucucacaagucaccacuaaagaacuuacuaauguaaccaaauaccaccuguaccccaauaaccaaugggggaaaaaaaagaauaauggugucuuuguuuugucuugcuauaaaggaauaccugaggcuggguaauuuauaaagaaaagagguuuauuuagcuuaugguucuacaggcuguacaagaagcaugacaccugcaucuguguagcuucuggugagggcuuuuaugcugccuuaaaacguggcagagaaaguaaaaguggaagugggcacaugcaaagagggaccaaagcugaggggcguccuggcuuuguaacaacucacucucacaggaucuaauucaaucccagcaaaacuaauccuaucucacuagagcuagaacucaacuaccaugaggguggcaccaagccauucaugagggaucugccuccgugacccaaauaccucucauuaggcaccaccuaccagcaccuccauguuggggauaaaauuucaaaaugagguuugguggagacaaaccaaccauaugcaaaccauagaagaugacuauuauaaaagagacaaaagcgguggugaggaugugugaaaaaagggaacccuugcacacuguugguggaaauguagauuaguauagucauuauggaaaacaguauggaguuuacucaaaauaaaaaaaaaaaaaaaaaaaaagaacuacccuaugauccagcaaucccacuacuggguaucuauccaaaagauaggaaaucaaucuguugaagaaauaucugcacuccuauguucauugcagcauuauucacaauaggcaagauacggaaucaauccaagugucugucuacagaugaauggauaaagaaaaugugcuauauauacacaaugggauacuauuuagccuuaaaaaagaaugagauccugucauuuguaacaacaugaaugaacuaggagugaacaguauguuaaguggaauaagaagccaagcacagaaagacaaauacugcaugaucucacucauaugcagaauauuaaaaguugaacucauagagguggagaguagaaugguuguuaccagaggcuggggguuauggggauuggggagauuuuuaaaaaaggaaacuucagucuuucaaagggcaucuauaaaggaccuacagcuaaugucauaucuaaugauaaaggaucaaaugcuuuuccuguaugauagagaacuaggcaaagauguucaaucucaccacuucuuuuaguauuuuacuggaaauccuagcagaacaagaaaauaaaugaaaggcauucagaccugaaaggaauaaauaaaacuaacuuucuuuguauauaacaugauuaucuguauagaaauuaccaacaaauuauuaaaaagcuccuagaacuacuaagugauuugagcaguauacagguuaacuuuuuaaaacaucacuuuuauuucuauacaaagacaaugaacaauuggaaaccaggauuuuuuuuuuuaaguuccauuuauaguagcuccaaaaggagggggaaaaaaaaacuaccuagguauaaaucaaacaaaacaugugcagaaucuguauguugaaaguuacaaaaugcugcugaaggaaauccaagacaaccaaaauaaacgaggaaguauacuguguugauggauuacaacacucgauacagucaaauugaccuauaaauuuaaugugaucccagucaaaaucucagcuagauucauuguagauauagacaaccagauucuaaaauuuauauggaaagguuaaaccagaauagcuaaaacuguuuugaaaaagaaacaaaguuggaggacucacauuaccuaguuuuaagacacaauauaaaucuaagguaauuaauacaguguaguauaggugaaagaguagguacauagagccauggaagagagagagucuagaaauagacauacaaguaugguaauagauuuuuuuuuuaauuguacuuuuuuaaguucuaggguacaugugcacaacgugcagguuuguuacuuauguauauguaugccauguugguuugcugcacccauuaacucgucauuuacguuagguauuucuccuaaugcuaucccuccccgcuccccucaccccacaccaggccccggugugugauguucccugccccauguccaaguguugucauuguucauuucccaccugugagugagaacaugcaguguuugguuuucuguuguugggauaguuugcucagaaugaugguuuccagcuucauccauaucccuacaaaggacaugaacucaucuuuuuuuguggcugcauaguauuccacgguguauaugugccacauuuucuuaauccagucuaucacugauggacacuuuguuugguuccaagucuuugcuauugugaauagugccgcgauuaacauaugugugcaugugucuuuauaauagcaugauuuauaaugcuuuggguauauacccaguaaugggauggcugggucaaaugguauuucuaguucuagauccuggaggaauugccacacugucuuccacaaugguugaacuaguuuacacucccaccaacaguguaaaagcguuccuauuucuccacauccucuccagcaccuguuguuuccugacuuaaugauugccauucuaacuggugugagauggcaucucauugugguuuugauuugcauuucucugauggccagugaugaugagcauuuuuucaugugccuguuggcugcauaaauaccuucuuuugagaccugucuguucauauccuuugcccacuuuuugaugggguuuuuucuuguaaauuuguuuaaguucuuuguagauucugguuauuaccccuuugucagauggguagauuggaaaaauuuucucccauucuuaagguugccuguucacucugaugguaguuucuuuugcugugcagaagcucuuuaguuuaauuagaucccauuugucaauuuuggcuuuuguugccauugcuuuugguguuugagccauaaaguccuugcccaugccuauguccugaaugguauugccuagguuuucuucuaggguuuuuaugguuuuaggucuaacauuuaagucuuuaauccaucuugaauuaauuuuuguauaugguguaaggaagggauccaguuucagcuuucuauauauggcuagccaguuuucccagcaccauuuauuaaauagggaauccuuuccccauuucuuguguuugucagguuugucaaagaucagaugguuguagauguaugguguuauuucugaggccucuguucuguuccauuggucuaucucucuguuuugguaccaguaccaugcuguuuugguuacuguagccuuguaguauaguuugaagucagguagcgugaugccuccagcuuucuuccuuuugcuuaggauugaauuggcaauggggcucuuuuuugguuccauaugaauuuuaaaguaauguuuccaauucugugaagaaagucacugguagcuugauggggauggcauugaaucuauaaauuaccuugggcaguauggccauuuuuaugauauugauucuuccuauccacgagcauggaauguucuuccauuuguuugcguccucuuuuaauucguugagcagugguuuguaguucuccuugaagagguccuucacaucccuuguaaauuggauuccuagguauuuuauucucuuuguagcaguugugaaugggaguucacucaugauuuggcuggcugucuguuacugguguauaagaaugcuugugauuuuugcacauugauuuuguaucccaagacuuugcugaaguugcuuaucagcuuaaggagauuuuggacugagacaaugggguuuucuaaauauauaaucaugucaucuguaaacagggacaguuugacuuccucuuuuccuaauugaauacccuuuauuucuuucuccugccugauugccguggccagaacuuccaacacuauguugaauaggaguggugagagagggcaucccugucuugugccaguuuucaaagggaaugcuuccaguuuuugcccauucaguaugauauuggcuguggguuugucauaaauagcucuuauuauuuagagauacguuccaucaauaccuaguuuauugagaguuuguagcaugaagggcuguugaauuuugucaaaggccuuuucugcaucuauugagauaauccugugguuuuugucuuugguucuguuuaugugauggauuacguuuauugauuugcauauguugaaccagccuugcaucccagggaugaagcccacuugaucuugguggauaagcuuuuuaaugugcugcuggauuugguuuaccaguguuuuauugaggauuuuugcauccauguucaucaggguuacuggucuaaauucucuuuuuuuguugugucucugccaggcuuugguaucaggaugaugcuggccucauaaaaugaguuagggaggauucucucuuuuucuauugauuggaauaguuucagaaggaaugguaccagcugcucuuuguaccucugguagaagucggcugugaauccgucugguccuggacuuuuuuugguugguagccuguuaauuauugccucaauuucagagccuguuauuggucuauucagggauucaacgucuuccugguuuagccuugggaggguguaugcauccaggaauuuauccauuucuucuagauuuucuaguuuauuugcauagagguguuuauaguauucucugaugcuaguuuguauuucugugggaucgguggugauauccccuuuaucauuuuuuuauugcaucuauuugauucuucucucuuuucuucuuuauuagucuugcuagcagucuaucaauuuuguugaucuuuucaaaaaaccagcuccuggauucauugauuuuuuugaagggguuuuugugucucuaucuccuccauuucugcucugaucuuaguuauuucuugccuucugcuagcuuuugaauuaguuugcucuugcuucucuaguuauuuuaauugugaugguaggguauaaauuuuagaucuuuccugcuuucuuuuaugggcauuuagugcuauaaauuucccucuacggacugcuuuaaauguuucccagagacccugguacacugucuuuguucucauuggcuucaaagaacaucuuuauuucugccuucauuuugugauuuacccaguagucauucaggagcagguuguuaaguuuccauuuaguugugugguuuugagugaauuucuuaauccugaguucuaauuuaauugcacuguggucugagagacaguuugcugugauuucuguucuuuuauauuugcugaggagugcuuuacuuccaacuauguggucaguuuuggaauaagugugauguggugcugagaagaauguauauucuguugauuugggguggagaguucuguagaugucuauuaggucagcuugguguggagcugaguucaagugcuggauauccauguuaaccuuguaucucauugaucugucuaauauugacagugggguguuaaagccucccauuauuauugugugggagucuaagucucuuuguaggucucuaaggacuugcuuuaugaaucuggaugcucccguauugggugcauauguauuuaggauaguuagcucuucuuguugauuugaucccuuuaccauuauguaauggccuucuuugucucuuuugaucuuuguugguuuaaagucuguuuugucagagauuaggauugcaaccccugcuuuuuuuuugcuuuccauuuucuugguagaucuuccuccaucccuuuauuuugagccuaugugugucucugcacgugagaugggucuccugaauacagcacacuguugggucuugacucuuuauccaauuugccagucugugucuuuuaauuggggcauuuagcccauuuacguuuaagguuaauauuguuaggugugaauuugauccugucauuaugauguuagcugguuauuuugcucauuaguugaugcaguuucuuccuagcaucaauggucuuuacacuuuggcauguuuuugcaguggcugguacugguuguuccuuuccauguuuaguacuuccuucaggagcucuuguaaggcaggccugguggugacaaaaucucucagcauuugcuugucuguaaaggauuuuauuucuccuucacuuaugaagcuuaguuuggcuggauaugaaauucuguguugaaaauuguuuucuuugagaauguugaauauuggccccuacucucuucuggcuugcagaguuucugccgagauauccgcuguuagucugaugggcuucccuuuguggguaaccugaccuuucucucuggcugcccuuaacauuuuuuccuucaacuuuggugaaucugacaauuaugugucuugggguugcucuugucgaggaguaucuuugugguguucucuguauuuccugaauuugaauguuggccugccuugcuagguuugggaaguucuccuggauaauauccugaagaguguuuuccagccugguuccauucuccccaucacuuucagguacaccagucaaauguagauuuggucuuuucacguagucucauauuucuuggaggcuuuguuugucucuuuuuacucuuuuuucucuaaccuucacacuuuauuucauucauuugaucuucaaucacugauacccuuucuuccacuggaucgaaucggcuacuguagcuugugcaugugucacauaguucucgugccaugguuuucagcuccauccggucauuuaaagucuucucuacacuguuuauucuaguuagccuuucaucuuuuuucaagguuuucggcuuccuugugauggguucgaacauccuccuuuaacuuggagaaguuuguuauuaccgaccuucugaagccuacuucugucaacuuuccugcuuuguuccauugcuggcgaggagcugugauccuuuggaggagaagaggugcuuugguuuucagaauuuucagcuuuucugcucugguuucuccccaucuuugugguuuuaucuacuuuuggccuuugaugauggugaccuacagaugggguuuuugugugaauguccuuuuuguugauguuggugcuauuccuuucuguuuguuaguuuuccuacuaacagucaggucccucaccugcaagucuguuggaguuugcuggagguccacuccagacccuguuugccuggguaucacaacagcaaauauugcaggagggcaauuauugcugccuaauccuuucucuggaagcuucgucucagaggggcacccagcuguaugaggugucagucggcuccuacugggaggugucucccaguuaggcuacacgggggucagggacccacuugaggaggcagucugccuguucacagagcucaaacaugcugggagaaccacugcucucuucagagcugucagacaaggacguuuaagucugcagaaguuucugcugccuuuuauucagcuaugcccugcccccagagguggugucuacagaggccagcaggccuuguugagcugcggugggcuccacccaguucgagauuccuggccgcuuuguuuaccuagucaagccucagcaauggcaggcaccccuccuccagccaggcugccaccucgcaguuccaucucggacugcugcgcuagcuagcagugagcaaggcucugugggcgugggagccacugagccaggugugggauauaaucuccuggugugccguuugcuaagaucauuggaaaagcgcaguauuugggugggaauguccuguuuuuuccgguacagucugucauggcuucccuuggcuaggaaagguaaaucccccaaucccuugugcuuccugggugaggcaaugccccacccugcuucggcucgcccuccaugggcugcauccacuguccaaccagucccagugagaugaaccagguaccucaguuugaaaugcagaaaucacccgucuucugcguugaucacacugggagcugcagauuggagcucuuccuauucggccaucuuggaaggguaaucccaguaauagauuuuuuuaaaggugcuaaggcaauucaguggagaaagaauagucuuuucaagagauggugcuagacuaacugaauguccucauaccaaaaaagaauuuccuucuaugaaaaauuaacuuagaauuuaucauguaccuauauguaagauaaaacuagaaaacucuuagaagcgaacauaggagaaacucuuuaugaccugggguuucacagagaguucuuagaguaucaaaagcacuauccauaaaaggaaaucauuuauaaauuggucuucaucaaauuaaaaacuuuuguucugugaaagauacugauagaauguaaagaagauauagggauggcagauaaacacaugugaagggugcucaacaucauuaguauauauuuuuuagaaugccuaaauuaaaauacugauaauacaagguauucaugaggauguggaacaacuggaaguuucauacauugcugguggauuacaacaugauacagucacucuagaaaacaguuuggcaguuucuucaaaaguaagacauauaccuaccauauaaccuggcauuuauucuagacaaaguucacaaaaacuugugcacaaauguuuguagcaguauuguucauaaucaccaaaaucuggaaagaacuugaauguccuugaauggauaaacuaauuguguaucuacucaaugggaaauacuguucagcaauggauacaggaacagaucuuuuuauacauacaaaaauggcugaaucccaaaugcaauaaugccaagugaaaaaaaaaagccauucuuauaauuacauguuguaugauuuucuagaaaugacaacauagaaggucaacaguugccagggguuaugggaaauggaagagucugacuuaaaaaggguguuggaauuguucuguaccugauuugagaagcugguagcaaaaugcuaugcacauguuaaaacucauaaaacuuaagccuaaaaaagugaauucugcuguauguaaauuuuaagaaauaaaaauacguauuaccuuguauucauuugucaaaguuuguucauacacuuaacauuugugcauuucacuaugucaaaauuuugugucaccuaaaaauaaagaauuguaaauaaacaaaaaaguaacuggaggaugggaaacacuuagguguucuaauuagaacaauuuugcccuaaagcgugauauauauaauuuuauuuauuauggcaagggcccauuuauuuuccuguuuaggagauuaccacguagucuauuuucuugacaauuuaguguugauucacugaauguuacuucuuaauaaugauggauaguuucuggccacaagcuagauaagagcucuuuuauaaucuauuuuucuacugcaucaguucagauucauccuaucucucgucuuuuccuuuugcacacauucuuucaucuguugacaguggaaaaaaaucagcuuggaaaaauguguuuugaguguuuucaugaauuucucacauuuaagauuuaaucauaaauuauuucuugacuagcagaagcaguucauacuguauuaguugugauaaucuuuggcccucauaaaacaaacuagcagaggcuuuaucuuaaacauuauagaccccauuugcaaugcuauggauugaauggauauauuuuagcacuugcugugggugacaguagaugaugucagauuaaauuuaaauugaucuccucucaauguuuaucucuggugcaugugcaauuacuucagcaccagagaaccuuucagaggcauucugucaauacagcuaccugacagucauuuguauuuguaaacugugcauuuggcaccugcuggucucuguugcauuggagcuaguggggagccaaaauggguauacaaugaaguuauugguugguacaucucagugggaguuauugaagggaagaaacagcacuuccgggaccucaagagaggauaaaaaguaaaagaaacugguaauauuaacuacaagccagcuauuguuugcuaccaaaaaaauaaugauuuuaaaagucaaucaauucuacccaaggaauuaaaguguauauggaccugcauuuuaauucuuguaacagaaugaaaaaguguuucuauuuaaaauauauaauuaauuuuuuaaagcaccaagaucucagaaggcagacaauucguaugagcagagauauaaauucagacaagcaaugaaaaaaaugcuuaauuugugaagaaauguaaauuaaaaugcagguaucuuuuacuuaucaaauuagcaaaaccaauuuuaauuuaaaaaagacaugcuuggcaagacuuuaaagaacaaacagguagacagauaguaaaaaccaacugauguuuuauagguauaauuugcucacacuuggucaaaagcucuuauuuguuaacccaguaauccuacuuuauuguauauaacucaaggaaauauuacaaagaagaaagccugguacauaaauuuguuuagcucaguaugguggugucugcuacagugcauuguuucugugcugcagauuugcucauacaugauugguaauuaagagaauaguguccauagaaagugaaguugugucaguuuauauaucauuauccucagaauauccugaagccaucagaauaagcuuuuucguaaagagaaugccgcaaggguguaugaagaucuccaaaacaaaacaacugaaaauccuggggaaguccccuuguuaguguaaauaaaagcuaguuuaaugaucuugagaagugcuuugcuuuucacaauauuaagcuauccaaugaaguugcaugugugguuugaagacauuaugaagacauuugccucuauguuuaggaaaaaaaacaugaaaaugcuaugcccugguucagguuaauuugaugaaauugguuucacugucuagugaaggcccuuaaggacccgaaccucaaaaguaggcucacaagcuuuacguuaaggcugcagaggaucaccugguugacacuagguuuaaauggugguggacauuggauggugcuaauauuuuuguuauagguucgcaguagugcuuugguuacaaagcugcauaguuuucagugguuagccccuaacuauuuuucccuugagcccuguuauuuuuagugugauguugcagaacaaaguuuuuuuuuaguuacauauauguaauuuaggaaaauauauaaagugcccauuaauaaaaaaugguuaauuugggguacagcaucuugauagacuauaaugugccuuaaugauaagcauggaaauuuuucuaugaaacaaguacaggaauuagaauacaaaacugaguaucuggauacuaugcuuacaacuguguaaaaauguuucacacauaccuggccugcaauaguugugguaggauggugggacuauagguuagcaaaaguuuuuuuaauacugugaaguugguaaaauagagauaaguccauuuuaacaguuuacauuuuauuugacucugguuuuagaauuccuggaaaacucaagcaauucguauuugacuuacauucuggaaaacugcacagagaauuccaucauggaccugacccaacugauacagccccaggagagguaggacuccuguuuauuuuucaaugagaacucuuuuuuucccuuuuucaguuagccucaaagagggucugaaguucuugcaucagcuugagcuucagcuucugaauauuuguguagagaaauucugaguagaaauuaaccuuuuaaauuaauuuuuaaagcuuuaggucuucagaaaaguugaaagaauauuauaacguaguuucuugauuguauaaaaguguucugaugugaccucuguggaauauggcuauaacaguuaaauauaguuggcuucaaaugggaauaggaaauaggaaucuaaagcagauaaaucagugaagaaaucaguggauuccaauaacuauccaagccuuccucuguggcuggaagauugaccacacuauaaagaaaguaaugauuuguuauucuugcuaaaucauucuaagagccuucacaaauacacuauucauaaugcucaaaaccuuacaguuuaaugcagcuuucccauuugugauuuagaauacuugacaacuauuuuaucaaaauuuuauguucuuuuauguuuuuuuuuaccugagaauuuuacuguuuccaccuuguaacuucuguuacaaguaauuucuauguuccuacuguacuaaacagcccuaaguuugcauuuugauagauuaugauuucuaucaugccuauuaccaugauaccgagagggaagauauguaccaaaacccucuauuucauaugcucagaacuuaaauccauuauuuugccuauaaaaccucuauuuauaaaaggaaaauaaaaacugaguuuuucuuuaccuuauuuaagagugagauuagguucagaggcaagaauucccuauaggaauccaacaacaugcuuuuuccuuuaaaaauuaggucagauuuuugauaauuaacaacuauaggaggcaaacuuguuggcuauaacccaaaggugauuauuuuccucagaaaagaaggccugcauaguauuuuaucagauuaggaaaagaugucauuuaccguuauuguauuauccugauuuguuucaauuuccucauuagacagugaacuuacauuuguucaucuuuguguacuaacagagggcaccaaauaaauguuuguuuuauaguaauauaauuaauuucagcuuauuucagcuuaauccaaacauauaucucacugaaaaaauuaaaaauguauugggaaagaggaacaugauaaagucaaaugauaaguuuguagacacauugcuuccuguuagaauuaaugugccauuacauauaguauguaauauaugcacugugugccuaugucaacuacaggggauauuaaaaugaggagaacaaucaggccugcucuugaggucacaauuuggaaauagaggauagacugcacugccuuuucuuuuuuuuuuuuuuuuuuuuuuuugagacggagucucgcucugucgcccaggucggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuaugccuuuucuuuaaaauucuuggaaauagcucguuucacuguguauuuuugucugcucuugguacacaaguaaaauacuacagaaauuaauuucuuucagcauugaaguguuugcuuuccucuuuauuucaacuaaguuguaauaauuucugguauccugguaauugauaacuaagauaauaucuacagaguggaugccauuaauucucuuagcagucacgugcagaagggaaggguuugggccaaccuaggguugugcugucucugucgacuagucuaggaaagcacccaggugucagguauuuuggucccuuccaccacaccucagcaaauguaaaacaagcccacaguuaauggcccuguggcaacccugcccuggagaaucucaauaagagcauuugaaaugaggaaagcaagauuucacauuuaaauaucuugcuuuggcacacaguugcuuuuauugauuaauaagcaaauaauuauaggggaacuacuauucaucgaauacacuuauuaaaauauuauagcaccauaaacuauauugguauaaaaauguuuuauucuuucuuuuguagcaagcccaagauguagcaagcaguccaccugagagcuccuuccagaaacuagcacccagugaauauagguauacucuauugagggaucgagaugagcuuuaaaaacuugaaaaacaguuuguaagccuuucaacagcagcaucaaccuacgugguggaaauaguaaaccuauauuuucauaauucuauguguauuuuuauuuugaauaaacagaaagaaauuuuggguuuuuaauuuuuuucuccccgacucaaaaugcauugucauuuaauauaguagccucuuaaaaaaaaaaaaccugcuaggauuuaaaaauaaaaaucagaggccuaucuccacuuuaaaucuguccuguaaaaguuuuauaaaucaaaugaaaggugacauugccagaaacuuaccauuaacuugcacuacuaggguagggaggacuuagggauguuuccugugucguaugugcuuuucuuucuuucauaugaucaauucuguugguauuuucaguaucucauuucucaaagcuaaagagauauacauucuggauacuugggaggggaauaaauuaaaguuuucacacuguguacuguguuuuacugauugguuggauauugcuuaugaaaauuccauagugguauuuuuuuggauucuuaauguguaacuuaaacauacuuugaaguggaggagagucauaagacagaacauuuggcaggaauuguccuuaugaaacaagaaaaagaaaaugaaaaguauuauuaagcuucuguguuugucuaaaaauguggcauauggauggcauuuaaaacuuugaaugaauuauaccuaaaucugggacagggaggugacaguggaacaggcuaccaaucagaacuagaugacuuuuaaggcuccuccuauuaugagacuucaauuuccaaagagaagaacuagcagagaaauuguauuucaguaauuuuaagcuccuucugucuuguagagucuuguuauaguuguauaaaucaaaaacacagaauaaggaacauauuuaacuuuuuuucauuauaaaaugguuagaggacccuacccccucuagauucccugauuuccccaggccugcagcauacaguaagaugggucccugugccaggccucaauacugccagggaauaaaaccagagggagaggacccucagugucauaucaggaagcccagugccagaggacagacagguucaaaacuggcuuuuccucugggccuggguuggugcuauaggccaagggucauuuuauacuuggguauaaaucaaucccaguuugggaaaagauuauuuuuaagcuuaaaaggcugacaugugccauuauauguaguauguaauauauguaacaucuuccaauucuuuuaaaauaaaauuaauauuuauaauggauauuuaaugauuguuauuuuuaaaaaccagcuuauaauuccucguuaugcaugauuuauccaaaguuuccauaguuuuauucaaaauaauaaauguuaauaaggugauaagggguauauuuaauguauuguaucaaauugugaauaagaaaguaggauggagcuuucuagagguugggccuuaguucuguuauccucauugcuuuuaaccaauaaguuaaaugaaguuagaguuauggucuucagguuagauuauggaccagaucugugagggucagcauggaaauucacauucaacaagguagcacacaggaccaagagcagcacaugcaaucaacuggaauaauauaguaauccuguaacuggguuugaaaaaauaaucaacaaaagauacaauucaaggguuagguugcagagagcuggcuugagaguaguuauuaugaaaaaggccucaaggaguacguguucaguaugcucuaagaugauaaaguggcuguuaaaaagggaguugauuugaggaaguauuacuuagcauucaugcauauugggcuuaggcucuagcccugccacuaucauugucuucucuggacugugaagucacugaggacaaggaaacuaaauuuaaugucuguaucacuagugccuagaauuucuggacacuuaguagucaccaucaggcguuuauuuaaugaaugagaagcaaagugaccuugguuacuuuuuuacccugaggggcucagcacucauuaggacuuggugccuaauuuuauaaaaagucacuaagcucaagugcuuggaugaaaggacagcguggauaaaaagguuuuuaaaacauggauguuaaggcuguuuugcuuggagaagacuugggacugggacagucuuuagauauuauuugaaaugcuggcacugucuaucuggaucccagggcuugaacuaggauuugaggaagucacagggaagcagauuucagucugacauuuauucagugcaaguuuuuuggugcuguaguauaugaugaaagauguaaagcugaauaaagcauuauuucugcccuagaguuguucacagccuagucaggcauauggauauguaaacaaugacuguaacguguuauagauguaaagacaaaauaaagguuaaagagggcauaaaggagcacucaauugcagagauuugaggacauuauuuuuauuuugagcuuuaaaaagaugaauagguguucucaggagguagggaucuggcugagagggaauaaucugagcaaagguaugaaacagccuaaugcauuagagaaaaaaguucuuuuaguaaggcauuugggguuggggaagcuagaaaaagaaaugggagcuggucacacagggccuugugugccagacuaagggguuuguaguauauauuguaggcagaagagauccaucaacagauugcaagcaaggaaguauguucacuuuaaaguuugagaaagaauaguguggaagcacgucucaaauuuagacuuguucccccucugaaccgugaaucagaccauuucagguagaagucuuccccgguuuaucugaucuacucggggccucaggcuucucagcugggaagagaggaugcaagaccagacugaagaacacgguugaguccccagaaccaaaagggggccuuucugcuucuuagccagcuaccucuucgaguuuuucaaauugugagggggaccauaaaaggauggaaacuuuuagaugacauucuacaaauuauuuuuuucuuuaaauuaaaagaaccuagccaauaagauagagaaugggcaucuaaggcaucucagagcucucugaugaagccagguugucaaagaucauuugcaaaagaagggaaaacuggcaugacaaaagcuacagagaggagagugaaauauagaaguguuugaaauguucaagcucacaauaagcuuaaauuuauagaaaaugcuaagguugucaagaaggcuuuuuuuuuuuucuuuuuuaaaccugagggcaaaaaggaauggauaaaguaguguaauggauugacaaucaggaagaacagaauaacucaguuuuuuuucuccuacaaggagauauggcuggaccaaaauaaaaugacaugaaacugcaaaaaugaa

SEQ ID NO: 191373 - RNA, 960 nt, Homo sapiens
auguucccggcaaauuggacaucuguaaaaguauuuuucuuccugggauuuuuucacuaccccaaaguucaggucaucauauuugcggugugcuugcugauguaccugaucaccuugcugggcaacauuuuucugaucuccaucaccauucuagauucccaccugcacaccccuauguaccucuuccucagcaaucucuccuuucuggacaucugguacuccucuucugcccucucuccaaugcuggcaaacuuuguuucagggagaaacacuauuucauucucagggugcgccacucagauguaccucucccuugccaugggcuccacugagugugugcuccugcccaugauggcauaugaccgguauguggccaucugcaacccccugagauacccugucaucaugaauaggagaaccugugugcagauugcagcuggcuccuggaugacaggcugucucacugccaugguggaaaugaugucugugcugccacugucucucugugguaauagcaucaucaaucauuucacuugugaaauucuggccaucuugaaauugguuuguguggacaccucccuggugcaguuaaucaugcuggugaucaguguacuucuucuccccaugccaaugcuacucauuuguaucucuuaugcauuuauccucgccaguauccugagaaucagcucaguggaaggucgaaguaaagccuuuucaacgugcacagcccaccugauggugguaguuuuguucuaugggacggcucucuccaugcaccugaagcccuccgcuguagauucacaggaaauagacaaauuuauggcuuugguguaugccggacaaacccccauguugaauccuaucaucuauagucuacggaacaaagaggugaaaguggccuugaaaaaauugcugauuagaaaucauuuuaauacugccuucauuuccauccucaaauaa

SEQ ID NO: 191374 - RNA, 8568 nt, Homo sapiens
uugagaaaauuuccuuuuuuauuagaauauuuaaaaaacaacugaauuguauuaauuauucacaaaaggaaugacaauccccaaauuugaguggauuucugggugguucaaggaagcuucuacauguuuuucacagguaaugacacuacuaguuaacagcucuggauguagaugggcaagacuggacggccaugcagagaaaagaaaggugggagugaaacuuuacagagaaagcaccugagaugagggaaaggcaccuuagguguguuuaaauagcauuacaaaagcuaaacauuaaccaggaaauacaagcuuuuuucccuaucacccaagugacaccugcuucgcuuugucuuagguuuaaaaauauauuugaucccaggaaggaucugagugaucuaaguuggacuaaacaggaggcagucuauagggaauguguauuuuucaaguaggagcauuucuuugccucuuuuguucaggaucucaucauuauauaucgucaaugauuggcaguuuuuaauaagaacuuaauuugcagagagagagagagagaaaagauaggcaggaaggcaggaaagaaggcaagaaggaagagaggaaagaaagaaggaaagaagggaggaagggagggagggagggagagacagaaggaaggaaggaaggaaggaaggaaggaaggaaggagauaacucugugaugaugcuggaauguacaugucucagugagcagugacagaugauuagcccuuucuaaagaccccuuaaagacacaaaaugguagguagcauugaucucaccuucauacccugggugaccauacuuugggaagcccaaauugaaaugaugugaucacugccaaugaguguugugacuucuaagugagauggccccccagacauagccaccagaaaaagcaucugaauucucagagcuugucuucuccagaauauaugagaaaucaucagaagacauugaaaacaagaaugccacgcccauugaccccugggcauugcuaaggcauucuguuggcuaggucccugguuuauguuccaaaauuauccaguuccagggauggagcagaugucuuacugguccuccccaaggaauggauauccaggaccucauaguaaugucagaauggggcugcacugaccagacaguccucuucauccuaaacugugggcaauuuggccugggaagucucuucuuauuggaaggguaaaaccauguuaccauugugaaguucgucucccacaauuccuauaauuagguuaguccaguucuugcucauagcuagagaccucguuguggcucugccuccuugguucuucuauaaggccauagguggccucaaggucaagacaucuggcagaauagaaagcuucacgcugagccauauaagcccagguuccgggcagcuugggagauccuggguguuuuccucuggggaaauggauaguaagcugguuugccagaccuguguggguucuuuauggaaagaggacauugagugcugaauuuuaagccagauuccacugccuuuguuuggguauugcccaccuggcauggaagcugggcagccucugggauuccgguuccuugcugagucaucugauugguuucaaacaagugugugucuccuucaggagggagccuuugaucagaucccacaagcuugccccuaugauguacuugaugacugguguccuggggggagguuuggaccaaacaaugcaucuccaggugcgugugccauggagacuugggggccugaaggcagcccugggcagccuccuccagccuccccuccaccucagaaucugccucuuccagggacagugagcuucuucucuccuuguuaauccaaacagcauugaccaucgauucugcaggagcagguguguuuccuccugaaaagagaaugcaccagcagggucaucacuggaagggacaggggcggcucucacuuagggggucucauugcuuucaagcugaaggaaggccauccccagaagguuccugguacauuucauguguguacauguguacacacacaagaucucacuugcaugcucacacacaugcccuuuuacaccucacccauauauacucacacacacacaauuauucauucauucaacacauauuuauugagcacuuaauaugugccaggcauuauuuauucuagguccugggaauacagcaaugaacauugagacaaaacccacaccuuccgggguguguccugguugaguagagacaaaauugcauauuuauaauaaaauuucggguggcaaucaaugcaauggaaaaucucaagcauaauagagggucaaacacugaaguggaggaguaaacucugggaggagauagggaacuagcguuuggggcuaaaagaaaggcaaggaacaagagcacacacagacucacacacauguggguucacauauucucaccaguggaaaagauuauucuuaacuuacgggguuuuguguucugggauucuuuuuguuuguuuguuuguuuguuuuuuugagacagagucucacucuguugcccaggcuggaguacaguggugcaaucuuggcucacugcaaccuccaccuccuggguucaagcgauucuccugccucagccuccugaguagcugggauuacaaggcaccugccaccaugccugacuacuuuuuguauuuuuaguagagacaugauuuucaccauguuggccaggcuggucuugaacuccugaccucaagugauccgcccgccucagacucccaaaguguugggauuacaggcgugagccacugcgcucggcuguguccugggauucugauagugaguuuaccacccaaggcagaagagggaggaguuguguuuugaagcagcucccuuuagagaaccaaucauuauccuucuccuaguccacaggcacugcucugggaggacaucugcagcauuuacggcuccucagaacuggcuuuagggugaaagaggcagaccaaugucucuuuucuuucuuggggacuuuuuuuuaaaccaccuaguggaauaugacaguucauuguuaacucuugguggcagugagagguauuggaaugacugaaaggcauuuuccuuauagaaagcaggugugugaccagcuuggagcuccucagaggugucacuuagguucacuuaucuguuccggcaccuguuaucacaggaggcccuggaggugacaaugugcagagcaagaguggggagaugauguuggaagaauaaagucagaaagaagccccugagcuccaauucagggaucccaaagaaacagaagaccagcugcagccaucucagccaacaauuacucuccugucaacacuaacucuagugugacucaagauuuguuccggcuuuguaacugguuaauuccuuaguauuauuuuccagcaugaaaugaagaaaacacuuuuuuuuuuuuuuuuuuuuugagauggagucuugcucugucacccaggcuggagugcaauggcgcgaucuuggcucacugcaaccuccgcccucugcaucccggguucaagcgauucuccugccucagccucccgaguagcugggucuauaggugccagccaccacgcccagcuacuuuuuuuuguauuuuuaguagagacgggguuucacuguguuagccaggauggucucgauuuccugaccuugugauccgcccgccucggccucccaaagugcuuggauuacaggcgugagccaccgcggccagccaaaggaaacuuuuauaaauauccaacauguuauguacuuauuugagaacaaggaaggagggagacacaaugggagaaccuagaaacugguauccuagcauuaguuuagaaggaaaggacugaagguggacaggccuguucagcugucagucccagccugugguucagaggaaaggaaaaagaguuaggcugggagauacacagggaccccaccccagagcagccucugcugagaaucaccaugagccuucuguggcaguacccugcacaucuugggauggugccugcccuucacuguacaagagaaagagaauuaggguaauugacugaagaguacagggaaauuucguaucauguuuuuuaucuguuuuguuuugguuuugguaagucagggacuggaaggaaauguacucguuaucuauaauaccuucuucauucuccacccuugauucacuuugccagaagauacaaguuggagaagggguauuuugagccccuccuugauuucucucuucaguggggaugaaggaagcggguggagagaagagcgaagagagugguagagagacucagggaggaaagaagaaucgaaauucacccuaacugccugagaccuuugguggaaccucucucaucaagccagagucaggaagacaugaggucugguccugaguucaccacugacucacuaggagacccuaggccuccauuuccucaucuauaaauggagaucuuaaaaagggagcuaccuuacaaggcugccaggaauguucaaugaaauguaauauaaaacauccagcccagauauaagucccgacccuaaucccuuuuucuacaugaggcgagucacacagugucugacugugacaaaagcauauuccuuuuggacaccaaucacugggaguaauuggggcuccacagacuucugaaaguagcucaagguccccuggguacuuacguugcaucagggaaggcacgcugcuacuuguaacugcauuuccagaagcuggauccaucgcauaaugcuaagacagggugaagaaagcuaauuucggagcccuuccuuucauugaucagcuccuagaauuucugagcuucuaaacgcaacccaaugucuugagacauugacuucuagcuuuaguaggagcccagucucaaugcucacucucucuuccugggucuuuuugcugcacugggcacugaggaucacgguccucuaaaaucccucuaccagcuuggcuucaugacauuaauugcucuugauuuucuuauaccacuuaaaauauguuuaauugugguaaaauacauagaacauaaaauguaccaucuuaaccauuuuuaagugcacaguuuaguaguguucaguacauucacauuguggaaccaaucuccagaauucuucaguuucucugacacucuauaagcauuaaacaauaacgccccacuuccccaugccccagccucuggcaaccaccauucugcuuuccuucugucucuuuaaauaugacuacucuacauaccucauguaaaugggauuauacaguauuugucuuuuugggacugacugacuucacucagcauaauguccucaaguuuuauccauguuguaguguauggcagaauuucuuuccuuuuuauggcugaaugauaugccuguccucaaauuuugacugcucucuccaucuucccuggcuucauuuccuccucuuguuccuuaaauauuugaguauuccagaacucuaauuuucaucccaguuucuuaucaauuuacacauggauuugccacaguuuuauccaugcccauggcuucagcuaccaucuauagaugaauaaccccaaaucuagcucuccagcccaaaugagauccaggcuggauggaaggucuacaggcaacuaucuccaaugcaguauauucaaaaacaaguucaucucucucuacaaaaagccuuuuucuccacaaaaagccuuuuucuccuguauucucaaggaaagauaccaccaucuauccuguugcuaaaguauaggggacaauuaauugcucuuuugccuccuuagugccauuuucaccuuauuuuugucaccuuacucugauuucucccuggauaauuaccuacuccuucacauucagugcuaguguuucaaguggccuuccuacuuagauacaugugacauacgugaucuuguccucagccagucagugcauaaggccuugaugagcuuuauacauauuaguucauuuuauuccuacaauaacccuaugauuuggguacuacaguuauucccaauugacaggugaggaaacugagccccagaaaauuuauguaacuuguuuaaagcugcauauuaaguaaauggcagagcugggacucaaacucaggcugugcuccaagacccaguacaugaccacuccauuacacaguaugcugccucucacaguuagauaaagaauguggaacucagccaaguauggugguucacgcccagcacuuuugaaggucgagguggguggaucaccugaggucaggaguucaagagcagccuggccaacauggugaaaccccaucucuacuaaaaaaaauacaaaaauuaaccgagcaugguggcaggugccuguaauccagcuacucaggaggcugaggcagggagaauugccugaacccgggaggcagagguuucagugagccgagauugcaccccacugcacuccagccugggcaacagagugagaaucugucucaaaaaaaaaaaaauguggaacugcaaacugcugaaagugcccugaaugacccugaccuagcugggaggucagaagucuucucggagaaagccacaccugggcacuccuugcaugaaccauaauuuagcaccuaguaaugaugggaaaggggguaccgaguuaccaagagcaggagaaaggacgagcacaggguauagugaauucucugggggcauguugaauuugagaugucuuuggaucauccccacuaagcaauuagauuugugagucugaauugcagguguauuaagcauuguguuuccauuugauagggauuuaaauugauaaauguuuguugaauaacugaaugaauaaauacccucaagggugggauagagcuuuaggaaccuuucaguuuaugcccugcagagauggugacuguuuggcugugccaguucacuccugccaggaacgaggauuccauugguuggcaacagcccagguaaugggagaugggcuccuucagcucagaggugccacuuuuguucccaaaaggcagcacacuuccugcccuagacagagaggucccucuggccccugauuccugcccagucuggccuggcaaagggcagcccaaagagucuacugaacucuacaaauaaccacagaaucccacagagcccagcuuugaccuuucaggguaucuucccuucucccucaaccuguuccucuguuagaggaggaagggcugggauuugacaugcccuugcuuucugagcccugugccucuaacucccuccuggaaugaaaucugaguuccuaaagggaggagguuucuccccaugaggggguuucuguguccaaucacaccucccugccugauguuugaggcuggaugagccugggaugccucaugggucucugagcccuaggcguccucuggcccagacaguucccaggcuguugggaacgccaugucuucuaccuccagagugaauuucucugguuuguaggaggugccuuaguuagacccagccaggaagcagagcuccuaucgccauaccugggcuagcaggggggccaagccuggcucaccaggcugaccagucuagcaagauuagaacaucagagcagaggccaggaacagugcuggcagccaggugcuuggcugaggccccuggcucccuuagcaggugggacagcugagcagagcugcccugagcccgccuccccugcucuuccccacugggagggagggcuggcaaagcccuggcucugccucccugcagcucugccacucaggucucccaugguaagucucuccuuccccagcaccuguccauuccuaccuuuuggaagcaccaggaggugggccuggguccucugcugccucuucaagccuucauacugggcucgcaggaacuggaugcugagugggggcccuuucccaggggccugaguccuggagcccucagccauuaagugagaccuaagcugccagaaguggggcagggcugggcacgggcagggcaaccccuccauccggauccgggagaaaagcaaacacagcuggguggggcaggaccuggggaggggagagagagggagggggcagugagggagaaggagaagugacgggcaaaaggaggguggaaagaggagugggacugaggaaggagauagaaaaauaagggggaaggagaaagaugaaggggaagaggagguagggauagggagaaaugugggggaggagaaaggugggagacaguggcaguaagaggagaaggaaaugucagaggaaagaaggggcagcgaagggggaaagacuggaggaaggaggugauagugacaagcggggauuaauggggcgagagaagaaagagagggaggaagauggagacaggcaggaggaggcagggaaaggagugauggggagugggagaccgagaaguaaggggaggacugggggagcaaagagaaaggcaagcccagcugcucagagcccuucaggggggucaagaaggugucuuauuccagguccuuccauugcuugauccuaaaguuuagaauccaauucccagugccacggugaaguc

SEQ ID NO: 191375 - RNA, 124053 nt, Homo sapiens
augaccucacggacaaagcgaaggcagaaaguuaaaaucagcauaucgaaaauaaaucacucuaguuaccgaaaagaacauaggguaucugaacaaaaucucagagcucacauaggcauagauacuuccaugugaacuuuaggaaucuugccuuaucuaacuuuugcagggcugaguggacccccugcucccgcuagccguuuugggagcaccagccaccuccacaccagaacugggcugucgggggccgcugcggcgcaggggcucguccgggacugagucagcgccggggccgagaaguucggcgggaggcgcagggcggggcuuccucccgccgacuccgagcccggcucuacuuuucugaguccacgucucuuccuuuggacaggcguguuuccccaggucgggcccagccaacgugacagccgcagaccucggaaaagggcgcuccggccccgccucgaggauuucccccggccgcuagggcagcccgggcccgcucggcccagccccucacggacugcggcgcgcggcuccccggggcccggcccgccgaacgccucgcucuacagcccucaccucgcggcgccgagcgcagcguccgcggcauggagaccggcuccgacucaggucagaggcccgcccccgggccgcgggggacuggcccugcgcgcgcggcggcgcgguuaggccgggccgcccgcacaggccgccgcgugucgaguccgcgcggggagcgcacgcggggcgggcggcgacaggugggcaggacgagccgcgagcgagcgagggcgggcgggcgcgcgaggggcccggcgggggggccgcugggaggauggcucagcucuuucuaaauauaaaaccggcgugaguugggcgagcgcggcgcggagucgcagagccgccgcgcgggccuggcgcacggggauucggccgcacagacggcggcggcggcagcggcagcggcuccgcagaggcgcgaggcugcgggagcgcccgagucgcgagcucgcgggggcagcgaagggcgacgcucgcgacgcggaggacgcaggcggcggcggcgggcgggccucggggcacagcgcgguccgcgccgagugaacggaggcggcucgcggccccugccgcaccgcgagccgcgagccccccggccgcgcccugcccccccagccccucccucguucccuccccggcgcaacauggcugcggccgccgccuccgccucccaggaugagcugaguaagugccgcggccgaaccugcggccgcgagccggaacgggcgccgcgcggugccgggggccggcggccgcaugagggcuggggcgccaggcccggugggcgggcggcggccgcggcguacggggagcuggggagcccgggccuggcggacgggcggggcgcggaccgucgccgcuggcguuuguaggccucagguuugcaccgucacguugcgaaauugaaaccggagccccgggcggagccaccucugcccgcgauccgcccuggcccggggucgggggagcccagcccccugcccacugagccucggcuggcgggagggccggagccccggggugacgggcaguguccgcccgucccgucugaccccgccuggccccggguccccgacggcugguugaguuauagaaauggagcuuucgggaagggggagaaggugccuuuuugugacacucuaguaaucagccgaaaggucacgaauaggcggugacccucagauggagcagggagggcggagagggucgccggucgaaccgcaggagaaaccacggggugacagcgcuuucagaaaggagaguuagugcccccucgaucguacgcggugcagccuucccggggacggcggucccugucuggggagagcgguggucacccugaaucccaggccgccccgcccgccgccgggguucgccucaaugcuuugugggaaguguaguuccggggcgccgcggacccacgcuggggucauaaauaccgaaguuucauaggacauaggacaugugagauaauuucugauugcguuuugaguguucucccccccaaggguuuucuuucuuucccuuuuuuuuuuucucccaaugcugcccuucaguuuauggcaaaaacaagaaagguguuauuugaagaugauguggguuuuaaauggaauaaagcaugggugagguguugcaagcuuuaugaagcuuacguuguuaaagccgcuucugaauuuccauaugaaaguaguuauacacguaauguauguuuuucuggugcuugucaguuuaaagccacuuuuauauacaugaucucacuuuugcccucauagcaaccuugugaggcagauagguaggaauuauccuuguuuuaaagaggaggcagguuuggagagauuaaguuccuugcugcuuugacacagaacugguggagcaggaguacuguuugcuuuuuuugaagcugaaguaaacacuuggugugauccugagcagauuggagagucggaggagacaaggucucauggugcgauuagagagagaagcgggcuacagauugcucuucugucgguuccacguggaagcaccaccaggccuucugagaucaguuccauguuuuguuuuaauuggaagaaaaguacacauaccauaaaauuucccguccuagccauuuuuuaaguguacaguucagugggauugaguacauucacacuguuguguaaucaucaccaccauccauuuccagaacucuucgucuuguaaaacggaaacuugauacccauuaaacaacaaauccucauucccuccucccuucggccccuggcgaccaucauuguacuuucugucccugugauuuugaguauucuuccuaccucgugugaauggaaucauacagaauuugugacugguuuuaucuuuauuuagcauaauguccucaagguucauccauguuguugcgugugucagaauuucuuuuccuuuuaaagguugaaugauauucccuuguauguauauaucacauuuccuuguccaucuaucugucuauggacacuuggguugcuuccacauuuuagcuauugggaauaaugcuguugugaacauggguguacagauaccccuuugagaccuugcuuucaguucuuuuggguacauacccagaaauguaauugcuggaucaugugauaguucuaguuuuaaauuuuuaaggaaccacuguacuguuuucuuuuuucuuuuuuuuuucuugagaccaagucuugcucugucgcccagacuggagugcaguggcgcgaucuccgcucacuguaagcuccgccucccagguucacgccauucuuaugccucagcccuccgaguagcugggacugcaggcgcccgccaccacgcccggcuaauuuuuuguauuuuuaguagagacgggguuucacuguguuagccaagauggucuugaucuccugaccuugugaucugcugugauccacccgccucggccucccaaagugcugggauuacaggcgugagccaccgcgcccggcccccacuguacuguuuuugacagugguuguaccauuuuacauuaccaccaacaauacacagaguucuaauuucucuauauccuggccgacacuuaucuauauugucaguaguaaccauccuguugggugugagguggucugauuuuuuuucaauugcuaugcuguaugacaucugaguuccuguuguagaaccaaacacauuaaagucugaauugauagcaggaaugggaacaaaacuagaggaagaauuggauauucugaaguggcugaaguauuugugucuaugcagugugcuuccauacauucagguacugguuaagaugcugauaguuaagggauuuccuggcucuaguaccuaauggaaaguuaggaacaaauaauuccaauccuugccuucuucuuguuuuguucaguuaaauugucagucaucagccacagauaucgguggacuugguuucuguauuucuucaggagagacugaauacguugcaguugauaccuuagaauaauuuaacuugaaagcauauacauguacacugguuaagaaguuucauauaaaccacuuuuaguuuuagaauggguauaauaaaauagcagaugcugauaaaaugugcuuuuggccaggugugguggcucacaccuguaauccuagcacuuuaggaggccgagauggguggaucaccugaggucaggaguucaagaccaggcuggccaacauggugaaacccugucucuacuaaaaauacaaaauuuagccugguguggcggcacgugccuguagucccagguacucaggaggcugaggcaggagaaucacuugaaccugugagguggaaguuccagugagccaagauugugccgcugcacuccagccugggcaacagagcuagacucugucucaaaaaaaaaaaaaaaaaaaaaaagaaaaggugcuuuuaagaauuccacuaaaaaaaaaggagagaauuauccaaauauuuucuaucauuuaugacuaguagaugauaguaaaagcaaacuacuagaugccagcauuguucucuuccacuaacauuuuauuguaaaaaaucuucaaacacacagaaaaguugaaagugaacauucguguacccaccacuuagauucuaucauugauagucaaauaacuuuaucauauuuacuauuauagcaaacuuugucauuuguccaucucaguagauuuuuaaaaauuguuaaaguuuuuuuuuuuuuuuuuugagacggaguuucagucugucacccaggcuggugugcaguggcgcgcgaucucggcucacugcaaccuuugccgccuggguuuaagcaauucuccugccuuagccuccugaguaacugggauuacaggcaccugucacugcgcccagcuaauuuuugcauuuuuaguagagacgagguuucaccaucuuggccagguuggucuugaacuccugaccucgugauccccccaccucagccucccacagugcugggauuacaggcgugagccaccaugcuuggccaauuguuaaacuuuuuuaguuuuacuuuauuuuuuaaaaaauaguaguaaaauacacauaacauaaaauuuaccaccuuaacaauuuuuuuuguugucuuuuucuggagacggagucuugcucugucgcccaggcuggaguggaauggcgccaucuuggcucacugcaaccuccacauccuggguucaagugauucuucugccucagucucccgaguagcugggauuacaggugugcgccaccaugcccggcuaauuuuuuuuuugguagagacaggauuucaccguguuggccaggcuggucucgaccuccugaccucaugauccgccccuccuggucugccaaagugcuagaauuaaaggugugagccacugugcccugccugccuuaacaguuuuuaaguguacagugguauuaaguacuuauuacuccaucuuuuuuuaugcauuucaaaguaaauuggugacaccaacacaccuucccccuaaauauuucagcaccagcauuguuuuaaaugcuuuguauguauuauuccucagaauaacccugaaagguagguaacauuauuauugcugcuuuauggagagagaaacaggcuucuuagguccccuggguccugcagcuggaaaguagucccaguguccucagucucuaguaugcacucacagccauccuugaggccaucuuaccucuuugcaccauagucagaguguguaugaugaacaguucaaaucagaugcauugccagauucucagcuagauguuaccuuaauccaaccauuugacuguuguuuaucauugcuguuggguacaaaagagacaccaaagcccaccaaaggaauuacaauacuauugaggaagaggaagaauauguguaaacagauaaguaaggaccaaaauaugacuguaugauauggauaauacuaaaguaauaucauaugugauucccaggucuguuauuuugagauguguagcugguaaaacugcauuucuauagauuucaaaugaacauuuucugccuugcauuugaaguaauuuacgucauaucaauuuaaaugaaaucugcaacuuucaguuauaucugcuaccacacuuuguaggagaagcaaaauugacuguuaggguucucuuuuauuuuauuuauuuauuuauuuguuuauuauuuuguuuuugagauggagucucgcacuguuguccaggcuggagugccguggugcaaucucagaucacugcaaccucugccuucuggguucaagcgauucuccugccucagccuccugaguagcugggauuacaggugugcgacacugcgccugacuuauuuuuguauuuuuaguagagacgggguuucaccauguuggccaggcuggucucgaacuccugaccucgugauccacccaccucugccucccaaagugcugggauuacaggcgugagccacuguguccggccuauuuauuuuuuuugaguaauaccauugagcaugaaguugccagaaggcugggugcggugacucaaguuuguaaucccagcgcuuugggaggucgagguggucagaucacuugaguccaggaguucgagaccagccugggcaacauggugaaacccuguuacuacaaaaaauauaaaaauuagcuggguguguuggcaugcgccuguagucccagcuacuugggaggcugaguggggaggauggcuugcacccaggaagucaagacugcagugagcugagaucacaccacugcacucuagccugggugacaaagcgagaccuuguuucaaaaaaaaaaaaaaaaaaguugccaaaaauaggcagguuaauuuuggggugagacuuguuauuguuagcauuuguuauccuuucacaaaccucauguuugagucagugauuauaauagaagaauaguaaagcuguuuauuuauuguguguuuaccguguguucuaauuguuuugcauguaucaacuaauugaauccucagaacaacccugugaguuugguacugguacugucucagggguagagcuacccucauuagacaguuaggacuugaacuuagauucucugauugcaaaauuuguauuaauucugcccuacuacuacuguguuauuccuguccugcaugggagaauauauaguucauaacaagaucaaaauggcuuuuugugugugugugugugucuaacuaguauccagagagaaccuucuguaguguauaaaauguggcaaucggggccaggcgcaguauccagaaagaaccuucuguaguguauaagauguggcaaucagggcuggagcggugccucacaccuguaaucccagcacucugggaggccgaggcugggggauaaguugagagcaggaguucaagaccagccuggccaacaugaugaaacccccgucucuacuaaaaauacaaaaaaauuagccggguguugggacgugcaccuguagucccagcuucuugggaggcugaggcaggagaauugcuugaaccugggaacuggaggaugcagugagcugagaacgcaccacugcacucuagccugggugacagagcuagacuccaucucaaaaaaaagaaaaaaaagaaaaaaggaccaggcgcgguggcucacgccuguaaucccagcacuuugggaggcugaggcagguggaucaccugacguugggaguucgagaccagccugaccaacauggagaaaccccaucucuacuaaaaauacaaaauuaggcagaccugguggcgcaugccuguaaucccagcuacuugggaagcugagguuuagaguuccugagguuugaggucaggaguucaagacuagccuggccaacauugugaaacccugucucuacugaaaauacaaaaauuagcugguugugguggcacacgccuguaguuccagcuacucaggaggcugaggcaggagaaucacuugaaccugggaggcagagauugcagugagccaagauugugccacugcacuccagccugggugacagagugagacucccacuugaacccgggaggcggagguuguggugagcugagauugcaucauugcccuccagccugggcaacuagagugaaacuccaucucaaaaaaaaaaaaaaaaaaaaaaaauucugauguuacugaacagaacauaguagauuuuuggguauguugccaaaaaagaaaaccauuaguuuugacuguuaaaggcaguucugaaaucuaguuuguaaauuaguuuaggucagagccuguagcuuucuuuccuuaugcuuagagugauuauaacuauugcaaaugaaaugaaauucaaugcaagacauguggcuaguuuuucugcuaauacuaucuucugccacuuuauggaaaaguugacauuauaguuaauauuucaggaguggguugagagauuuccaacagggaaggaagcauuugagacuuuucaccuggucagcuguuuagugguuucguauucugggcuuuauaauuauaaggcauccuuagaaucugaucuucguugggauaaaggcaacucaugaaggagcaacagccuauaaucuugaaggaugcacuauucaauuugaccauuugacauagccaugggaaacuucaguugcaaaaguuggccagauaaucagcaugucaggugucuucugagagagccucugcuagugcugggaauccugguagcucuuuuagaggaugagauuugggaagcuguguguugaacaugauucugugaccauacugaaauagccccuaagagcuaauugcuuaaaugaccagaauacaggcuuccaagcugaucuuuguagaaaggccaaggcaagccuguaucauuuaaauuuuaguuacuuaaccaaauaggaaaguuaagauggaaaaaugaccacggauauuucuauuuuuuauuaauuuccauucugauuuuuuuacuuucacugcauucuggguuuuuuuuuuuuuugaaacuagagucucacucugucacucaggcuggaguacagaggcacaaucuuggcucauugcaaccucugccucccagguucaagugauucuccugucucagccuccugaguagcugggacuacaaggcgugcaccaucacaacuggcuaauuuuuguauuuuuaguacagaugggguuucacaauguuggccaggcuggucuugaacuccugaccucaagugaucugccugccucggccucccaaagugcugggauuauuggcuugagccacugcaccuggcccaccacauucuguuuugaauuaugcuuucaguaaacuauaauaugugaucaaggccauugucagugagaauaguuggcacaggagcauugaccuuguucagaagauagauguuaaaauugaagucacugccaguguucucagaugguuugaucccuguugcugagcucucguuucagaccuggccuugaugcuucccauuuuauauggcuuguuuugcccauguauuuuuucaauucaauaagcagacuuuuaaaauugaguaaauaauguauggugcuguccucagagggcuuauaauucagugcagagacagauuuaugugcaaauguaaauaacauacacaaagcacgguaaguaaacugccuaacacaguucuuuggaaaccucaagaaaugagaaugguauuugaggcuaaaggaaaaauagcuugagcugagacuuggagauagggaaauauuaugcaaaacaaaaaaagcugaguaagucuguuaugaugggaaugggggugcuacggcugugugaaguacugggaaaggggaucagcugugugguuugagacuuggcccaugcugccuuuaugauuugagaucuuggacaaauuaccuuaccuuugcaagucucaguuucuuccucauaaaauuggaaugacaagauucacucauaguauuguuaggauuaauguaugugaaaauguacuguguaaacacuuaagcucuuauaaauuauuauuauuuuuggugugggauguaauagcagaugaugcuguggagauagguugggaccagcauguuguaggaaugccaacagaacuaguuuggacuuuguucuguagacaguagagaaccaucagagcuuuuaagcaggagcguaacaugaguaggucuguuuuguacggguaacagguggcauugguguaacacugauugcaaggauccggagaucaagagcagcaagacuaauuaggaggguaucacaauggccaaguaaaaagaaacuuagggucugaguugggacaguggaaguggauuuggcaaggaguuaauauaauguaaaaucccuaaaauagggagaaauuguuggcugacgagaugaggguuguugaagaagggaggaguuagagaugaaucuaaaucugaccugagacuagaagguggaggaguaacagagaguguagccucuagacagauuuaggaaagugaaggaaagagagaacagauucaacagauagguagucuguguucagcagaaagauuauuuguugaaugaauggguugaauuauugagcccccauguuguucagggagacugcuuugaguaguggcuaaaaccucuggaacuggaaucagagacaguuuugaauccugauucugauacuucuuaauguguucuugaacaagggaccuaacuuguaggccucgguuuucucaucuguaaaaugagauaauaaaacuuacaagauuuuuuucuuuucuuuucuuuuuuauugagacagggucucucucugucacccaggcugaaguacaguggugugauuucggcucacugcagccacaauuuccuggucucaauccaucuucugaccucagccuccugaguagcugggacugcaggcggguaccaccaucccuggcuaauuuuuguauuuucuguagagacgggguuuggcuauguugcccaggcuggucucaaauuccuguacucaagcaaucugcccuccucggccucucagagugcugggauuacaggcgugagccaccgugccuggccaggauuguuuuaagaaugggaagagauagcacaucuuggcacauggauugcgggugugugggaaccuugguucugaagcuagggagacagugugggaaugauucccaugguagagcugugggaaugggcauauuguucacagucagcugacugggagccacguguauacguauuuaagagcgagaggaagauaaucagagaaaggagaugaagagugcuaagagaggucagcgguggccgggguuaugucugucagccauuugcguucucauauguaaugugcuaaaaacauguauacauguuuaguaacacuucuuauaaaacuauuauguaauugaaacacuucuaauuaauguaacaguuuauauauuuaugauauauauacacacauauacauauaugauaaaauauguugcauugguauuagagauuuuaagucuucagcaaaugauuaucaguguauuuuuugaaguauuagcauguucucaguaaauuugguuuguggacauaggccuuauucuuucucaaauuugauagucauuauaauuuuuuuuccucauacugaauuugcaaagcagggcaucaaagaucuaacaagaaaugaaaagugcuuauuuuuuucuuaaaauuguagcuaugcauauacaucuguuaauuguauuuuuuugguguucuaaauaauagauucuuuauacaauugcauauguacgaguggaugaacguaccauuggugaucccgaggauuuuugucaagauuggauaaaccauguaucacauugauuguagagguuaguagauuuaguuccuuaggaugugugcauuuuuuuuguagcagcauuuaaaaaugcauagguuaucagguagcaauuuccccccaagaucuucauguuuuuuuuuuuuccuuuucuagcuagccugagaaaauuggugaaguucauguuaauuuacaaaugccugaagccucuauucucuguaaugcuaaacauaaaaauaauuugcaaaaagaagaaaaagauaaaacuugaagucuuuuuuuuuuuuuuuggagacagugucucacucuguuguccaggcaggagugcaguggggcagucauggcucauuguagccuugaucucccaaggcucaagugauccuccugccucagccccaccgaguagcugggacuacaggugcaugccaucacaccuggcuaauuuuuauauuuuuaguagagaugggguuuugccaugaaggcuggucucgaacuccugggcucaggcgauccaccuaccucagccucccuuggagauguuauuuagcacugugcacaaggaaaagacgaugggugaucguuuacaaacaacuuugugugccacaaucacaaaaagucauuuuacaugcucgaggaaugccaucauggagguuuuuguuuuuuaaauuuuuuaauuuuuuuuugagacagggucucgcugugucacccagacuggaguacaguggcacaaucauggcuaacugccaccuugaucuccugggcucaggcgauccucccaccucagccucucuaguagcugggacuacauuuuguuuuauuuuuauuuuuugacacagggucuuccuuuguugcccaggcuagagugcaguggcacgaucauggcucacugcagccuugaccuccugggcucaaguggauccucccaccucagccucccaaguagcugggaucauaguugugugccaccaugccuggcuaauuuuuuuuuuugguagagacagagucucuguguguuaccuaggcuggucuggaacuccugagcucaagcuauacuccuaccugggccccccaaagugucaugauuuuaggugugagccaccaugcccagccaguuguucuauuugugagaagagguaugaaggaggcaucuucaugguaauuggauguuucuaauucugccauuuugucaugcauugugauuuugagaaaagccauuuaauucuacuucauucuaaggcagaauaagaguauggugucauuuucacucuuggaugauaucagauggucuuuugauugaaacucuguaaauucagauuguaauucucugauaucauggacucaauauccagugaguuccugggauuuuguagcuucaauccaaaagugcuuuuuguugcuaucuucuaauuuaacuguuagaccccuucuccccaccccuccuaugcauucuacuauguuuugguauauauauugcugcugaugauacaaaaugucuuauucauuuaggugaaauuuugagggaugggauaauuuuaaaaccagaauucaacuuuaaaauaaauuuuggccuguuuuugcuguuuucacaaaucuuuauuccuugggcguuuagagaaaugaaaaauugggagaugggaagaauuguuuagaagagcagugaggacauuguuucuucucuccuagauucuuuaacuccuagagcuuuugggcuugugauugauguguuaaugucauuaugauauacugaaggcaaagugaagcuacaacugcuaggauuuaaauagugauuuaaauaaagaacauucuagggcuuacacacccauaugagcauuguucuaaguaauuagcugcuuuggguggaucuuaacgaucguacauuagacuuuuaugcagucugaacucuugcauaguauauauuauuuccucuaagcuagcuuucacaagcugaaguaaucuuuccugcuugucaccuccuaaaaccgauuucuaacugaguaucucugccagcugcugucucugggggaaagggccuuguggaccucaguguugggagucuagcacuuacucauuaaaucuagggcuucugucuugucaccuggcccagucuugccaagcuacuccuaugauuuccuccccuuccucuguguguguguguguguguguguguguguguguguguguguggcgggaggagaggacaugaugggguuguggggaagugggugcggggugguaagcaauaugaucagggagggguagccuuguuuugggcuaugcuggauuggcagggaguuugaaguagccuggaaucauaugcaaaaggcugggcacaguggcucacgccuguaaucccagcacuuugggaggccgaggcgggcggaucacgaggucaggaguuugagaccaucacggguaacacagugaaaccccaucucuacuaaaaauacaaaaaguuagcugggugucguggcacaugccuauaguccccgcuacucgggaggcugaggcaggagagucacuugaacccgggacggggagguuguggugagcagagauugcgccacugcacugcagccugggugacagagcaagacuucacuaaaaaaaaaaaaaaggccagggaaagaaagacucuuuuccucuucccuguuuaaagagccuagccuguaguagauccagaugcaaggguuuccagauuaggguaucugccugggcccuugggggacagacugguggacuagggaacagaaagauaaucugucugauugccuuaauucuggggugggcagaguuacuagcaaaggacuccaucagcagggaccuccugcucaggacuuuguugccugugaagguacucauugccaccucuugggcccuggcuggagagaggcagcuccugcaggaaccuugauggauugucucuuucugguaauggaucuucuccccacucccaacuuauauuuauguuuucugcuagacugccugacauucuccuuuuaaguacauuugcaucuguugaguucuguaaaaaaggcuggggauggggguaacucuuuacaaacaggaguagagaucacauuucuagacauucuuuuuuuugagauggcgucuuuuuuuuuuuugagacagagucucgcucugucacucaggcuggagugcaguggcgcgaucucggcucacugcaagcuccaccucccggguucacgccauucugcugccucagccucccgaguagcuaggacuacaggcgcccgccaccaugccuagcuaauuuuuguauuuuuaguagagaugggguuucacuguguuaaccaggguggucucgaucuccugaccuugugauccauccaccucggccucccgaagugcugggauuacaggcgugagccaccgcgccuggcgggacggagucucguacugucgccugggcuagaguacaguggcuggaucucggcucacugcuccaccucccggguucaaaucauucuccugccucagccucccgaguagcugggauugcaggcgcccgucaccacgcccagcuaauuuuuuguauguuuaguauagacaggguuucaccauguuggccgggcuggucucaaauucaccugaccucgugauucaccugccuuggccuccaaagugcugggauuacaggugugagccacugcacccggcugcuuuguuuuuuuggagacagagucucgcuauguugcccaggcuggaaugcaguggcacaauuuuggcuuacuguaaccucugccuccuggguucaagugauuucuccugccucagccucccaaauagcugggauuacggggccugccaucacgcucagcuaauuaauucuuaaagaagcauccugcuggccucauuuggguuuugccaaguauuagcguggcuuuuggggaauugagaugauauuucagauagaugaaguggacuuuaacuuccgguuaguaucugguuagauuuauaauucacaggauugaucuaccagaaaauacuaguauuacacacaaaaucuagaugccaacuagggcuuccuuauuuuuccauaguuuuagccucaaacuccuaauuguacugacugucagaguccauucucuucccuaccuuccagccugauauuuccaauuuuugugaauucccuauacuuuaguuucuuauucuuuucuuaguuucugggcucccacuucugaaaauguuucagcuuggacgugaaacacacacacacacacguuugagcuuggacaugaaacacacacacacgcucgcucucucucucucucucucucucucacucacucucuuugcccagaauugguauguccuaggaaaaggccuuguuuuaagagugcuugauuuucugcccuuuuacugguucaccccuuccucuucaucuuuuucuguucucuuccuuuccuucucucggcaguaacugcugcaucucugcugguuuggagucacgucguauacaguugucuaguaagauuuaguaucuucuccaccuacuuucucgcuuaaaccauguuauaauuuagugugcuagaaggagcauuggacugucuaggguuugaaucagcccugccacuuaguaguuuuggaaucuuggucaacagaauguuuucaaggcucuguuuccucaacuguaaauuggagcuaauacuacuugcuuuacuagaaguucuuuacaggcagguacuguguuccagugugcgcuuggaggguaaagcccucucuggguucagcuuguuuguuuuuguuuuguuuuguuuuuugaggcugagucuuguucugaugcccaggcugaagugcaguggcgugaucucggcucacugcaaccucugccuccuggguucaagcaguucugucucauccuuccuaguagcugggacuacagucacaugccaccacgccugaguaauuuuuauauuuuuaauagagaugggguuucaucauauuggucaggcuggucuugaacuccugaccucagguccuggguucagcuucugaaucuguguaucauucacauggugaccucuggcaggucaguuagguggugagucuauaaaugcaucuauaagugcaccucacaacauuuuucugaggcucagaaggccaugugaaacugcuuugugacugugauguauuuuauauacuuauaucugugaaucagaagaaaguaaauaccauuagagagaauauuucuuucugaaaucgucuauuauaguguaauauauuucuguaguaacuugauagaucuuuuaaaaaauaucgugugguguuagcgguggucuuagguauuuucagcuuucucuucaauuucagcuucuacuuaagaccucuaaccugauuuguauuuuaaaauuuacuuucauauucaggaaaaaaauauuuuuuguagaaaauuuaagcaaccuuaaaaaaccugaaaccugucacucagaaauucacgcaaguaauucgugcucaugaaguaaguuaguaaugacacauaauuaaacaaaccagaaagaauccucugaaauucaaccaaacagggauaacauugccuuaaauagaauccuuucucuauuccuuuugauaguauacuuuucuuguauaauuuuaaaggacuauuuugauguucagguuguccugaaaggaaacugauuucucuucucuucucucuucucuucucuuuucucaucucuucuuuuuucucaucucuucucuucuuuuuucucuucucuuuuuuaacaugcuuuuuccauuaauaaugaugugagggaaaaauaaguaauuguagguuuauuguuuuuucuaguccuguaagaaaauagcuuuuccucccuaauuuagaaguuaaaguuguguuuuugagagagaucugaagaaugugcugaagucuuuaaaccuuuacuggucguuuucuuuuuaugcggguaggaggagggaguguuccuucuucgucuuuagauagagaaacuaaagacaggcgaauaagauaaauuugaauuauuuaaaggaaaauaaaugagcugggugugguggcucacgccuguaaucccagcacuuugggaggcugaagugggaggauugcuugggcaaaauaggaugaccucaucucuacaaaaaauaaaacaacuagcugggugcaguggcauaugucugugauucuagcuacuuccaaggcugagguggaagaauggcuugagacugcaaugagcuguaacugcaucacugcaccucagcuugggcaacagcagaacccugucuccaaaauaaaaacguguguguguguguguguguguguguguguguguguguguauuuaguuauuuauauuuuuaguagauuuuuuuuccuccuacaagaaugucauaguuaacaugagcuaaacuggauuuuuguuuuguuuuggaauuuuaagauucucaggguuuugauacuuuuccuuugagaucaaauguucuuuuuguucuuucuuuuuuuuuauuuuuugagacggagucucgcucugucgcccaggcuggagugcaauggcgccaucauggcucacugcaaccucuaccucccggguucaagcgauucuccugccucagccuccugaguagcugggauuacagaugcacaccaucaugcccagcuaauuuuuguauuuuuacuagacauggguuucaccauguuggccuggcuggucuugaacuccugaccucgugaucacuuaccucggccucccaaaaugcugggauuacaggugugagccaccgugcccugccucuuuuuguucuuucauaggcuuuaagguuccuuucaagcuucaaaguucugugauuaaaaauuuuuuuucuugucuuuaaaacauggauuuuugauuuuugaaaaauauuugcucuguauacuuuuuuuuuuugggacagggucuugcucuguuacccgggcuggagugcagaggcaugaucuagcucacugcagccucaaccuccugagcugaagcgauuuucccaccucagcccccuguguagcuggcacuacagggacgcaccaccaugccuggcucauuuuucaauuuuuuguagagauggggucuugcuguguugccgaggcuggucucaaacuccugggcuccagugauucuucugccuuagcuucccagagugcugggauuacaggagugagccacugcauaugcuggccuguaugcuguuuuuuucuaaucaaaaaauguauuuucacugaaaaauauuugaaaaguauuaagaaaaauuacugauguauuuucuuucacuuuuuauauaauuauaucauaaaauaaaauuaucauggaauauauauauauauauauucuuuuaaaaauaacgaauuauuucaaccaugaaggaaaguauggagaguaauguugacauggaguuuuuuuugcucuuguagcccaggcugcagugcaauggcacgaucucggcucacugcaaccuccuucucccagguucaagcaauucuccugccucaacuucccgaguagcucggauuacaggcgcccgccaccaugccuggcuaauuuuuuuauuuuaaguagagacaggguuucaccauguuggccagccuggucucaaacuccugaccucaggugauccacccaccucggccucccaaagugcugggauuacaggcaugagccacugugcccggccuuggagaguaaucuuauuaacauuuauguaugucugacucaucuuugucaaauuuuuacauuuucugcuaucagcuucaggucuuguauuuuauuuuaauuaauuaauuuauuuauuuugagacagaguuuugcucuuguugcccagguuggugugcagugggaugauuucgacucaccacaaccuccaccucccgggcuuaagcuauucuccugccucagccuccuuguauuuuuaguagagacgggguuucuccauuuuggucaggcuggucucaaacucccgaccucaggugauccacuggccuuggccucccaaagugcugggauuacaagcgugagccaccacgcccggccuuauuuuauuuuuuuaaagaaauaaacauugcagaugcaauucaaacccccuguguuacuccuuaucauaucauuuuucuuuucuucccuuuuuuccucucuuuccuccuccccuccuucccucucccuuuucauucagagauugucauuacugugauguaucguacccaauauguuuuguguuuaaaaacuuuccauaaaugggacuaaacuguacauauccuucugcagcuuauuuuguuugaucuuagauuuuucagauauggucuuguuggcucauguaacauguaauccuuguuuauuuauuuccaucguugugugacucugcauaauuuauuccuucucauguugacugauauuuagauuguuuuuauauuuuugcuuuuacuaauccugggcugugaacacuuucacacauguguccuugugcuugucucuuccugggagaguucuuuuuuuuuuuuuuucuuuugagauaggaucuugcucaguugcccaugcuggagugcagggacacgaucacaacucauugcaggcuuaagggauucucccaccucagccucucgaguacugaguagcugggacuacaggugcauaccaccaugccuggcuaauuuuuuuuuuuuuuuuugguagagauggaguuuugucauguugcccaggcuggucuugaacuccugagcucaagcgaucugacuaccucagccuccuaaagugcugggauuaaaggugugagccaccacacucagccccugggagaguuuuuuucuaggacgguguuacauaaaguguugucugagcauuagggaguuauuucuugcaaauaaggaacuugcaucaaaauguaaaucaacuaucacuguuaauuuauuuaacacuucuuauucuagaagcacuuuuucaauaaaaaguguuccuuaucucuuugcugacuggugauaaacaguuuguagaugggcuucuugaauggcagaauugcuagguggaaggguauguuccucuucaacuuugcuagagaugucuuuacugcagaauugcucuucagagauuguaucaauauguaccccaucaguaguggaccagaguucuugguuuguuucccaucuuugccaacauuugguacuguuagauuugaaucuuuuuuuuucugauguguaguccauuguucucugauucuuaauggcauuuuugucaaucucaaguuuucauguauucccaguucucuuucuguguucucuguuuuaaucuauugauuugucuauuugcugaccggugcuuuugucacacucaaucuuaauaauugucauagcuuuauaagucuugaaaucugauugagccacuccuacugcacuuuuauggaaaauugacaguuacucuuggcucuuugcuguuucauacucuguuccauucauauuccaaaggaauuuuauaauuuuuuucagcuuucacaaagcacucuguuuucuguagagaauguuugacuguugggggcuucccaucuuugcaauauugaguuuauuugugagcauuagugcuguuuaccagauauuucuaguucucucuuuugggcacaaaauagaauuuagugcuggggacacagugagagacaugugauucaccacagaaguuucaccacagaaggguugaauugagccagaaggauugaggauauggcacuaacuagcgguguuugagaugguguuggcucuaucagccgacuguagugagcagagcccuccuccugaucuaugacugaggcauggucuaagugagaaacuaauguugguuguuuuuaagccauggaaauuuggggguuauuaucacuaaccuauccugacauggaaauccaugaauguaguugggugugguggcucacacuuguaguaucagcacuuugggagguugagguggguggaucaccugagugaggucaggaguuugagaccagccugaccaacauggcgaaacugcaucucuacaaaaaauacaaaauuagccaggugugguggcgcaugccuguaaucccagcuauuugggaggcugaggcaggagaaucgcuugaaccugggaggcagaaguugcagugagccgagauugcaccacugcacuccagccuuggugacagagugaaacucugucucaaaaaaaaaaaaaaaaaaaaaauuccaugaauguugugcuucuccauuaauuuagaucuuaugaauuauaguuaggauuauaauuuucucuguaaaggacuaugacauguuucauuagauuuauuuccagauaacuuguaguuuuauugccauuguuaauuauauguuuuuaaaaacuacauugauacuuuguucucauuuaucucaguugacuucuguacucugaucuuguaugcaacauaauuaacuuucuuauuuuacauacccuaucccauaaauaucauguaaucugugaauacugacaguuuuuaguaucuccuacuuccauauugcauuuucuagcaguuccaguucaauuugcuuggaagugaugauagugcacaucuuguuucugauuuuguaugagauauauuugcuguagauuuuacauagaugcuuuuugucagauuaugaaaguuucuuucagugacgguuauuuccagcuccacaguuauaaacuacucuuugggacagauucugcuaaucauauuuuucagacucccuuaccaucuagcuucuuguuuuaagauaucuuuuccuaucucgagguaaugagaauauucuuuauuucucuagaaacuuuauuguuuuaccuuugacauuuagauuuaugauccaucuggaauugauuuucuuuuuguuugaugauaugguuuggcucuguguccccguccaaaucucaucuuguagcucccauaauucccaugugcugugggagggaugcagugggagaugauugaaucaugggagugagucuuucccaugcuguucucgugauagcgagugggucuuaggagaucugaugguuucagaaacgggaguuugccuguacaagcugucccuuugccugcugccauccauguuaagaugugacuugcuccuccuugccuucugccaugauugaaaggcuucccuauccacauggaacuguaguucuccauuaaaccucuuuccuuugugaauucucuagucuuggauaugucuuuaucagcaucaugaaaacggacuaauagauauggugugagguagggauuaaauauuguucucccauauuggaauacaguugauuuaacaccauuuauugaaaagaccaucauuuacucacuacauugcagugacaccucuguuuaaaccaggugacuauauaccuguuugucuuuuacacauuuucuauuuuguucaaguggucuacuuauuuuuuguuagcauaguauacuuuuaauuacuguaguuuuuauuuuauguguuuauuuuuuugagacaaggucuugcucuuuugcucaggcuggagugcaguggcaugaucuuggcucacugcaaccucuaccuccugggcucaagcaguucucccaccuaagccucucaaguagcagggacuacaggugcacgccaccacgcccagcuaaauuuuuuuuuuuuuuuuugguagagaugggguuucaccauguugcccaggcuggucucaaacuccugagcucaagcaaucagccugccuugcccucccacagugcugggauuacagggcugagccacugugcccagccuacuguaguuagccuugaaauuugaccaaagucuucuagcuguuuuuccucuucaagauaguuuuggcaaaucuugguccuuugcauuucuuuaaauuauagaaagaaucaacuuuuuuuuuucuucuagugguauccacacauuuaaagauuauucauccacucauucauugauugagauaguuaguaucuuccuguguugcccaggcuggccuggaaccacuauaggcucgagccacugugccuggcucuaggaucagcuuuuuaguguuacccaaguuaucugauggauugugcuuggauuauauugucuauaggucaauuuggggagaauugacaucuuauuaauauuuucuaaucugugaauaugguguaucuuuuaaguuuuccuuaauuucuuguagcgguguauuuuaguuuucuguguagaggucuuacacauuuuucccuagauuaauucccagcuauucgauguguuuugaugucauuguaauagguguuuucaaauuuuguuuucuaaugguuuauuacuauuauauaggaaaccaauugauuuguguauuuuguuauucuauuaauuuuuccauagauuguuuuggauuuuuuguguaccaaucauuaucuuuaaauaaugaaaauauuauuucuuccuuuguaaucuuaaugcauuuuauuuuucuuugucuuauugcucugaauaaaauuugcaguacaaauuugaauagaauugguaauagugaacaucuuuaccuuguuccugaacucagaggaaaaguguuugguauuuuaccuuuagauauaauguuugcuguaaguuuuuauaaaaaucucuuaucagauuaaggaaguucucuuuucuuccuugucucuucaacaugaauaguuuguucccaucuauuuagcaugaagagauguugaauuugaucaaaugccuuuucuguauauauugagaugaucauaugauuguuauucucuauuguguuaauguggcagauuacacugauuuucaauauuaaaccaacuuugcaucuuuggaauaaauccaauuuuuguaugauguauuauccuuuuuauguaucgcuggauuugacucauauuuuuuacuuauuuuauguauuaugauuuaaauauuauuuuauuaucucauuugcgucuauauucaugagaaauaucuuuuauuugcuuuuaucuuucuggggauacccuuguuugguaucaagguuauucuggccucuuaacauucagggauguguuccccugccaucccuuuaccccaccuuuuucucuucucuggaagaaguuaugaaggagaauuuaccagcgaauucauaagguccugccauuuuuuuguguggggagguuuuuaaauaauacaguucauauuugugguaauuuagaaugaaccaguuuuuuaaagcagaauuuauaauugugaguuguaucauuguggucugucuuuagaaguaauuaaaaaagccccuuaaaaucauguaauuaugacuuuguacuaaguuaugccuccguaugaugagcucuugugucucugagguauugucacaugggauuuuuagcuuucuggccuggcucaguuuuccuuuggugguaguaaaugggguuauuaacauaccuagcauaggauuccuacucuaggugggauucuacuaauaauucauauuuugcucccagcugauggaauguguguucucaaauauuucguagacuucugauuuauuaaaauacuuauuuuuguaguaguagucagcuuuauuuaaaaaggagguaaaauuagccaaauaugauggcucauaccuguaauuccagcacuuugggaguuugaggcaggaggaucgcuugaggccaggaguucacaagcagccugggcaacauagaccucauuucuacaaaaaauacaaaaaagaaaaagauaauaauuucuucuugccacugagcuuaaggggaaaaaaaaagaaaaagguaaaauuaaaggaauaauguauucugagagauaauuauauacaauauuuauauaacauauggaaaauauuuuauaucauauauaauuacucugccaaaccuaaccaguuaagggcauagcccuccacuagacugaaucgacuucauaugccaccuacaaguuccuguuaucccagagccacccucacuuuugaccuauuggauacagauuugggggucuccauggacccccucagguuuaaucauuagcuagaacgagucagaacucaggaaagccguguauuuaugguuaugguuuuauagaaaaggaugcaaguuaaaaccagccaaagggagagacauguagggcaaggccugagaggguuccagaugcaaagcuuguguugugucaggguacuuucccaguauagcaaugugugauaauacacacaaugcacugcugaucauagaagcucaccggcucaccugaacuuugguguccaggguuuuauugaccaggugugauugauugauuggaucauugcccaugugacucaauuucuaacaccccccccacccuccucucccucuccaacccuuccccuuguccaccuccccuaaucaccuggcugaaaaccugcaagaugauuagucuuucuagugugaucaacccccauccugaguuaucucuuagcguaaacaaucuggggcccacuaugaguuacuuccucaguguaaguuaucaaaugugauuagagggucccaccaugaauaacaaaggcacuucaguuacuggggaaaucccaaggguuuagugcuuuccucucaggaacauggacagaggucaccuaaauucuuuauuacacaagaauauaaaagcuacaucuguaauaugauagccguauauaacauuauauaauguuucacaacauucuuaugaagcaaucuuaugcuguuccuaauagacaaguucauuaauaaccuuagagagguuuaguuuacuaacuaaaaccaguaauguaucugacaugaaaauauagguccguuggcuccuuuauaucuuagacucucggagagaaucauuaguugggcuuucacaagucuauauuaauaauguauaguuuauaaauaauagcccauuuagaauuguccccauaauauaugcaaaggaggaauuuuauacuuuuuuaauguguguuucucauguguguauguauaugcacacaaaaucuagauacuucuuuuagcagaaauucuccuuaguugguugaugugaaauaaaggauauuuuccuaaaucacauuuauaacugaagguuuggaaaacguugucuguauauguuuguauuuuuucagugauuagacacugauauaaaugcuauagggguagggggaagaaaggauaggagauuuauuuuuuauuuguuugacuguguggauuaaugcugcuguaaauuuauauucacuaaccucaauuggguccuuuacacuuucuucacauuuguaguucauuuuaccagucaauuuucuucucuucuucacucuggggcaagccuuuuccuaccauugucacgcugcccacuugcccucugcucuccaaaucucagaagaagacugugccuucuauuuuacagaaauaauagaaaccaucagaagggaauucuuucaggcccuuccauaaaauuuauaagauugauuuuaucaacagcagucuuccuguuucccuccuguuacaauggcagagauggccuuccuguccuaucuaagguaauuccucagaccuugugcugaauccuaaucucucccauauucucagggucacagucuaauaauuuuuucccucuucaguuucuuucucucuaguggcuuuuuccuuuugcuauuuaaaugugcucagagcucuuauuugauugaaauaaugaaaaauaacuguuccccuccccuuucauaacuaaaaguuucuaaagaguugucauuuacuguauuccucacauccuuuuuaaucuuccacugauuccucuacccuguacagucugcuuuuuucucuaccacuucauugaaacugcuugagccaaggucaggugugaacucuauugcugaauuaacuggauucuuuucaauucuuaucuugcaugaucuuuuugcaucauuugaaaugguugacugcugucuccuaggaaaaucuuucuuaauuauucugaccccacguuuucuuuuuauuuuugucuguugccuaccauucccuuuuucagacuuuccuucuccugcauuuaaaugcuguuguucgcaaacagucuguccuaggccuucuguuauuuucuuucuacaugcaguuaucauauacuugugagguaagccuggacaacauccaugccucuucccucuccacucuuuuuacccaugaccaccaagcucuuacgcaugguagaguuucaguagauacuugaaugagugaccuagauaggagaaugagugcuugacugugaaacugggagggugcugggccuugaaggaggagagaauuuugaugagcaggaaggaggaggagaaagguugaacugcagcuggucacauauggaguuagcuucuuauucauaguagugaguucccucuaguguuguuuucugaccuuugaauuuguauguuuuuccauuuuuguaauaaauacugccugaaugagacacauucuagugaacguuuggauauucuuucaaauaaaacuuccuguauaagguguaguauguacaguauguguaccugauagaaaauagggucauucuuggagacaguuguaugguauaggcaaggauuuuuagacuaaaggucagaagacuccauucuuauucuuacucugcugcuaauuaaucugugaccuugggcaaguccuuaaaacucacugugcuuuuuuacguuauauaaucuuucagucuucuucaguucuguuuucaguccaguacaaaucuuucuuuaugcaggcuucaaaauuaauuuucuucuugacuugggggguagucacaagauuguuuauaauaauucauuaaaccaugcauuuauguuuugaaugauuuucuguauguauuauuacauaguuaagaagauuuuaaaaacccaccaaagacuuguuuccuacaucccuccauauaccaaaagaaaauuccagauggaucaaagacuugaaugcagaaagcaaaaucauaaguguacuugaaagaaaacauagguaaauauaccugccaggagacucccaguucgccccuagcuucagugauugucuaguaggacucacaggauucagcauauauuuguacucccagcuaagauuuaguguagcaaggucaccaaagggaaaagucaugugagugaaaucuggaggaaaccaggugcaagcuuccaagaaucuucugguggagucacacagcacauacuugauuccuccagaagugaguugugacagcaccucugaaaugguauccaccagagauggucaucagagacucagugccucagguuuuuauuuggggcuggucauguugguaccuucuuccuaaaauguaccaaaauuccgcccugaagggaagcugauguucagcauaaacaauauuauuugcacagacaggcacaaugaaccacucuuagcaguucugggaauggugggaacccugcugaaauccagguuuccagauaucagccaugggccagccucagcuagaaagcacaucuuucuuucuuucuuucuuuuucugagacagagucucgcuuuauugcccagacuggagugcaguggcacgauaucugcucacugcgagcuccgcucccuggguucaugccauucuccugccucagcuuccugaguagcugggacuacaggcacccgccaccacgcccggcuaauuuuuugaaauuuuaguagagaugggguuucaccguguucgccaggauagucucuaucuccugaccucaugaucugcccuccuuggccucccaaagugcugggauuacaggcgugaaccaugugccaggccgaaagcaaguguuucuacagguagcaguccugggucuguguaaacucuucucugcacaauauaauauuuaaaaguauuuugcagugaaaaugacuuuucuaagcaugccuagaaacuccgaagucauauagggaaggaaugguaaguuuaacuauacucaaaagacuuaggccgggugcaguggcucauacuuguaaucccagcacuuugggaggccaaaguaugaggaucgcuugaggccaggaauucaagaccagccucugucuugaggccaggaauucaagaccaggaauucaagaccagagaccucugucucuacaaaaaauaaaaaaaucagcugggugugguggcguaugccuguaguccaagcuacuugggaggcugaaguaggagaauagcccaggagguugaggcugcagugagcuguggauagcgccacugcacucuagccugggugucagcaagacccugucuuauuuaaaaaaaaaaaaaaaggaaaagaaaaauauagcaguuauaucuguagauguugaccuuucuucuuuuuugugaaacuugaacaagcuuaucuuuuauuuaaguauagaugggucuguaaagaugacguaacaguguuagauugauucaccucaaagguagaaggcuuuaccuuuuccucugguguagccagccuguuuuagcaggacccucucacauggugguuggugcucuuucuucccauucccauguucucauaauuuuauuguguuuaggauguuauauuugccugucucgugagggagagaagauguuaggugcuaugcugggcauacauagaagcauccaaaugauugcaugaaaaggaacagggacuggauauuccacacccuccugccgccgcaccccacccccccaucuccccccaccguuuucuuuaacuuugacagagauucucuaggucaguuuauuaugaagaguuuaauuuucugccuuuguccacagaacacuucuuuuacaguuucuguagcucagauuuguaguuucuauggccuaaaagcuguaaggcccuaaggagcugcuccuuuaccuguaacuucugcaaacacuguggguugaacucagcauuccugagaacuucuuuuacagcagcauucagcauuuaucaaauagaaucacugguagucucagauugagccuuucuuuccucccucccuuuuuucuuuuuauuauuaauuuuuuaaacuaaacuugagacuuuauuuggauuuuaccaguuuuuucauuaauguccuuuuuucccccccaggauccugugcaagggaccauuuaguugugauguuuuccagcuuucucuggucugagacaguuuuuuagucuuuucuuauuuuucaugaucuugaacguccugagcaguacuggccaggugucuuauagaaugucccccaguuuggguuuuucuguuguuguacucaugauuagauuuggguuauggguuuuuguuaugaauaccagagggguaaaaugccuuucuugucacaucauuucagggacacgugauaucugcacgacaucaugagguuuaccuucuuacuggacuaagauaguauuugacaguuuucucuacugugaaguuaacauuucucccuuuuuguauucuaaagaaguagucacuaaaucuagucuacccucaagggggagggugggcaggaauuaagcuccaccuccuguagggggaaauagccacauauauuauuuugaauucuuccuauaagaaaaauuugccucuucccccccaguuucuuucaucauucaauaauuauuuccaucaguauggacucauguagauugacauuuuggcuuauaauccaaugcuguuauuuauuuuguuccuucuaucgucauugcuugggcaaugacguucuuucagguugguuccuguaucccuuugacuuguuccauguuccauuucuuuauuuuugagacagggucuuacugugucacccaugcuggagugcaguggcaucaucauggcucacuguagccucaaccucccaggcccaagcaguucuccuaccucagccucuggaguagcugggaccauaggcacucgccaccaugccuggcuaauuuuuuccuuuuuuuuguagagaugggggugucucuguguugaucaggcuggucuugaacuccuggccucaagcaauccucccuccuuggucucucaaaguguugggauuauaggcauaagccacugugcucgaccccauguuccauuuccuuuuaggcacuacaagacgcuucaggcucaucuuguuuuugaccugccccaaucccuaaacucagaccuuuuuccaaggagcuugguuccuuuuccuggagaaugguauugaaaaacaagaucaauucuggguguuagguaugcuuguugcuacuaggaugucauugcuucugccccucucaggauugaucgaucaaucuguugaucugucugucugucuauccauguaucuaucuacgucucugucauugauccaucuauugagugaucuaugucuaucuaaucuaucuuccuguagaaaauuauuguggaaaauuucuggcaaacacaauaguaauucucaguaucuguuaugaagcuugaauaauuaucaauuaguggcaauuuugguuuuacuuacauaaccccuccccagugucuccucauuauuuaaagaaaauucuacuagcuguuauuucgccugcaaauauuuccaucuuuaucucuaaaaaaagauuccuuuaaauauauauuuuaaauugaaguauaguagauacaguagaagguaugaaaguguagaguuugaugaauuuuuauaaauguauuuaucucuauaaucacgcagaucgaaauauagaacauuuuuagcucuuuagaaaacucccuaauucccaugacaguuuuuguagggaccuuuaaaaaacaaaccuaaccacaauaccauuauaguaccuaaaacaauuuuaacaguaauuccuuaaaaucaaauaucuaguuguuugcauaggcuccccuuucauucccaucuuccugcuugccgcugcaguguacugguugaagaaguuaccuugucuaaaguuuaucacagucuggguuuugcugagaguauccccauggugucacuuaacauaugucucucauaguggcuuucuuggggaaacuuggcuauuuuucuaacuagguaacccuaauacaguaaugggcagugauccugucuuuggagaaacuucaucaguaagaugauuucaccagggauagauauauugucccuaauaacugaugguaucugauuaaaguuuugcugccuugcucuacuaacuaguuccagaagaugccuuuagaaaucuuguauccuuuccaguauccaguuaaaacugaauaacguugcaugugggagagaacuuuuuguucuugguuuuguuuucuuccauucuaaaggguagaccaggguagaacaguuaaccuuuugguggugguuuguugcugugucaaaauaucuguauagggcuagcugugguuaaaguccugacugaaggauugcaguacagaaaaaaagaauaagcuauaaaaauaauuggucuugguuguguuuggcuugcuaaguucucucuuuuuuucuuuuuauauuauagaucagcuugaacgggucuuuuuacgacuuggccaugcugaaacagaugaacaauuacagaauauuauaucuaaauuccuuccuccuguuuugcucaaacucucuagcacccaagaaggaguacguaaaaagguaagcauguugggacagcugggggaauuaaaugaugaauaaaugaauauacauuaucaagugaguuuucuguucccauuauugaguucuagguuugugaucuuaauuauggccuuucaaaauggagaguaagucuagaaccagcuuuuaugauuuaaaaguagcucuuguauccuuagcacagcugcauuuagcaccaacugucuacuuggcaucagugucagauaauauaauugagauaauuauccuggaauguauggaggcaugaucugaaauccaugccauugauuccaauaugaaaggcaugugguaauggggcaaaaauauucuuuaguuaauuguugacaaugauuauaaccuuaacuaaaaguaagcaaaauaaaaaaaaauuuaagcaaaauaauuuuauagcuccuguuucaggauucugcaaaguacucuuacaaaaaguuggauaacugucacaucagauuuucauuuucuuucuuuuuuuguuuuuugagauagggucucacucuaucacccaggcuggagugcaguggcacaaucacagcucacagcagccucgaucuucugggcuuaggcccuccuaccucacccucccaaguagcugggacuacaggugcagaccaccaugccuggcuaauguuuaaauuuuuuguggagacaggguuucgcuuuguugcucaggcuggucucaaacuccugagcucaagcaauccaccugccucggccucccaaagugcugggauuacaggcaugagccacugugccuggccaguauuuucauuuuuuaacgaaacuguucuacauggaacauuucccccuugauuuguagaauauuucauuagucuuccaguauauuuauaauaggucauccagucuuugagcuauggucagguuuuauuccuugggccacaguaauuggcagugacuuccuggaggucugcccugagagggauuccaaggucugauuuggguucagugcagaaagagaaucuuuaggaaugucuuuuauguuuauaucucuuuacaggagggaaugggcauucuugucauauauuuggcaugucugcaguuaauccuucuuugcugagauagacgugcauuugauuaugucacucuucuauuuaaaacccuucuguggccuucucuuacuauuaggauagcaaggucuaagaggcccuucgugaguugauuucuguauacuucuuagccuuaucaguuuuguuauuuagcaaauauuuacugagugccuucuauaugccaggucuuggggauauggugaugaaugaugacaacaccuaguuggggaaaucaguauaaaacagucaggcaaauaguacauaguugaaauuugugauacaugccaagauggaaaaggaaauauauucuuaugaaagaauauauuugggauauaauuuagacuaagugugggguauaaggggaggccucuguggugugcaggaaguagccaggccaagaggugggggagaccauugaagauagacccugugcagguguucugagcugggacagagugugaugccuucaggaaauuggagaaggccacagugauguccccagugcaugagacgaagccugauaggaggaaagagguauuccaggggcacugauuugaaaggguauugaugguagugccuccaucacucuagcuguuggcuggagaaagacuuggaguaggggccaagaguggagaccuggagagcaaacagggaacuuuugcauuaguccaggcuuaguaucgucaguaguuuuuaacucauuuacuuaucuuagauuuuuuuuuguuucuuuguauuuuauuuuuuuauagaaagucauucaucucuguccaucuacuuuaaauguucaguuguguaucauucacuucuaucauacuauuauucuuuuuuaaaaaaauaaauuuuauuauguauauuugacguuuacaacaugauguuauggaauacauacagauuuuaaauguuuacugaagcaaaugagcauaucucucucacauaauuuuaugcuauucuuaauauucuguuaucauuauuucaaaugggaaauucuauucuuguuucugguuuuauuacuaccaaaguuuuaaccuuuuaaugggucauuuuaaaaggaaacucagcuuuuagauuaauguucccuuuuuaacuguauuuuuuucuauuuuuauucaaauuauuucuuuuuuuagauaaguuuuucuuguguaaaguuuuaauuuauauaauaaccuggcaaugguucuuaugugucaagaaaagugcuaaggacuuacauccucaugagauuaugugaaguaggcauccccauuuuacagaugaaacugaggcuuggaaugauuaaugaacuuguuuaaggucaaauaacaaauggucaggccaggauuugaacccagggcuuuugaacuucaaaagguaagcuuggucaucaaguuaaaugcuuuauucuuuauuuauaguauguuaaaaaaaaagaaccaaaaaugaccucagcuuaugaauuucucuuugaugacuauuuuaguuauauguaauaguuauguugaugugcaguuuggucauuuuaucuuugacuuauuuauaagaguguuguuuuuaguuucaaaauauuugauauaaaauuugccugguuuuauugcauucuggucagagaccauagugugcaaauguuacaguccuucaaaguguauucuaauguuuguaagaaaagccuuucagaagauaaaaagaauacuuccuguuuguggaauauggagcucagcaugcgcuaaggccauucauuaguaacauugugcauucaugucuugaaccugucuuccaguccuauuauaaguugguaguacuaaaguauaauguccuacugcuguuacaguuuuucugauuuuucuuucaguuuuaauaaucuuggcuugcugcauuuugauguacaaguuuaacaucuugucuuuauuaauaauuauaguauuuuauguuuauuuuuuaucuuuugaauuccauuuaagguuuuuuucuccaaaaccuguuuuauccaaaauuaguauuguuaaccauuguuuuccuucugucugcuugauaaaauauuugccccagccugcaauuuuaaccuuauuuacuuugucuguaucucuuaguacaauggaaaugucacauauuuuugagauuugaguugagggcauuuacaucaguuauugugauuauuaaccuauuuuuaaaguuuuaagaaaaaauuuuauugauacauaauuauaccauauuuauggggguacaugugauauuuugauacaugcauguaauauguaaucaaauaauuuaguauuuaggauacucaucaccuaauuauuuauuuuuccuuuggguugggaacauuuuagaucuucuagcucuuuugaaauauacaugauuauuaaccuguuuuaucaguuggucuguuuguccuuucccucucugccuuucuuuccuucucucacuuucucguuaucaaacugucaacacuggugucuucaaggggcugugaaaggacaagggaaaagggaugcuuuagauuuuccacuugauuuauuauuauaaauguaucuuucuauuauaacuuuaaaaagcaaugcagaauaaaguaauaaggauaaauguaaucauuuugaacuuaauauauuuaauauauuuaauuuauacuaauaaaauagcauuuuuauuugugcaugucaaauugguuaaguuggaaaacuuuuggaauaggggaaauggaaucaaacagcuaaaauagccuguuauauauuaagcauugugcuaaacucuuugacuuaucuuuucauuuaaucuuuacaguagccuuugaaauguuaucugaauuccacaaguuauuuuuaaaucuuucuugguuuauggaggauuccagacaagauauaaccauauuuaggaaauucgccgauauuuaacaugacaauaaugcuacuagaaaauuaaguaauuaauccauuuaaaauucaaaauaggccgagugcaguaguagcucaugccuguaaucucagcacucugggaggcugagguuggaagaucuuuugagaccagccuaggcaacauagcaagaucucauuuaugccaaaaagaaagaaaaaaaccaugcaugguagcaugugcuuauagucccagcuacugcagugacugagauaggaagauugcuugagacuaggaguucgaggcugcaguuggcuaugauaaugccacugaacuccacccugagugacagagugagacccugucucggaaaaaaaaaaaaucaaaauaaauuuauuauuaaaaaaaagcaugcaauugugggcaagauucucugucuccaucgauaauaauuuucuauagagucccucuaggaaucagccuagauuacaaugucagaagagggcucuuuccuuuagacuaguuccuccugauuguuuucucuugucgccuagcgguaucacagauccaggacagguaggaagcucggaugaaguauggaugacaaugcaaguuucuagcuucuuggaagguaucaugucucacugacaaacacuuucgcugaugugaguucaaauaucaguguuugaaaagguuaaaaaaaaugggcucuggagucauauuuugacuuugcuauuugcuggcccaguauccuuggacaaguuacuugaggcuucugcuuccucaucuguaaaaugggaaugacaccaccucacugguuguugugagaaucguauuagauaaggaaugccugggggaagagugcauagaaacugugauaaauauuagcuauuuuaauauuacuauuuaucauucauucaacaaacauugauuacagaguuguuauuauucuuaaacauaauucaccuauuucauuauugcuguagaucucuuggaauuuuuugcugucggugucaaacaucucuacagcuuucuuuaugcaugcuuugaggcuagagcacgaauuucagaaaugagggagaauaguguaaaccuggcccugcagaauauuuaucuuaaauucuugagucuuucuuaggcaaggccuucuaaaaaucuuauuucucaaugcucgauuucuuuucuguuggcagaaaucuuuuuauuguaguauaauugaggccauuugauaugagccucuguacaucccuuucuauccaugcaaacuguugacuugucaauuccuauuuugcucucuuuucccacuuaaaggagaggaagcuuguuauuucuuacaaauuauuugauaguaucagaugauauucagaauacaauaaaaaugccucagacuauucacaauagcaaagacuuggaaccaacccaaauguccaucagugauagacuggauuaagaaaauguggcacauauacaccauggacuacuaugcagccauaaaaaaggaugaguucauguccuuugcagggacauggaugaagcuggaaaccaucauucuaagcaaacuaucacaaagacagaaaaccaaacaccacaucuucucacucauaggugggaguugaacagugagaacacguggacacagggcagggaacaucucacacuggggccuguugugggggguggggccugggguagggauaccauuaggagaaauaccuaauguagaugaugaauuguugggugcagcaaaccaacauggcacguguauaccuauguaaaaaccugcacauugugcacauguacccuaaaacugaaaguauaauaaaaacaaacaaacaaaaaacaacucccagacaaaaauaaaaaugccucaguauuuugccagaauccuuuuguaauccagaccuugcuuuuaugaacucuuaucguucugggcuucagucagaugcagugugccccauaccuucuuauaacugauacucugcuuggaacucauuaaaucuuaaggacucaguguuccugucacuuccuccgugaagucuuucuugauauagcagauacuuuugucuucuggaaacccacuguaucuuguaugucucucuuuucauaguauucaugguguguugcaauaaucuguucuucuugagggacaugcuucagucuaggcccaacuuggaucucaacuuuaacuaaaggacauuguaaaaauaaauucacuuggccaggcgcgguggcucacgccuguaaucccaacacuuugggaggccgaggugggcggauugcuugagaucaggaguuugagaccagccuggacaacaugaugaaacuccaucuuuacuagaauacaaaaauuagccaggcgugauggcggguaccuguaaucccagcuacucgggaggcugaggcagggggauugcuugaacucagaaggcagaaguugcggugagcugagaucgcaccacuacacucuagccugggcaacagagcgagacuccaugucaaaaaaaaaaaaaaaaaaaaagccaggagcaguggcuuacgccuguaaucccagcacuuugggaggcagaggugggcagaucaugaagucaggaguucgagaccagccuggccaacauggugaaaaaauacaaaaauuagccgggcaugcuggcacgcgccuguaaucccagcuauuugggaggcugaggcagaagaauugcuugaaucggggaggcggagguugcagugagccaagauugugucaaugcacuccagccugcacgacagagcaagacuccgucuugggaaauaaaaagaaaaagagaaauucacuagugcauagauuuuugggagacaguauuuuugaacaagauucauguaguguauacucccuuucugggauguaaaauuuauacccuuuaaaagaacaaaguagcuacuauucacuaacauagauaacaucugauaaaugaauuuuaagaugagugguuuuuaagauaugaucaauaacuuuaguucccaucucucuguauuuuagguaauggaacugcugguccaucugaauaaacguauaaaaagccgccccaaaauacaacuuccaguagagacacuguugguucaguaccaggacccugcugcaguuuccuuugucacagugaguguuguauuggaauauuuucugacuuacagcaaauuuucuuuccuaacauuuauuagaugucaucaacauauuggcaaguuuagaauuucaccuuagaccacuucuaaaugaaacaugaguuuuuuuuuuuuuuaaaugacacacuguuuuuccacugaguaccaauccagaggaaaugcugcuuuacaguagcaggguaaugaauggcuauuuacuuugggcaaaggaauguuggugaaaugacuugucagguauguuguuauauaaaagaaugauuugauuuuugguaggagacuguaugaaaugggucugaauagagggaaauguuauacggcuugggcacgaauaaagccuaauggaagaaaaaauuaguaaaauggcaagaagauacaugaaagugaacuuaaaaaaaucuuuuguguuuuugauguguauauucagaaagaucuuuuuuauaaaguggaguaaaucugagucugguaagaaacauuccuuuuaaaguguugucuucauaaaaauuaaauguaaaauauguugaugcugugugauggcaggugauguuuuuuuuccugguccuuguaguuccuagcacugaggcagaaucgauugaaucuuaccuaacaucuggagucacaaaccuuuuggagccuguuauugguccagacgucauuuuguccaugucuguucuggauauuuggcucaauuauacauuuccuuucuuuaagcaaauaggaacacugugugccaauaaaaaugccaaauauaauuuauuugaagaaguaaucuuaugaagcccauuuacuuuaguaaagaauucuucagaggccaggcacgucggcucauaccuguaaucccagcacuuugggagguugaggccagcugaucaugaggucaggaguucaagaccagccuggccaucauagugaaaccccaucucuacuaaaaauacaaaaauuagcugggcgugguggcgcgugccuguagucccagcuacuugggagacugaggcaggggaaucacuugaaccucagagguggagguugcagugagcugagauugugccauugcacuccagccugggugacagagcgagacucugucuugggggaaaaaaaugaaaaagcuucagaaaagcaaaucuuaaucuuaucuguaaauccagauacguauuuauggguuugcuuaaaauccaguauucacacagauuauagugauacagguugaguaucccuuaucugaauugcuugggaucaaaaauguuuuggauuuuggaauauuuacguuauacuuaccugauuuagcaucccaaauccaaaaucugcaaugccccaaggagcauuuccuuugugugucuuguuggcacucauaaaguuucagauuuuguaguauuucgaauuucagauuuucaaauuugggaugcuugaccuugcagaaacacacaguacucaguuuccuuugguucaucaugcauuggugaguuacuggagugaggaaccacagagugcugcaguauacuaaguuuguuuuagucauuugaccagugggaaauggcagccuaggauuugucaacaccugaucuccuccuagcuuguaaggauuaaugcaacagacugggagaucuggugcuaauauguaguguguagguguaaauagguugauuauuucuuucuucuucaugauaagaaauugcauauaugaaugcuuuagauuaguccaugcuaccucacauuaggccuacuuuaaagcaagcauuuugauuaaguuggacuggaauuuuuccucugagauacaguaguugguaaaggugcaauaaacguggagggaggaugagucacguuuacaaugucuuuguuguaaccauaacucucuaaguuaucaaucauauauuuucauugaaaucauagaguauuuccuucacacucacuugcuuuucucuuauugcauuagaauuuuacuauaauuuauguuaaaaugggcuauccucgccuaccaguggaaaaacaaugugaacuggccccuacgcuucuuacugccauggaagggaagccucagccacagcaggauagguaugauuuccucaauuaacuaauuucccuccuacaggagucaacaacugccuuucaaauauuaauucacauauuugguuuuacuugagcaaaugggaggucuugagcuguuuuagcugacaaauaauagaauuuuccgugguaccucaaaguuaccguuuuguuaauacuaucauaaaauuucuugaugugaacauugaaaaaugugcagaacuaacauuuaucuaagucugugcauuuuuuuggcuaguuaucuugaagcaguuaauuuuaugugauugcaaaaauuagaauuaaaaauccuuugcaucaaaacaauucuaucuuggaagauauaaaguuucacagugguuuuccuaaggaacagagcacucguuuguauuauuuugggaaguggugcggugaaaaggguuuuagauaacaucauuuguuucuaggcuuaggcaaaaguucuuuguucuagcucugucauagugagaaucaugaugaagagugcagaaauguagaggaaagagauggaguuagaucauguuuucaguucaccuuuuagagcauauucauuuuuuaaaaaauacuguaauacagaagaaguuuacaaguaaaauuaauagacauuacaaguacuguuuguaauuguugucagauguuuuaagaguaucaaaagguguuaaugaaaggaauuacugagaccuguuacuuaaauucaugcaguggaaauuuuaauguuguauucaaaauauuaauaugauugauuuuuaauuuuuagaauaacuuuaguuguggaaaauaauuuuuuuuuuugagacagagucucacucuguugccgaggcuggagugcaauggcgcaaucuuggcucacugcaaccucugccucccgagcugaaguguuucuccugccuuagccuccugaguagcugagauuacagaugccugcuaccauggccggcaaacuuuuuguauuuuuagaagagaugggguuuuaccauguuggccaggcuggucuugaacuccugaccucagaugaucugcccaccuuggccucccaaagugcugggguuacaggugugagccacugugccugaccgaaaauaauucuuuuuuuuuuuaauuuuuauuuuuuauuuuuuauuuuuuuauuuuuauuuuuguuuuuugagauggagucucacucuguugcccagguuggagugcaguggcuugaucucggcucacugcaagcuccgccucccggguucacuccauucuccugccucagccugccaaguagcuaggacuacaggugcccgccaccgcgccuggcugauuuuuuguauuuuuaguagagacgggguuucaccauggucucgaucuccugaccucgucaucugcccgccucggccucccaaaguacugggauuacaggcaugagccaccgcgcccagccuggaaaauaauucuuuuugaaaagacaaguaaguugaacuuuacuuaagguuucauauaaaaucucuuguggaaacuucagauauuaacacugagcccauuugauguauuuuuuucagguaauuuuagucaugagccagauuggcuaaaugcuaaucaucacucaauauacugagcuuucaauaaaaaagaauucuaggccagucccuagauuaggacuuuguaaauuaguaguguugaaaaggaaugucucuugcuuaaaacugccaguuuuuguuacgugauuuuuguuuugucuguguuuugcauguauaaaaaucucauuuuuuaaguaguugcaauaaauguaauuguuuuuucagcuuaaugcaucuuuuaauaccaacccuuuuucacaugaaauacccuguugaaucaucaaaaucagcuucuccauuuaaucuugcugagaaaccaaagacugugcagcugcuuuuggacuucaugcuagauguccuucugaugccuuaugggugaguuaaaaaauaaaagcaaccuuguucuugacugcuuuuacuacggggaguuaaguacuauuuuaaaugauuaaacucucacuaguaaaugaaugcaucucaacauccauuuacguuuacaaagauuuuuuucuucuaaacuucagcuccacugcuuaucggcuuuacaaaugcugaguugccauugugauuuuagacucuaccugccuaagaugaaaucagucuuuccccauaaaaauaguuccuguuaggccaaggugggacgauuacugggggcuaggaguuucagaccagccuggguaacagagcgagacucucucucaaaaaaaaaaaaguuucucuuuuaaauuuacuauuaaugcuaugaugguucucuuugccaccuagccauacaaugauaaauugucuccagcuuuucucuucuuuguugcugcaauaucauuugcauaaugccuccuuccuucuccuugcugugucuggaacucuucccacugcuaucaucuaguuuugccucuuuucaacucuugucauaauuucuuucccagcggcuccacuucuucaaaucucucuacacccccucucuaugcuuuucccgauuugcaaaacacagaucucaucaggcaacaccuuaaaauccuugguuucucauauccagucauuaauacacucaugcauuucaugcacgcuuauguguccuugcuguuuauuuuuaagagaacgccuuucugucugccuagaaugcuucuucaaaaaagaaagaaagaaaacaacaaaaagacacuuugaaaaacagcauccuggccaggugcaguggcucccaccuguaaucucagcacuuugggaagggggggccgaacagaucccuugagcccagaaguuugagaccagccugggcaacauggcaaaauccuauuucuacaaaaaauacaaaaauuagucagcccucauggcaugcaccuauagucccagcuacuugggaggcugaggcuggaguauugauugagccugggagguugaggcuguagugagcuaugaucaugccacugcacuccaaccuggugacagaacaaauacccugucucaaaaacaaaaaaaaaggaaaaaagaaaaaagcaucccaaacuggcuuaaaggucaacuccguuugucucugacaaauuucuugccuuagacagauauaacugcacuauuuucugugucauaaaaacacaaaacacccgccuauauggccacuguguguuuuugcugcauuguagacauuuccaucuccccuaguagauggugagccccuuguagucgagaccuauuucauguagcuuuggucucuggcauggagcccagauugugaucuacuucuggucuacuuauuuuguccaucugccagauaaauuuuuccaaaaugcuguuuucaucuucuuucuuuccugaucacaaaaguauguguacaugguaagcuaggcauguggggcuccauaucauuuguuucucaauccagaaaugagaguucaugcggugugaugaacaaauuuguucuccuccugccccucuuguuuggaagcccaauuuucugggccuucagucacuccauguucacugucaccaccuguuauaucauuucuuauuucucagcaguuucuuugcaucugauagaauggcagaugcuauuacauguguuagguuguuacugucucagcuuacuccagauggcagagacucgaucuuacaucuccuuauauuccucugucuuguguuuaggaugauguuuguuugagauagggucucagucugucgcccaggcuacugugcagugguaacucaaugcagccuugaccuccuggguucaagcaguccucucaccucagccuucugaguagcugggacuacaggcgugcaccaccacacccagcuaauuuuuuuguauuuuuuguagagauagggggucaccaaacuccuggacucaagcgauccucccaccuuggcuucccaaaaugcugggauuauaggccugagccaccacacccagccuuaggguguuuuaugcaguauuaagauguauuaacuuauugauugauuuacuuaaugccaccagucuugcuauaacuuagaaauaaaaaaacuucuuuuuauauuuguuaaaucaggaggcagccagaaugacaggugaugauggcuuugguagauaaaccuugaaauucagauuuaccuuaggaacaugauguaaccaagccagugauuccucacauuuuucuuacuaaugagaacuugggucauuuauauaauaacauuaaagcgauuccuuaagagauuuuuaaaaaauagauaaauuuaggaauugaaugaauaugacauguaaguaauguggaauaacuuacuauccuaucagguucuaaguguuuucuugaacuuuuauuauaguggauauuuuauuauaauauccaauaugauaauggaauuuaucaucauagaucuuuaguuuuaagagauuugaauuaauauuuauaucaaaaacuucauuuuguagaugaguaauaccaguuuaauuggaucaaaaugaauuucuuagaggucuuauuucuccucuauagaagcuaaaaugaaauagggaugauaaauuaaccaaggcagugcaaagggcuuugaacauguaaugggaaaagucaguucuuguguaacuuuucuucuuugggcccuuuugaguuuuuucauuuuagggacuuuaugugcuuaugugguacgugcuuaugugcuuauguggccguuuggagguuucaguggauuuucuaauguagggauaaagaccucaguucagggaggauugaaggugaauuacaacuucguagaaaugagaaugacuguaaaaauacucuccuuuggguauagugcaauagcuccucccaguccccuuugucaacaaacuuuuccucauauuuggcagcucaaaacucaaaaugugauucuggaguagccauuagagcaaucauuuauagauugagagugaugaaaauauuuauauucauuguugguaaugguuguaguucauuuguaaccaaguuaaaugacgugcucucugguuaauuugcugaagauacaucuuuuuuagauaccuuaaaauuuuuuuuaugaugaaauuuuaauuucaaguguucauucuucuaguaaaauacaguaggaggacaguauaugauugaauguuuuguauacauauauaguuguaaaugcuuuuguauuuauagaggguuaaaguguuauuuccuuuccaguuacguguuaaaugaaucccagagucgccaaaauucaucuucagcacaggguucuucuucaaacaguggcggagguucuggaaucccacagccuccuccgggaaugagcuuuuaugcagccaaacgaguuauuggugauaacccauggacaccugaacaauuggaacagguaucacacaaggcuugcucauaauaguaguugauuguggacacuuuccccuaugaaguucaugaaccguauaaaacauaauucuaguauauucaggcucuccagugaaauauguuugaaagaagcaguugauguaauguguucuuuucaugcuaguuauuuauuaagcccuaggggcagggaggagugggacauacuguuuaguuuuucuaauacugcuuacauaugucaaguauaaagcacaacucacuuauaaauugaauauguuuaacuuuugucauuuuauuuuuuuuuauuuuuuaacuuuuguaauuuuaauuuuuuaauuauagguuuaauuuucaucuagcuuuuauggugcaguuaaaauacaauuuuucuuacauuauucaacuuuuaagggcuguacguuuuauguaaagugaggagccccagcacuucacaggugacaauguggggaaaagcaugacucccuguuauauuacuucuugggaauuuaaaaauuggcauuaaggauuuuauucuggauuuaaacaggacacagauguucucugagcagcuuuuaaaaaugacuggugcucuacagagaaggugccuuacugugucugugucaucaggcacuucagggaagaacagaugagaucaguauguaauuauuuuggaauucaagcaacauggguuagucuucuaauccuuccuuuauuucuccauggcagucuaaaugauuugaucccuuuuuuuuugggaaauguaagugaccauugauuaaaacaguauucccaggagaggggaaaagaggcaaguggggcauucuugccauucacaaauuuauagaauguuuuauugagugagggauauaauugauuugauuuccuucuucauguuuuauggaucuuuuuuuuuuuuccuccuuaaacuauuauguaaguaagaaagguaaagaauuaacagaggccgggcgcaguggcuaaugccuguaaucccagcacuuugggaggccaaagugggcggaucaugaggucaggagaucgagaccauccuggcuaacauggugaaacccuguuucuucuuaaaaaaaaaaaaaaaaaaaaaauuagcugggcgugguggcgggcgccuguagucccagcuauucaggaggcugaggugggagaauggcgugaacccaggaggcagagcuugcagugcgccgagaucgugccacugcacuccagccugggcgacagagcaagacuccaucucaaaaaaaaaaaaaaaaaagauuuacugaagcuacucuuuauugagugcaaucuaugugacaggcaccguaccggguacuuugaauacaauaucucauuuaacccucggagcaacccaguaagguauagaaauuguuaguuccauuuucugaaaggcauggagguuuugagauuuaccagggucucacuuuuaguaccaggcuuugaaccuaggauuaucuaaggguuaaagcuacaaaugcuggagaaaaauuguuauuguucaauuacaaucuuaaauuggucauuauuugccaauaugccucuguauguguuuugucaguuucauaaucuagugcugaaacgaacaguuuaguuucagggaugaaagcuauuuuccucuaauuuuaaaauaucucuuuguuuuauacuuuuucuuccaaggaaaacauguuuuuuccaauuauaaacaauguaaauauucaaguaguuaagaauaguagagaaauuaaaaauuaaggggcugggugucguggcucgggccuguaaucccagcccuuugggaggcugagguggguggaucacuugaggucaggaguucgagaccagccugagcaacagagugagaccccgucucuauuaaaaauagaaaaauuagcugggcgugguggugcaugccuguaacccuagcuacuugggaagcugaggcaugaaaaucacuugaacccaggagguggggguugccgugagcugacauugugccaugacacuccauccugggcgauagagcaagacucuguguaaaaaaaaaaaaaaaaaaaaagccagaugugguggcucaugccuguaaucccagcacuuugggaggccauguugggcagaucgcuugaggucaggaguucgaggcuagccugaccaacauggcaaaaccccaucucuacuaagaaaacaaaaacaaaaauuagccgggcauggcggugugugugccuguagccccagcugcuggggaggcugaggcacgagaauugcuugaacccaggaggcagagguugcagugagccaagauugcaccacugcacuccagccugggcgacagagggagacucugucucaaaaaaaaaaaaaaaaaaaaaaguuaacuggaauccugucacacuaguuugucaucugucuacaguuuugcucugugcauguguguguguucaccguuuuaaacaauacauuucuacuugucauguaauacauuauuuguaguuugcuuuuuauguugaauaauauuuuggauuuuuaaaaaaguaauucuuuuuaauguuuguuuacaauuauaugugauauguuuuaaccagucuccuauugauggacaucuguaucauuuucaguuuucuuuacacauuuuuuguuuaguuuauaucuuuguguacuugacuuccauguguccuuuuuguggcuguacaaauguuugaaucuuuucuguuguagcuguuguuaaaaguaaguuguaucgagcaggggagggaaggcaggcccuuuuuugaucuguuaugcuuuuuuaaguugcauuuuuuucucauuuaauaauuguaaacuuuauuaauccuaguauauguaaaaacuguuaugugacugauuuuuuaagaugaaaaugaaacuuuauuuuuucagguguauuuauccuaaauagagucauuuguagugaaauucauagcaucuucacauugcaugaaguucuaagcagaaucucucuagucuguuucauuucagccagucaauuaaauugaaaacuguuugauuagaauuucacuugcauugaguagcuaacauuugaagucauauccuuuguauguaagcaauagagugaaacuccauggaaugugaguuguuuaguucuuuuuugaacugucagaaaaauccauggagcacuauauuccuaguguaccacccucuuaucuggaggccccaaauuuggacuucaagacuucaucacucuagagaggcuguguaaccucacuagggaggcuguguaucauaauaauuuuggagucagagaggcuuggguuugaauccugccaucgucguuuaccagugucuuaaucuuuuaagccuugccucgguauuuuuagcuaaaaaauggguauaaugauugauuuauuauugugaggauuaagugaaauuaugaauauaugugcuuuaguacaguccccggcacauuguaagccuaaguaggagcugcuacuguuguuacugcucaucuuuggcuugugaccacacugauauguuaagcaguacuuucaguggguguccuuugcuccccugacuguucuuucuccuucccuucauuuaucuacagugcaaauugggaaucgugaaauucauagaagcugaacaggugccugaacuugaagcuguucuccacuuggugauugccucuagugauacacgccacaguguggcaacggcagcagaccuggaauugaaaagcaaacagagguaacuacuucccuguaaacuuucaagauugaaaggacuacauuucuaaaaacuuacuugacacauuuuuuguuuaaggauuuuuuguaaugaggcauucaacuuagaggagauuauuaaauauaccuaguuuguaaucaaguuugcuaaagaguugaauucuguguaagacagagaagaaaaucuguguggagaugcuguuuauagcugcaauagguuaggaaugucaucacaaucaaugagacuuuuggcuagguagaugaacuuaaagaauugauguuaagaaaagugucaguuccaagaaacuaauuuuuauuuuuuucugugucucaaaccauucgagauuacuuuuaauaaagacuauguauguauuaugguuaauacagugaaaauuacauucaugaaaagaguugcugaauagauucuaauucacacacgaggagauacagauaggaaauagacuuauagaaaauauucuguauaagaaauaaagucaaugaaaaauaaaugaaugaagucaaugaaaaauaaaugaaugggauaccaguagcagugguuaaacccauuuacguuucuauugaaacugcgauuuuuauuuuuauuuauauauuuauuuuuugagacagggucucucucuguugcccaggcaggagugcaguggcacgaucucagcucacugcaaccuccaccuaccagguucaagcgauucucaugccucagccucccaaguagcugggacuacaggugcuggccaccaugccugccuaauuuuuguauuuuugguagaaaugggauuucaccauguugcccaggcugcucucgaacuccugagcucaggugauccacgcagcuuggccucccaaagugcugggauuacaggcgugagccaccacgccuggccaaaacugcuauuuuuauacccuguugauuggcauuauaaauugaaaugaaguuuuggaaagcaguuugcaauaaguaaugaaucauaaagauauuucuauccuuuuaucucaauauucugggaauuuauccuaaggaaauuauucaaaagcagaaagagauuuagaaaaauuuuauagauuuguucauuauaucauuuucuaucauuguuaaaauaugaaaacaaauucaguuuuccauaauggggauauaguuaaguaaauuacuguauguaucuuuauggaauauuauauauuugccaaaauaugaaugaaguuaauuacuacuaaguuuuuaguuuguuuuacuaaaguguuuguuuugucugaaaucucuaaaccacaaguauuaugaaagaaaagcaacggcggagcuugaggauuaguuaguagcaaucagcugaggaaagauguaggugaaucauaucuaaaacagaauuguagaaugccucugaggauagcggaauuguggcuauucuaagaagaagcauauuuauaaacuaugaaagaagauaaauccaaaaagcaguuaaaguagcuucaucuguuguguuugcacaaacacaggauagcuugaaagcagaaccaaugucaaagggcagagagaauauaguaugguaaaccagucaaaugaaaggaaggauuacauuauugcuagguuuaugaaaugagugggugggaucugcugcagagggugggaacgaaucaccaaucaucuuuuuuuuuuuuuuuuuucugagacagagucuagcucugucacacaggcuggagugcaguggcacaaucucggcucacugcaaucucccccucucggauucaagugauucucgugccucagccuccugaguagcugugauuacaggugcacaccaccgugcccggcuaauuuuuguauuuuugguagagaugggguuucgccaugcuggccaggcuggccuugaacuccuauccucaggugauccacccgccucggccucccaaagugcugggauugcaggugugagccaccaugcccagcugucaccaaucaccuuauaucugaauucaccuuauuguggggcccaaauagaauuaagucuuagugacugauagcauaacuacucugcagaauuaaaacugcaaguguguacugguagauaaggaaggagggggaugcugggaaucacagugacguuagagaaauacgguggcuugcaagcuuccuagauguggcuuuaauuucauggguaaaaauuuuuuugucacuuuccuuaucacuuuugaacugccaaaugguuaaacagacgaauccuacccugccccaggccucuuugaacaaguguaguaaagcucugcucuguuggaguugcuccaugccauuggccugagaacccaucuauguaggaacaguguccaguguucuugugguaccaaauugugccauuggauacaauaaucuguugagucugggugggauaagugauuuguauuuguuuugguuuaaaaacauacuuugauagaaauuagucccuuucuuuuccuucucuucuacaaugucaauugcccauuucauuuguguguuucuaacauuuucuuuuguuaagaaauguuggggcuauaauuuuuuugaaaucacugaaggagggggaaaaauaauuuuaacaaccuguguugaaaccuuccauagcuuaauugacuggaauaauccugccaucauuaauaagauguacaagguguaccuuggagauauaccacugaagacaaaagagguagguuguuuugauuuauucucacaucagcguaaaaaguaguuuguugacaugaacugcguauuuauacauuuucuucuaguuucauuuaagcugaaucugugcuauaacaaaaugcuaguuuuaagucaugcuaguuuagaugaauuaaaaccugguaauuuaguuuacuggaucuuguguuguaaauucagauuccuaaauaacaaugacaaacugucuagaguagggauugacaaauuuuuucuguaaauuuuguaggcuuugcaggccuuauggucucucagguugcagcugcugaacucuuguaacaugaaagcaacuauaggcaauacauaaccgaaugagcaugguugugugccgguaaaacauuguggauacugauguuugaauuuuguguaguuuucauauauuacaaaauauauuccuuugauauuuuuuaaccauuacaaaauguaaaaaugaugcuuaacucauagaccuuaucagaauaaauggugggccagauucggacugugggcuauaguuugcagacuucuggucuagaaucuagaacaaaagauagguccuucuaaagccucaaaguaagaccuuugccuuacuaacgugaguucuuuuuaguucacuguguuuaaaaguauuccagguccaaacccagauauacaaggauuauuuguuugcaugcuugcauucuugcucuuuuuuguuugaguugggguuuagcuauguugccuaggcuggacuugaacuucugggcuuaagcugugcuccugccucagucucuugaguagcugugacuacaggugcacaccacugcaccugucugccuuuuugcuuuuuaaaccauaaauacuuguuuuaaaaaucaauauuagcccugguuagauuagauugagugugguaaagcagaaauaacaaugaauugggaaucaggaccuaugaauucuagccccaaauggcuguacacaugaaugugcuggggaggaaagguuuggcugaucacauaacuuuuccuggccucauguucuucauguagaaaaugaagggguuggauuagauuagugguucucacagugugguccauggaccuuuuuagggucacaaaacaccuuuuaggcagucugugaaggccuuuucuuuuuguacugugucaauauuugcacucaugguacaaaagcaauggugaguguacuugcuagguuccuaccacauaucaaagccaugucaccagaugacuaacaguuauucuauucuucaguguuauguacucauuuaaaaaaaaaaagagaauaaaacucagcuuuacuuaagaacauccuugaugaagcaguaaaaaugacuuuacuugaagaguagacaggcaaauuauagcuaccgagauggguauuuggugcauacuuucucuaaaagggaaaaaaaugagcuuguuacuucaagaaaaacaacaugauuuauuggcaaugauaaaaguuagcuuucaagcaaaaauuagaguuuugagaaacuuguauucaccacagugauuugauagcuuaucaguacuuaguagauuuuucugaugccguuagaacacaggugauaugagcacaggcuuugugaaaaaaaauguauguaugaagaaacauuugcuuaacucagugagccaguauugugcacaugaagaaugauguuacaaaagcauauaaggacaagggagccauucagaguaagauaaccaguggaauauaguauaagaguauacaaaaguucauugauaugguuucaacuccaaauugcaacuaaccuuuuuuuuuucauuuuuuaaaaauaagcaauuaacuguuaagaaauuauuauuugucaaguuuugguguaguaugaaaaaagaauguccacaauuaccuaagaaagcuaaaaucaucuccacuuuuccaaccacacauaucugugcaagcgagguuuuuguuacuuauuucaaccaaaacaauguauuauagcagauugaauacagaagaauauauaaaaauucauuucucuuguaguaaggcgaacauugaagagauuaguagacaauguaaaacagugcuucucccucaguacaauuuuuuuugcuuuggaaaauaguuauuuuuuauaaaaauguuaguuuugaaaauaaugaguuuauuaauaauugugaguaaacaaauauguuaaaauuucucaguuuuaauuucccguauaguaaauauugauagguuacacagauauaaacagaagcucuuuggagaguucaguaauuuuuaagaguguaaagggaucuugaaacaaaguuugagagaccacugauuaagaugaauucucaugacauuuucaguucaaaauaauuuugaauugcugaguuauaaucaagcauauuuucaacagggugcaguucugaagccagaguugaaaagggacccugucaguacaagagucaaguuaaagauugucccccaucuccuccgcucuagacaagcugcugaaacguucccagccaacauucagguaauuuguuuuuuccagagaauauuggccugucugcaacuuuuaugucuauuuaauuagagaaagaacuguguuaauggauauucaguggguagguugauguauauaacaagauuaaugagauucuuuuuuucuaucuuaaauuugcugcaauaugauuuuaaaaaaauuaucagaaaauauauauagguugagcaucucuaauuagaaaaucugaaauccuaaaugcuccaaaguccaaaacuuuguacugacaugaugcuccaagugcaaaauuccauaccuggucucaugugauggauugcauuaaaacagucaaaacuuuacuucaugcacaaaauuauuuaaaauauuguauaaauuaccuucaggcuaugugcauaagguguauagaaaaugucagugaauuucaucuuuagauuuggguuucauccccaggauaucucuuuauguauguacacauauuccaaaaucugaaaaaaucugaaaucucaaaacacuucugauccuaagcauuuccaguaaggaacacuuaaccuaugcuauauuggcuuccauuuaucuuaaauguaugguaauaaucccuuucagacaagguuuuuuuuuauguguggcuuuucuccaaaaaugguaucauuagcaacuuagucacuuaagugacaaagcugagucauccuuaacugaaagcucacuugaaggcaguggccaaauccucuugauuucaucuuaaugucuucacuucucuaugccuauaaugcugcuauuaauucaaacuauuacuucuuguuuugguuauugcaguauucuuuuaacuuaccuuccugccucuagucuuggcccacauucagucuguuuucuuuuucauugcuuuuuuuuuuuuucugagacagggucucacuguguugcucaggcuggagugcaguggcacaaucuugucucacucagccucuaccucccaggcugaagugauccuuccaccucagccucccgaguagcuaaaaaaaaagucuguuucaaauaauguagcacuugauuauauuuugucccauaucuuuuugugguuuuuuuggagacggagucuuucugugccacccagacuggagugcaguaguggugugaucuaggcuuacugcagccucugccucccaagcucaaaugauucucccaucuccaggccucccaaguagcugggacuacaggcaugugccaccaugccuggcuaauuuuuguauuuuuuuguacagauggaguuucacuauguugcccaggcuggucuagaacuccugggcucaagugaucuuccugccuuggccucccaaagugcugggauuuuuuuuuuuuuuuuuugaagugagacaggaucuugcuauguugcccagacuggccuugaaugcuugggcucaagugauccucccguccuagccucccuaguagcugggacuguaggugugagccaccaugcuuggcuauguaucauuuuaauguguguaucucuuaacucuucaacaagauugagugcuuguucuuuuuuauaucucuuaguaccuagcacaguggcaauuauaaagcagauacucaauacuagucuguaacucacauguuauuguuaaauaagaucagaauacugcuggcaguuuuaggaacaagaguauagaguuuuuuuuuuuuuuuuuaguguaaguaaucuuugucauaaaaaggaacuugagggauuuagauauuuuugauguuguugguuaauauugaacuugcuggaugcugcacaggacucaucugcaugaucuuuuugccuucuagaugugguuccauaauacuugaagcaccuuuaccccaaugggacacuuguagaauauuuccauuuguauguuuucucugaagcuuuuauuagaauuuguccugaaucauauaauuaagaaacauagggaauagcugaguggugacccacugcaguguguacucuucguuuccucacugugguagacccacaaucuuugcagacuugugcgaucaaccauuguguuuguuacuccacagacuauuuauaggagcuucugauuggcuuucuaaguuggucagcuaauaauguguaucugcauuaauguugaagaacgagauguaguaugaaaggucugcugcugaauucugauuacuauucaaaaauauuaaauucuuauuuuuauuaauugauguucucaacucuucauuuuacauaggugguguaugauggacuuuuugguacaaauacaaauucaaaguuaagaacauuaucccugcaauuugugcaucauauuuguauaacguaagucuuuaacuauuuuaacuauaaaguuuucaagcugcuggaaugauugagugcuucaaguguaucguuuuacucaucuuaccuagaaagaaaacauguuugcucaucuuuaaaaauuuuuguauuuuaauagauuauuuaacuuauuucgguuaugucucucauuauuuuauguaaucauccguaaagauauguagucaugagauucuuaucuugcuuuguguauguguguuuuauuuaaagcuguccagaaaucaagauuaagccauuagguccaaugcuuuugaauggccucaccaagcuaaucaaugaauacaaagagguaagugacuugucuuuuaaauuuuaucaacauuuuauaucuuaaaguauuuucuauaauauuucuggucugucaauguaguuaguuaaaaguuuguuaaaguuucacuguuccuuaacauuuuacuugaaauaguacaaauuucagaaauuacugcccuuuuuugcuuuuuuggggggaaauaacuguuaaaaacugauaugaggucuuacuauaucuuuuuuuuuuuuugagauggaguuuugcucuaguugcccaggcuggagugcaauggcaugaucuuagcucccugcaaccuccggcuccugguucaagugauucucuugccucagccucccgaguagcugggauuacaggcaccugccaccaccacacccagcuaauuuuuuguauuuuuaguagagauggguuggccaucucuacuggccgucucaaggccaggcuggucuugaauuccugaccucaggugauccgccugccucggccucccuaagugcugggauuacaggcaugagccaccaugcccagccugcuguaucuuuaaauagcauuuuuucagccagcaccuuuugugcuacuucuagcuauugugcaaaaauggaauuaaaggaauugaaauuuauguugauuucccuaugugacuauuuggauuuggcuuguguugggaaacuguuaauucucaggggcuaagauacuuuuuuucuuuuauauuuuucucugguaaauaauggggcugagauuuuaaugauucaaaauucugucaaaacaugcauucaguaaauuuuugauuccuuaagcuaaaugggaugaggauuccuuggacuguggauuuuugaaucccuuucccugcuguauuucucuuacuauaauaucuccaauauuuaaaaggaauuugcuuaaaaagguaauauuucaagaauucauuagcauuauuuuccccagucuaagcuaaacaugaaugcauguuugcaguaguauagugagaucaagaucuuacaucugaaauuagaacugaguuugaauccuaguuuuguucuuuggugaguuacuuaaauucuuugcaccuucuuauuagaaaaaugaaaauaauacugcuugauuagauuacugugaagauugaaugaguuaaucuaccuaaauuguucaccauagucaaggcacguuaguagguauuauuagugaaaggcacuuuauuuacugugcagcugugcuuuggggugguaaguaggccugguucucauagcuucuuucuccuauugagugaugcuugcaugguuaagaucuaggggaccacucagauuauuuuauggcauagauggugaaaugcuuuagagucauugguagaaaugaaaauguucuggggcucuuggggagaagcuguauauuuaaauguaaguuagagaggccagacaaaccacagggugugaguccccuuaccugcaggugacaucugcaugucuucccaacagaugaauccauaagaguagccauuuagauguggaagggcaaauccuaggauaaacacauaaacuuuaacugguagaaguuuauuguguucugaguaaucagauuauuaguuuuuguaaaaccauguaaaacucuaucuguaucuugaggagagaaccucacuaauucaccuggugauuaugacccucuuaauuuuuuaugguagaaaauaugauagaaagcuguucauuacaguguagauuuuuagaagaucacacuacaguuuauugcaauuuuggugagagacggaggauccuagucuguuggaccggugauguauuuucuaaugaguuaauguuuuuuaguguguugaagaugaacuuugguguuuggagguuacauaguguugaaauaucuugaacucagcaccagcuaagagaaaccuuucauaucuaugaccacugcauuuucuuuuuggagcgauuggggaugcaagguuuugucuuguuuuuccuuuuaguuagugugauggauucuggguuuggacauuuuuguuguuguucaggugcuaacaccauguaguuagacagagugagaccuagguuuaauaaggaguaaaauaaugcauguaauugcagcgaaaagguuuuacuguuuacuguauuuuuuguuuugucuguuuuuuguucuuucuuuucuuucuuuucuuuuuuuaauuucaaggacccuaaacuacugucaauggcauauucagcuguuggaaaacucuccaggugaguaaacucuuuuuuagugagagauaugguguugguaaacagagaaaaauuauguggcauuuaauaauggcggagaauaaauuugucgugauucugaaagggaauguauuuaauggucauagguuguuuagaaaugucuucuguguagaaggaaaaagaugugagacauuuuaauuuacauuugaagguauguuacuguauuaaaugguggucuugaaaugagaguuugaacuuaauugugucauaauggguuacuuuuuuuguacccuagagacuuuugauugaccuuaaguguuuuuguugcuacuuggcacuaaucuuuauaaacccagugaucaagguuuuucuagugauucucuuuucugagaaugguguuuaugauucugaguggcccugacagauuuuuuuuucuucucaaugugauuuccucauuccaguuccuccuggcuucaucuuccuucacuguauuugaaagcagggagauagagaugaagcauucucaguggcaccaugugcugcuuccacgcccagugcagguuuuguguuggccuguguagaccaggucuugcucuucucuacagugaaaggagcuuugggguuuggaagaaagccaccccagaucaguggauauagugcaggguugucagccaaccuugucccuugucuguuggcaugaaguaacaaagccccuuuccacgacagucauuaguuuagaucacaguuuggucuuaccuaauuucuucauguuaaaaucagaaauguuaacugaaugcauggaauauuauagaggggauauuuggaagaugugcguguuaaucaaggguuauuuggauuaaagaauuaaauacuuggaaaaauuuuuggcucucagagcggguaaugaugcugacauugucuucagagaguucaggaaaauuuguguuuaguuucauuuuuucccuuuuucaucucuuggaaauuuaugauaguaacaauauuuuuacauucuuuugcagucggaugccacauuuauucacuaaggauauagcgcuugugcagcagcuuuuugaagcccuuugcaagguagggaaacagcugcuaaguuuaugcuuuguguuuggauguuccccugggaacccaacaaggagggaaacauuuuuaucaucuuuauaggaagagccugagacucgacuugcuauucaagaagcuuuaucuaugaugguuggagcguauaguacuuuggaaggggcacagcgaacucucauggaggcacuuguggcuucguacuuaauaaagguagguccgugugaacuacaaagccuggguaguauacgguuuacauuuuuaagaacaaaauuugaauugcuacuuaacuuuugauaagaggaguauuugcuuucacuugggcugugauuuaggaucuauuuuuaauucuucaugaugaaaauuugacuuuaggggagaaggagugguaguauucauagcgaugcuuauguuuagagcuuuccaugugggaaaacuauucuuaaugccauguccuccgaguuagaaguguuuugucuuuguaacugguagcugagcacuacuguccgcugggguagaguuugauagguaacauuuucagagaaaagcagaagggaugaaagacaaauuccauaugucaaagugagucuuuaggaagugagccaguacuaucauacaugcucuucuuccucuuuauuugguuuucaugggaauuuguaggaggauuuugaauaucuguagauacacacacacacacacacacacacacacacacacacacacauauauguaauauguaauauauauuugcuuuagucaguucuuugucccacauuuuuaggaguagaaagggagauuggaagacagaaugauacuaaaaagugucagucagauuaauauaaauuguguccuaauggaauuagacugacaugauuuaauauuuugagggaauuuuaaauguucagaaagguaucugcuuccuauuaaaauaugacaggguuaaaugugcuauuauauacauucagaaagcuuacuaugauggaguccuauugucaagugcucuuagugugcagugcaugugguucauggucauauguuauggacaaagguguguaggcguauuuggaagcucauuagaacagaauacuuuaaacuuucucuagguaacuuuacaaggaagugugaugcuugaauaaacacagauacugguucuacgcacacagaucaaaucauguaacacuauuaccaagacaaagcuaauuucuuuucacagacaacauuuaaagcaaccaaacucuagguuaguuauguaauuuaggcuagucuuuaauauccucacucuuuaauguaguucaaggacugcuaaauagcaagaaugccagaaugagugggacaauauauauauuuuuaaugucucucuuauuucacuuauguuuguggcuagaggagugaccuggggaagguacguaagaauaaagcuucaggaucaguagauucuaaaacuacuuuucugguugaacuuuguaguuacagauuauuaaucuuaguuaauugaauauauuucuguaguugaaacugcuuugagcuaaucugagaagcucaauuugaaguauuuagcuucaaauugguggggauuccaaguaggcucuguuuguaauuucugccaaauaccugacuuucacucaugugacugacaguuugagaguugggguggcggaggugauggcuagaaacugucacagugaccguggucccaagguuugggcugaggaugcgcagagauucucuaguuaugguccuuggaggucuuccuacuucaccuggaggauccucuaaaauuauaagaauacucuuuaaguaaugccaccauccaaaagacuuaaacaacaugauuaaagaucuugaacaaaugauuuauuuaauuuagauacacguuuauuaaaaugucaccuuagaauuuugaauuguuuacaguuaggaagacucaucuugauuggaaugaauggcugguaauugauuuuuuuuuuccuuuuucggaucgggguggucuguguauguuuacacaugaaauagccugaaguucaaguucgacaaguggcugugaaauuugccaguacgguguuucccucagaucauaucccuuccagauauuugcugcuacuggcugcaggagauccguaaguuucaaaagguguuaauuugaauuuugguuuauuuugaauuuauuugaaaauuacuaaaaguuguauuguuuacaauguuggucuaugaaauuuagaagcuauuuauuaaagaaaguauggcucuugaugugauauagaccuguacucauauaccuauauauuuauauaguaauauaaauauuacauguauauaucuauauaauauacauuauguagauauauauguguaauauaugauauauagcuaauacagaaaaugguuaugaaauggucaaguguaaauaaagcaaauuauaugauugcguguguaauauaauuauauaucuaaaaacaagcccuauguaaggagaaaaaaggcugauguugaugguuugacauauguauuaauauuuuauuaaauauggaguaucauuuuauaucuaauauauuuuuaaaugagguauaaguugcauuuuauauuaaugaauuauacuacugcauuuucuagaguguguaaugcuuuuuaaaagaauguuuaaaugguuuugaaauugggacaugccuuuaaaagucauguacauauaaugaaauauauguggacauauuaaaacaacucuuuucaaaucuguuauaugucuuacagucaaugccaucuuaaaauccaugcagcauucuaaucuauuucauaauaaaccauuacuacauuuaacguuuagaauuuuugcaucccuuaagugagauucuuguauauguuuuucuuuuuuguuaucagggauagccuuauuuggggagaugaaaagcuucauuuauucugaggaauaguuuaaauaaaauuaugcauucugugaugauuugaacacccuugcccauaaacuuuuaugguccauuuuuuaaaaauggguaauuccuugauaacuguuucaguguucuaguuggccagcugugugccccucaugccauuuauuuucuuuacuauaaguuguauauauuuugcuguuauuuauuugguugguauuuuaauuggacaucacaaguuauuaccaggugcugguuuuugacuucugaucuuggcugcugcuucucauagagcacauuucaaucugguuaaaguggcuuuggauuguuaauguugauucuggugcucuguugcuucuuaauuuuuuuacguuaguuucccaaccaaggccagauguacuggggccuggcagccaaggugucaguucauguuagagcaaggauuuaagucuagggaguuggacuuccaaauagagcucuuaacugcuguaucuuacucuguaagugcugaaaauuguuuuuguuuaagaaaccaaaaacaaagcauaacuaauucaacaguuuuccuucuuagguuagaaccauucaggucaaaugaaaauccucugacaacuuaaggaauuauuuauuaauucuuucuuuucggcccuuuauguguuguuuggaaaaugagacacaaucagaggcaauugaagaauuaaaaggccuuuaugugguaucuggauaagacuauugcugagaucagucucuagguggucugaaauugguuggguuuauauuuuuacacuuuaaugucacuuaugaguuauuaguuguacagaauuguagcugaauacauagagauguaagacuuuggguggaguguguagaccacuggauagucacugacuucuaaaauauguauuauaguuguuuaugguuuaacucuacgagguaaagcauacacauagauauuuacauaauaauuuacuuaaaguacccuaucuuguuuuuuaaugugagucaaauucaaagauguaagccagaugaguccccggaccucaugcaauuucugaaaagaagugauuucuuauaauguguuauguugacucugcuuagauagccaagaauguauuuaagacauuuucugagaacucuagcugccaaauaaaauugcuguucuuauucuucaaaugaucauuucccauuggugacauuuauuuuuuauucuuauuugucuuuuucugaaagacgugaagaaguucauggagaagcacaacgcguauuaaggugucuuccagguagaaacagaaaagaaaguacuucugagcagaugccuuccuucccagaaaugguuuauuacauccaagaaaagguauggcaugcaacuuaagguaauuagucuaaaucauaauggaugaugaaaauaaaaacaucuuuaaagugaaaaauguaaucacuagauguugacucauaaaauuucuuuuucuuuucuuuucuuuuuuuuuuuugagauggagcuucgcucuuguugcccaggcuggagugcaauggcacggucuuggcucacugcaaacuccacuaccuggguucaagugauucuccugccccagcuccugaauagcugggauuauaggcgccugccaccaagcccgguuaauuuuuuguauuuuuaguagaaacaguguuucaccauguuggccaggcuggucuugaacuccugaccucaggugauccaccugccuuggccucccaaagugcuagguuuacaggcaugaaccaccaugcccagcugacucauaaaguuucuagcauuaauacuuacaauaagaagaagauacaaagugaggaaaaaaaauuguaauccucaccuguaauugaucuguuuugccuaaacuugaauuacuuauaauuccuuucaugcuuggcaacauuuuggcuguguuaaauauuuuuucccuuaauaugacaugcuuaaaaauacaucuccuuuuuuuaaaauuuuuuuauuuuuuuuugagacagggucuugcucuggucacccaggcuagagugcagugguguggucucaguucacuaaaaccuccacgucccagacucaagugauccacccuccucagccucccgauagcugggacuacaggcgugcaccaccgugccuggcuaauuuuuuuauuuuuuguagagacagaguuuugcuauauugcccacgcugguucuccuuuuuauuuuuaagggcacgcuuuaggguaguguaaguuuaaggaugcuucagggaacaguucauguucuucccaccguguucauaagagagcaucccaucugcuuuuguaaguuuuugcuuuugcacaguguuuucugcuaguagauccaggauauuggcaguaaugaccauccacccccuccaggccuugacucugucccacuuugccggaggacaccuuccuaccuuuuaccuccacuggugauccuagcucuuugcuagguaggcaccuuaagggaguugaaggucaguaugcagcggccaugauucuguuuuccacauagcagcacagucuauuuguggucagaagauucucugcuuguaguuuccuccuacuuugauuauuaaugaaaauaacuggcaugcagugaccugagaugaccauauuaguagaugucuggaauagguuuauuauuuuuaaacaaaccagaacaaacauggaaaaagggcaauacacuugucuuuuagugugugagggacaugcacgaucagcaugguuaauaggaaaguggaaaauguuugaucagaaaaagaagcaaacuuaggacauguagcuagaaacacaguuguuuuugaguugaggaagggcagguaugcuucauuuuucaguaauugugucuguuuuggacuuuuuaaacuuaggcuucucaucgaaugaaaacuccagucaaguacaugaccgggaccacuguccuuccauuuaacccagcagccuuuggagagguagaacuuucauauauuucuauuuacuuuuuguaaguguucuaaaaagaucacaccacacccaaagaggggucugucauuuuguuguguuuuagguaaacccauauuguggugucauuguucuucaucggguuguuuauuuaaaaaaaaaguauugggaaauugguauuauuuuaauucauagugaaguauguaaauauauuuaucucagugagauucuuuuugugaaaaaacuggauguucuguagugauuacuauugggauuuugcagcaaguuagauuuggguuuuaaagccaaccuguuguugagguuguuaggguuauuuaguuuugaagguuggagaggauuaaauugaucacacuuauuaagggaaauucuguuuuuuagauuauugacuugcucuagguaaauuacaagaggugaucuuguucggauuaagaauauucacagugaauuugcugccuauccuauuuuaacgaucaaugaaaaagcuuccagaggauggacuccuuggcagccuguuuauguaaggguuguuuuuuuuguuuguuugguuuuuuuuuuuuuugagaaggagucucacucuguugcccgugcuggaguacagugaauggcgugaucucgguucauugcaaccuugccuccugggcucaagugaaccuccgucccagucuccugaguagccaugacuacaggcgugcaccaccaccccuggcuaauucuguuaucuuuuugguagagauggguuucaccauguuucccaggcuggucuugaacuccugagcuaaagcaguccuccugccucagccucccaaaguguugggauuacaggcgugagccacugugucuggucuauaucagagguuuuuaugguguuauaucuauuuuucuguagaugaauugaacccauuuucucagauucuugugucaauggaguaaacacaacuggaauucugcaggaguaauaggccauuuacuucagauuucuuuccucucucucugucuuucucucucucucacacacacacacacacacacacacggcuuuuaaaaaauaaugauuuuuauuauaauuuuuaacuuuuauuuuagguucgaggguacaugugaagguuuguuauauagguaaauaugugucauggggguuuguuguauauacuauuucauuacccagauauuaagcccaauaccccauaguuaucuuuucugcuccucucccuccucccacccucucuccucaaguauaccccagugucuguuguuugcuucuuugcguucagaaguucuuaucaucuaacucccacuuauaagugagaacaugugguauuugauuuucuguuccugcguuaguuugcuaaggauaacagccuccagcuccaauuucugacuuuaaaaguucaguuuguauuuuaacaaucuuaaaaaauucuuuggauuugcaaaccuuauuauacaaauuuugcuccauuauggcauauuuucugccuuccaugaggauuggaauagcuuuauaaagaagugugggugaaucaaaacuagaaauuguuacuuugaagaguaccuucccacacugacuuuucgagaagcuuaugcagucuuccucuccguucuguuuguagaucguucuguacuugcgcaugugccuugcgcacagugcggggguggugcccaccucucagaguuuggcugauaugcaggaucaugccccagccauugggcgcuacauacggacuuuaaugucaagcgggcagauggcacccucaucaucuaacaagaguggggagacuaacccuguccagaucuacauuggccugcuucagcagcuguuagcagguguuggagguaggaauaugugacgcgaaggaaagauacugaagcacuuaagcaaaaaucuaauuuuaaacuuugcuaagaauuuauagcaaaauuauucuuuuucuucuguaacugaacauuagccuuuguuucuuuuuaaacuuaccugauucauucuggauacacuacuucuuuuuucggaaagaaaugcuaacaauagauaaauacauuuuuacuucggaaguggaugugaagaacaggauauccuuuuuauagauagcucaucuguaaauuugcuguagugaaucacauacuauauuuagguuguguagguuuucuuuuuuuuuuuuuuaauagaaccgaaagaaugugugcuaaagcaguggccuuauacuuuaaaggaauuuagugaucccuguauguucauuacuuuucuugaaauuuaaggugauucugaauucuuauuuagguuugccgguuauguacugucuauuggaagcugugucaguguauccagaaaagcuggcuaccaaauuuguagacaaaacagaauggauaaagguauguucugcauguaccuuuuuuuaaaaaaaauucuauuucagaccuuaacuucaugauuucuuuuuccugccagcgggaucccuaugaccuuuucugccuuuaggucguuuugaaaacucucuuaucaucagacacuuacugggaagcauguaggucacuaugucucauugacacaucuggaggagauugggagaugaauugagaagcauaggaguaaaaaaaaguuccuuuucuguuucaaaaguuuuuuuuuuuugaaaaaauaagcaauagauuuguguaguuuaaauaaaaacuauguaaaaugucuccuuuccguaaccaucuccaaccuacccaagccuucuaauuuuuguccuuuccucuccccucugacaaacauauauaagugaccacuuauauauggcaugcuuucuagaguuuacuuauguacauacacauaaaaacaugcauuuaaaauuuuugucccaucuuuuuaucaaaagcagcauacuauucauacuguuuuauacauucuuucacuuaauaguagagaacuauuccacuacaacuauggagagagcaucuucuuuaacagccucaguuuuuauuguaugaauguacuaucauguauucuagaucuuuauagauggucauuuagaguacuuccauucugcugcaaugaauaaucuaucaucuugcauauugaggaaguauauguuuuagauggauucccuagaaguggaauagcuguaucagaggacauguguuuuuguaauuuucauagguaaugccacacccuccgugugugguaccaauguacacuucuaacagucauguaugagggugucccugucccauggccacaccaaaagggaugccagguuuggaaaauaaaaauacaagauacucaguuaaauuugaauuucagauaaauaaugaauaauuuuuuuuuuuguauaaguguuggcccauacaguuuucuguaucuccaugugcuacauauugcgguucuuuuuuuggaaaauacagcuugaaugaugguaaaaauguaaaaauuaugucuuuaagugugaaaacaugaaugaaauuugccaggaggugugaguuuugcacauuucuggauagucuggucuuaugaaauugcuuuuaguuuaaaaagguuuuuuuauuucuuaugaauauugacugauuuuaaaaugauuuuauugaacuuugauguuuuagaugagagguugucaugcuauagucaaagguccaaauagggccugccuccuguuuuuguaugguuugcaagcuaagaaugguuuuuacauuuuuaaauguggaaaaaaaaaucaagaaacgaauaauguuucaugacacaaacauugucguguccauguuuuacuggaacccagccacgcucauucauuguguauugucuguugcugccuuuguacugcaguggcagaguggaguaguugcagcagagaccaaauggcccauaaagccuuuuuguuuuuuuacagaaguuugcugacccuuguuuuagaucaucugugaauaaauuucaccuguuuuguacuuguguaucuuugacgaaaauggaccuaagauuuuguuaucuaauucauucagcuuucauuuuguuuucaaauaauggcuuguuuuuuucucaauauccaucaacagauugaacguucuuuuaauuuuaaaagauguugucaucaggcacgugguucugugucauguauauauuuguuuuuuuuuuauacugcucagagucugaugaauaacaguaaagaagaaaugcgcgaacuggcagcguuguuuuauucuguagugguaucaacagugucggggaaugaguugaaaucaaugauagaacagcuuauaaagacuacaaaagacaaucacguauguuauuuuguuuucauucuuuuuugugggagauaggguuuuauaaaaggaucuaacuuauuuuugacuuuuauguucucauuuguaaaaugaacuuacaaauuccuugcuuuuaugaccauaaagaguaaaugagauaggugauacauugguucagucagcucacuuaacagauacgggugcugugucugauaagcacuguuuuaggugcuaggaguacagugauucauaaauacaugagaaucccugguacaacaggaugcucagagccugcagccguaccaccgugaacacaccuaaucucaucugaucuuggaaacuaagcagggucgggccugaugaguacugaaagcgagaaauguuagcuccuuuuuucuuccucaucuacugcugccagugaaaaaacaaguuuuacuucacauaguuuguugguuaccuuguguuuggagguuuuggcaauuagaaauaggaucuguuuauugucuuuuguuggcaauaggaagacauuaugugugaaaguuaugauauucuaguuacauaagugcuguaagcuggaaaguggcgugggagcauguaggagcauguaggaaagucaucucacccggaauuggagugggcauggaauuacagaauguaaaucuuaaagugaaucaagauucagcuucucaaaauuccguuagaaacucaagguuucucuuguucccuaagcucgaugcauuagcauccagugaaaccucgaguguucacuuuauucuuuagccuuauguuuuguuggagagaugauccuaaucgacacacaguuacugccauguauucuugcguauaugagagagagccagagauaugcuauuguuuuugcuaaauucagagcccggagauacagcauggauccuugcuugcauugggauucacggugggaagguauuuggcuaaaaagaaaaugagaaugucagagcaacaagaccuggagagaaaugcugacacccucccugaucaagaggaacucauucagagugcuacagaaacaauagguaauuaaugucuuuaugucgauuuggguguugcaguuuuugaauuauguuaaauuuuaauauggcguuucaguuucuuuuuauggcauuguauuugaaaagacacaagcuuuuucacaaaaaacuuacuugauaaauaauguauuuuuaguaacaacgaaggcugggugugguggcucaugccuauaaucucaguacuuugggaggccaaggugggaggaugacuugaguccaagaguuugagaccagucuagucagcauagugagaccuagccucuacaaaaaaauaaacaaaauuagcuugguaugguggcguguaccuguagccucaacuacugaggaagcuaaggugggagaaucacuggagccugggagguccaggcugcggugagcugugaucaugccacugcacucccgccugggugacagagcucgaccuugucucaaaaaaccaaaacaaacaaagcaaaaaacaaagcaaugaaagcacucuauuuuuuuucucuacauuuuuuuccuacauguuuuuauaaacagagaugauccuauuaugggaacaaauuuauacauuaaaaaaauacuacucuauccccuguuaccauguugucuuuccacugaauaaauguuggcaaauugucaacuagaagauaucguacacuuugauuuuauuuugccgucuuaaaaaaaaccuugaguacaucacugguugcuuugggucguaaggauaaugguauguaauucucuuuuuggcuaaaugugcuuacaggcucauuuuuggacaguacaucaccccuccuggcaauugcugccugcacagcccugggugaaauuggcagaaaugguccacuuccaauccccagugagggaucuggcuuuaccaaauugcaucuuguagaaagcuuacuaaguagaauaccuuccaguaaagaaacaaauaagguaaguuuuuuucuuauuuuuucccuuucuggaauucggucuuucuaugcauacaugagcaaaaacagauuauaaugagaauagauggcauuacagcuggaggaaggauuuaauguaaaaaugggugauaaagaagcaagucuuaaguguuuacuuuugagcuagagguuaucuguguacaaucuuagugugcacaucuuuuggcccagucauuccaauuuaggucuuuauaacuguuaagauuugagugaaguauuaaauucaucaggaaauaucuuuugucaugcaaaagguguauaauaaaauguuaaguaauuuugugauuuuuuuuuuauuuuaggccaaauauaaauccuaaccuccuaaagccaguuuugugaucaaaacaccucaauuuugagguguaagaugauuuaaugagcagaaauaucaguuuacuacuacaaguuuaauugauauaaucuuuuuuuuuuuuugagauggaguuuugcucuugcugcucaagcuaaagugcaauggcgugaucucggcucacugcaaccuccaccucccagguucaggcaggugauucuccugccucagccuccugaguagcugagauuacaggcgcacgccaccaugcccagcuaauuuuuguauuuuuaguagagaugggguuucaccauguuggccaggcuggucucgaacuccugaccucaggcaauccugccugccucggcuuccgaaagugcugggauuacaggcuugagccaccgagccuggccuaauuccuauaaucuuaaucuuggucuagcuacuguuuaaaacuuucugagaagauauacaguauaguuuuuauuagcuauuaacuaaucauugccaaacauuguuaagcacuucuaaugugccggagaguauguuaagugcuuugcaugcauugauugaaucuucuaaaaggucuagugaaauaggcacaguugucaucucuaugugagauaacaugaggaaacagagucacagaggggaaauaacuugcuuaaggucgcacaccaguauaggcugaaaugguugagaugugauuugguccuagguccucugggcccagaacccacauuuuaaaucguuauaguuugaaagguaauaagccuaguuaaaggcuuucuuccuucuucuuuugcagcuguggauccuuaguggacucacauuuguguguuucuaccuucaaugacuuacagacauacgacuguaaaauuugaugcuuuuguaaaaacuuuugcguugauguguuagauagacugcgcuucccugucaucucauuuuggaaauacugcacugggguaaagcuauuauauacucuguuuaaaagaaaaaaauuugguguucuuccagaugaaagaacgagcaauccaaacacugggauauuuuccaguuggggauggagauuuuccucaccagaaacuccucuugcaaggucugauggauucuguggagguauuuauauugcuaccugauuguuaguuauucagagaaaaggcauuggucuuuuuuuuuuuuuuaggugcaguuuugcaugcugugagauuuuuaauuaagcauuuacuuguuuauucaccagauacuugaguacuaguuuugugcucaucacugugcuagguauagcauugacuaaaucaccuaugagggaaagaccuuuucuuaaaauuuuugagcaaagugcggugcaguguggguagaaggggaaacauauccacauagcccgucagccagauguguggagugagccacuaaaaaacaguaguucuugaguguuucaguugguauuucaguuguuuucaagucugaugauuuagcuucuguccucuagaugccuaguguguaguggagaagaccuacaaguaggcaaaugccaagauacuguacuaaguaucucagcauggccugaucuggcccugcuuuuccuagccuugauucaugacauucacucacuuucuguauaccagccucuuuggccgccuugcacugagcuuuugaaagccgccuacuuccuucucggcuuguugcugugcuccuugaaaagccuucccugacccaucauacuaggguagauucuuuaguuacuugugccaucaugucucuuguucuuuuucuucacagcauuuaucacaguuucuaauggcccaccagacugaaugcagacucuguuuugcuuacuguuguaaaacaagugccuagcagugugauugguaauaguaggaccucaguaaauauuggcagacuaaguaaccggaugaagagacauuugcauguaaggcaguagaaucacaaaggaagguguaauucuaucaggaagaguuaguguaugucuuuggaggagagguuucugcugggccuuaaaugaugggagggagaagagauaauugaggcuaagggcugaggcacccgaguaagagaguugcuauuagucuggauucugaauucaguauuuuuaaagugaauuuuuuuagacaaucuacgucuccugggaugucauuaacauuguaaccacuuggagagaaacuuaugauagugguuuucucaucuuuuuccuuuuuugaaucccugagugagguggguuucuucuagguuuuuuuuuuuuuuuuuuuuuuuuuuuuuuuuuuucugagauggaguuuugcucugucucccaggcuggaguaaaguggcgugaucuuggcucacugcaaccuccaccucccggguucaagcgauucuccuucgucagccuccuaaguaguugggauuacaagcgcacgccaccacaccuggcuaauauuuguauuuuuaauagagacaggguuucaccauguugaccaggcuggucuugaacuucugcccucaggugauccgcccaccucggccucccaaagugcugggauuacagaugugaaccacugcacccagccuguuuuguuuuuuuuuuaaugaaggcucgucuggauucuuaacuuacuuuuaaugccauuauuuuaagaguuuagaaauacaugaaaagcuagaaauauggaaauaagguagagagauuaaaugaugagaauaaugaaaagcaugaaacggaagcagaauaucuucacagucgaauaggacacagugcugaagguuuuuuugguuucuuuuaacuguuuuuauuuuuuauuuauuuuauuuuuacaauaggaucucauucucucaccaaggcuggaguacauuacaucucccaggcucaaaccauccucccaccucaccuccuaagcagcugggaccacaggcaugcgccaccaugccuggcuaauauuuuaauuuuuuauagagacaggguaucccuguguggccuaggguggucuugaacuccugggcucaagugauccucccaccuggaucucccaaaaugcuaggauuacagacauaagccacugugccucgcccauuuuuaauuuuuuaaauugauacaagcauacaauguguaaugaucaaauuaggguaauugggauauccaucauuuuaagcauuuaucauuucuuuguguuuggagcaugucagauuuucccuucuugcuauuuugaaauauacaauaaauucuuauuaacuauuguugcccuguugugcugccaaacacuaaaacuuaauuuuuguaacuguauuuuaguucccauuagccaagcucucuuuccccguucuccaguaccuuuccuggccucugguaaccaccauuuguucacuacuuccaugagaucaguuuucucacauacaagugagaacauaggauauuugcucugugccuggcuuauuuuugcuaaauauaauguccuccgguuccaucuauguugccgucagcaacaggauuucauuauuuuuuauggcugaauaauauuccauuguguauauauaccacuuuuaaaaaauccauucaucuguugcuggacacuuagcuugauuucuuguuuuggcuauuguuaauagugcugcaguaaacauuggagcacaaauaccucuucagaauacagauuuucuuucuucuggauauauacucaggauacauacugggauugcuggguuauaugauaguucuauuuuuaguuuuuugaggaaccuucauacuguuuucccaccaacaguguaugaauguuccccuuucuucacauucugacuaucagcuguuguuuucugucuucuugauaauggcuguucuaacuagggugagaugagaucucauugugguuuuucucuguauuucuaucaugaucagugaugccagacuuuuuguuguauaccuauuggccauuuauauaccuuuuuuugagaaauaacuguauucagaucuuuugucccuuuucaaaucagauuguuuauuugcuauugaguugaauuccuuacuuauuguguauuuuaaucucuugucagauggauaauuugcagauauuuucgucuaugccauagguugucucuucacucuguuggauguuuccuuugcugugcagaagcuuuuuagcuugauauaaucccauuugucaauuuuugcuuuaguugucugugcuuuuaugaucuugagaaaucuaugcccagaccaguauccugaaguguuucuccaguguuuuuuuauaguagucuuguaauucaggucuuagauuuaaguccauuuugguuugauauggugagacaaaggggcccaguuucauuauucuacauguggauaucuaguuuuuccagcacaacuuauugaagagacuguuccuuccucaauauauguucuugaugccuuuguugaaaaugaguugacuguaaaucaguagauuuaucuuuggguucucuauucuguuccauugguguaugugucuguuuuuaugccaguuucaugcuguuuugcuuaccauagcuuuguaauauauuuugaagucagguaaugcaaugccucuggcuuuauucuuuuugcucaguauuucuugcucauuauucagggucuuuggugguuucauagcaauuuuaggauuguuuuucuaguucugcuuugaugaacgucauugauauuuugauagggauuauauugaaucuguagaucguuuuugguaguauggaaauuuuaauaauacgauuucaauccaugaacaugggcuaugucuucucuuuuguguguucuuuuuaauuuuuuucaucaauguuuuauaguuuucaguacagagaucuuuugcuucuuugguuauaauuuaucccuagguuuuuuuuuuuuuuuuuuuuugguagcuauuauaagcaggauugcuuucuugacuucuuuuucagauuguuugccguuggcauauuagucuguucucgcacugcuauaaguggguaacuuauaaagaaaacagguuuaauugacucacaguucugcaggcuguacaguaagcauggcugggaaggccucaggaaacuuacaaucuuggcagaaggcgaagaggaagcaggcaugucuuacauggcaggagcaggagaaaaauaacaaagcgggaggugcuacacgcucccugucagaacaguaagggggaaguccacccccaagauccagucacccccccaccaggccucuccuccaacauuggggauuacgauucagucaugagauuugggcagggacacaaauccaaagcauaucacauauaaugcaacuguuuguauguugauuuuguauccuguaacuuacuuuaucaguucuaauaauuuuuuuguuuaucuuuuaaagaacccaguuuuucauuucauuaaacuucuguaguuuuuuuagucucaauuucauuuacuucuguucugaauuuuauuauuucuuuccuuuauuaauuuuggguuugcuuugcuuuugcuuuucuaguucuuuaaagugcaucauuauguuguuuauuugaagucuuuguacuuuucuguacuuuguacuuuuauuacuauaaaauucccacuuagcacugcuuuugcuguaucccauagauuuugguauguuguguuuuuauuuucuuuuuuaucaagaaauuuuaaauuuuucuuucuuaauuuuuucauagauccauugguuguucaggaacguguuguuuaauuuccauguauuucuguaguuuccaaaguucuacuuauuacugauuucuaguuuuauuccauuauggucagaaaagauacuugauaugauuuggauuuuuuuugaauugcuugagacuugcuuuguggucuaacauauggucuauccuggaaaauguuccaugugcugaugagaaaacguguauucuauagcaguuggaugaaauguucuguaaaugucagguccauuuugucuagaguguaguucaguuuugauuuggguuguuugauuuucugucugaaugaccuguccauuauugaaagugggguguugaagucagucuucagcuauuauuguguugcagucugucucucccuuuaauaaaucuauuaugcuuuauacguuugagugcuccaauaguguuugcauauauauuuauaaccuuuauaugcucuugcugaauugagcccuuuaucauuauguaaugaccuaggucuuuuucuaguuuuugacuugaaaucuauuuuaucugaugcaaguauaguuacuucuauucuuuuuugguuuucauuugcauggaaguaucuuuuucauaccuuuaccuucaaucuauuugugucuuuauaggugaagucuuuuuuuuuuucuuucggagauggagucucgcuccauuguccaggcuggagugcagcaaucucagcucagugcagccuccaccuccuggguucaagagauucuccugccucagccuccuaaguagcugggccuacaggcacaagccaccaugcccagcuaauuuuuuuuuuuuuuuuuuucaguagagaugggguuuugccauguuggccaggcuggucuugaaccccugaccucaagugaucugcccacuguggccucccaaaguguuaggauuacaggugugagccaccgugcccagccaaagugaauuucuuguaggcagcauauaguuggucuuguuuucuuauucauugagccauucuguaucuuuuaaucagauaaguuaguccaucaacagucaguuuauuauuguuagguaaagacuuaacuacugccaguuuguuuuuuguuuucugguuguuuuggaaguccucucuuuuuuucuuucugucuuccuuuguggauaaaugauuuuuucucauaguauguuuuacuuuuuauuuuuaguuuaucuguuuagacuuuuuugaguugugguuucccuaagggguucagaaaauauaacaaguuugaugacaacuucacuuugaucacaagaaaagaacaaaaacaagcaaagaaaaaacuuaaaaacucuguuuuaauuccaguacccccauuuuuuggcucuuuguuuucucaacuuguaucuuuuuauauugccagucuuucaacaaauuguuguggucauuauuuuugaaaaguuuauguuuuagucuucauacuaaagauucuauggaguauuagauaaggauacugaagauacucuaauacaaagauacucuuaauacuccacaauauuagaguaucuuuaaaugcaguauuagagugucuuuaguaucuuuagaauacucuauaaaguauuagaguauuuugaauuugucuguguauuuacauuuuuuguugcaugcuagaauucuuuucuuucagauugaagaacuguagcauuuuuuguaagacacaucuggugguagugaauucccucaucuuuuguuuacccaggaaagucuucauuuauccuuuauauuugaauguugugggaagucagggaccccaaguggagggaccggcugaagcuguggcagaagaacauaaauugugaagauuucaugaacacuuaccaguucccaaaauuaauacuuuuauaauuucuuaugccugucuuuacugcagucucugaacauaaauugugaagauuucauggacauuuaucacuuccucaaucaauccucuuauaauuucuuaugccugucuuuacuuuaucucuuaaucccaucaucauuguaagcugaggauguaugucaggacccugugaugauuguguuaacuguauaaauuguuuguaaaacguguguuugaacaauaugaaaucagugcacgcugaaaaagaacagaauaacagugauuuucagggaacaaggaaagauaaccguaaggucugacugccugcagggucgggcagaauagagccauauuuuucuucuugcagaaagccuguagacagaugugugagcaggagaaguaucacuuaauucuuuucccagcaaggaauauuaauaauugagacccuggggaaggaaugcauuccuggcgggaggucuaugaauggcuacucugggagcgucugucuuaugugguugagauaaggacugaaauaugcccuggucuccugcagugcccucaggcuugcuaggauugggaaauuccagccuggugaauucuagucagacuaauugucugcucucaaacccuguuuccugcuaaaauguuuaucaagacaaugugugcacagcgggacacagacccucaucaguaauucuaauuuugcccuugccuugugaucuuuuauugcccuuugaagcaugugaucuuugugacuuacucccuguuuguacaccccccuccccuuucaaaaucccuaauaaaaacuugcugguuuugcggcucaaggucgccaucacgguccuaccaauaugugacggcacccccgcaggcccagcuguaaaauuucucucuuuuuacucuuucuauuucucagaccaaccgacacuuagggaaaauagaaaagaaccuacauugaaauauugggggcugguuccccugauauuugaaggauagcuuugcuggguacaguauucucaguugcaaggauuuuuuucuuucuuucuuucuuacuuuuagcacuuugaauauguuauuucacucccuccuggccuguaagguuucugucaccagacguaucagagcuccuuuauaucuuacuugcuucuuuucucuugguacuuugaggauccucucuucauccaugaccuuugugaguuuauuauaugccuugggguaaucuuaauuggauugaauuuucuugguguucuuugaccuucuuuuaccuggguguucaucuuuuucuagguucugaaaguuuucuuuugauuauuucuuugaauaaacuuucuaaccuguuucuuucucuguuuccucuuuaaggcaaauaacucuuagccucuuugaagcuguuuuccagaucuuguaaguguaucucauucuucugcauuuuuuuccucugacuguguguuuucaaguagccugucucagagcucacuaauucuuucuucuacuugaucaguucugcuguugagacacacugaagcauuuuucagucauccauuauauuuuucagcucuaagauuugauuuuuuucccccauuuuaaucucuuuacuaaauuucucuuauaaguuucugaauuccuucuccauguuuucuugaaguuguuaagcauucuuaaaacagcuaucuugaauucccugucugagaggucacauaucuacaccacuccaggauuggucacuggugccugcuuagucuguuuguuuagggugaauguuuuuucgaacauguuuucucaaauguccucgaugcuugugaacauucgucaguguuugggcauugaagaguuaaauauuuauuccagucuucacagucuggccuuguuuguaccuguccuucagagggccuuccaagaauucaaauaugacugaguguugaguucccuaagccuguggucacugcaguuguuucagcacuagagggcacccuaagcccaggugugcugcaacucuuacagauaccuagauacccagcauugauggacuuggggaagauaagggaacauucucuggguucccaggcaaaguuucuugcucucuucccucucucucccccagguagagggagugucucuccacaauaagcugccugaaguuaggggaggguaaugugggcacuccuguggccacagcagcuagcaccaugcuggguuacacccaaagcccauggccucccagaccagcacaguaccagggcucacccaaggccuguggccaccugacugccgcugaugcuuuuucaaagaugaggcugcuuuagucagcagguguuggagccaaccaggacuugggacuuagguuguucaugccacaugagcagauucccuucuugccuggggugggucuagaagugcucuuccacagcagcauccuggaaguggggcuuucggacucugccugguccuuuguuuuauugugggugggcuggugccugguugcgagacaaagucuucuguauuuuugcuuuuccucccuccaaguguggucuagccgcuggugaaauuuauuugugggccugaggccauuuuagucagcugacuuggguuccucucagugaagaagcugauuccccucuggcccagauuuggucuaagugcucccuccuugggcacuggcagaauucugccugaugcugugaccggguguuacugaguugcaaugugaaguaucacacucauuuugcucugcuucacccaagcacacagguucucuuuccaagcugugcugccugggacucggggaggggugguauaggcaguguguacuucccacucuauucagucagucuccucuuguuauuaugcugaagccagguacugugaugucucaccugauuuaguuuuuaugaaggugcuuuuuugguggauaguucaguuugauguuccugcauuagauggggaggggaugagauucuguugggcuuuuuuuuucucaauuuuaaguuuuuguagguacaugguggguguauauauuuaugggguacaugagguguuuugauacagacaugcaaugcuuaauaaucacaucauggagaauaggguauccauccccucaagcauuucuuuugaguugcaaacaauccuauuauauucuuuuagcuauuuuaaaauguacaauuaaauuauuauugacuauagccacacuaguuugcuaucaaagaguaguaggucucauucauucuuuuuuuuuuugagacggagucucacucuguugcccaggcuggagugcaauggugcaaucucagcucacugcaaccuccaccuccugaguucaagcgauucuccugccucagccucccaaauagcugggauuacaggcuuacaccaccaugcccggcuaauuuuuuuauuuuuaguagagacgggguuucaccauauuggccaggcuggucuuaaacuccugaccucaggugauccgcccaccguggccucccaaaguguugggauuacaggugugagccacugcaccuggccugaauucauucuuucuaacuauuuuuuuguaccuguuaaccauuuccaccuccccguucagccacuuugcccugccgccugcucccucuuguaacuuuuuauuauaggaaauuucaaacauacacaaaaauagaauaauaauauaaugaauccccauguaucuguucauauuuucucuauugaaccccccuuuauuucuggauuauuuacagcaauguccagauaguauauuauucauaaauguagcuguggaguuuuguuuuuguuuuucaugccagcuguguuguuauuaacuacaggaaacaugcaaaaacagguacagguacauaaaaugaaccccuaauaaggauuauguugaaauaccuuuuuucagcuugaaguugccaagagaagcuuuuaaccagggaagcuguaggacuaaagccuuuaaaucuuuuuuccucagacuaggaagcuuguggcauuaguacgugaugccucaucacaacuagagcguuuguugauuggcguaggaaagucucagcuguugucuuugugcuuugaagaguagcguguuuauagcccucacaugcugucuguucauucccuuauuucuccuuuuccuccuaaauuucuuccgguucacaguaaaaaguggaaaaugcaggucuagguaguuacauguugggucagugacuccuacuagugaaucaugucaacauuucugaauaaaauuuuaaaacacuugaguggguacuauauagaauuuucuaauguuugacuuuugaaaugcuuucaaacuuacagugaagcuguaagaauaguguaaagaacuccugugugcccuuuauccagauuuaccaaauuuuaacauuucacauaugcuuuauuauucucuuuuuucugagccacuuaaaaguaacaucaagauaucauauaauuuaagagugcaaagaguuaaauaauuguuaaauaaauguuaauaaaauauaauggcuacuauuuauuguggaguaaccacaaucaagcauccuauauaauaguuuuauguacauuaaccucauuuaauucuuaaagccuaaugcuguggaugacgauauuaugccccuuuuacaaaugaaguuuuugaggcucauagaaguuuaaauaaggguuuauagguggugagagauagcuagaauuuauauugagacuuacauggcuucaaaguugaugggguuuucugucuuccuuaggugaaccauauuaugcuuccagagaucauaaaucacugcuuagugguucucuacugagggugaggagggcagcaaagacuuugaaaaauaucuucaagggauucuuauauccuccacucccucaccaucccuggccuuugagccauugaauuagccgaaagcaaacuagggcaaagagugaaaacaaaacaugcucagaaccacacuuuuaagcaggcuuucuguagaaauggauguuuuugggaaauguguuuucucauucaugguuuuuacuuccuucguugcaggccaagcagauagaacuucaguucacuauuggcgaagccauuaccagugcugcaauaggaacuaguucuguggcugcccgagaugccuggcaaaugacugaagaggaauauacuccaccugcugguaccaaauauucagcuaaucgauuuauaaugaucaaguaaccuuuuuuuguucucuuuaucacauuugaggcaaaaacauuacacauuccauauuacuguuuucaaauauuuauaucuguuuuaccaauuucauucagucaagaaaaauaguugagugaagaagacagcaugaggcugggcacaguggcucaugagugccuguaaucccagcacuuugggaggccgaggugagcgaaucaccugaggucaggaguuagagaccagccuggcuaacauggugaaaccccaucucuacuaaaaauacaaaacuuagcugggcgugguggcacaagccuguaaucccagcuacucgggaggcugaggccugagaauuucuugaaccugggaggcggagguugcaagugagcugagauuaugccacugcacucuauccugggcgacagaguaagacucugucucaaaaaauaaaaagcagacagcaugaaauuaguuaacuucuuuuucugacccuuuggcaagcaagcaggggagucagcuuuggauuaccuugaagcuugugcucuuuucacgaggauuuauguauuuagccaguuucagaauucaagguauaguuguuuccagaugauguguccucuaauccuuuauuacauaaugaagccucagugccuucugcuagcgcucuagguacacuggcuuuuagugacagcauauaguugagggaacaugugguuucugacuuuauguuuuauauauuaugauuucaaguuuguugugguuugauuugaauuuggaauugaaaauauauuuuaguauuugagcuagaauaaaaaaaaauuuaaacagaaggaaaagucaccacauuuuuauauuuuauccucucaagugaggaaauuaaaagagaguauucucaugguaacaauuuuauuguauauuguguuccaucaugaauaaugcauuaauuuaguuauugcacuuaguguuacaguuaacauuuaacuccacgguaaugcguucaccuauuauuucauuagccacccuaaagagauuuaaaggaaauagaaaaacacacuuuugcuugcacuguaaugagaguuguggauugacggaagcugaaucagagucaguucuuugagguuuuucuuugaacacacaugaagcaaggcaaggagcaguuuguauagaaggaaggagguaaggaagggaagcaacauuguuaacaagaagacaaccaaaccugaagugggaauuuucagguugcaugugagaggugguaacagaggcuugacaacagggagggcucacacugaggaguggguuugcugugagaggcauguuuuugacuccauggguuuuuuaccuagugacuuaagcaaguagagguuaguagagaggcaucugugccagucuucauccucugaacucuuguauugccucaaacucuucuuggaagauugcauccugcuuggcuuuuuacucaugcaaaggaaucuccaauuguccauuaaauguugaaguucuauuuuugucuguuuugggaaaggaaaacauaaaauauuguggagaagggagggaugaugaaucucugacgugaauuuugaucaugcguguucuaugucauucucaucugagugcuucuuagccuuuggaugucauuguugguuacaguguaccaaucuugcugugaguagaaugaacagcauuugagaagccaguuagggcccaggucuuagccgucuuaacaucucuacauaauauccugggcauguuaugggaaucuaguaaggacuuguugguuuuauaauuguagaugcccagauagcagaacugcuggcagcuagaguugugguuacaggaauuaaaagaagggauucugacucugagaacuggaguaaugugaucaaugaggaguuaugaagggacaaggggcggaggggaauugaccaugucauguacugccaauagaucgacuaaagugagaauugagaaaccaucauuggacuuagcaacaggaaagucauucgugauuucuaugacuaauuucuauggagaagagaagguaaaaggcugauuuggagugggcucaaaaaagagaagagcaaaguuugaacaugaguuuaaacaacuauuuugaagggucuuaauguaaaucauugguuugucacuggaggaaugagauuuuucccccuagacacuugguaaugucuagacacuggggagggugggugccacuggucucuagugggugaaggcacaggaugcugcuagacauccugcaguguauagcacagcuuuguaugauaaagaauuauccagccacaaugucgguaguguugagguugagaaacccuggaguaauaaaggaaaggagaaaaacaguaugguagcuggaggaggaaaguaagugcaaaauaaguuuguuaguuuuuagauggaagaugagaaacaucuaguagacaaaaauugcugacacuagagagauuagggauaaguuuucauucucaggaacuaaaaaguuacucgaguaccuuugaaauguaauuuuguuuacacuagguucuagaguggauaauuauugauuccuucagcaacuuuaaacaccuuagccauuuagauuuuuauauaggauuguucuguugaguaaauguugauuugaauuuaauuuuuucaggaaacuauguugaguuauuuuaauucuuuguuauuuuucuuugcuuuuccccaggagccaaagugaaugaugugguuccauggguguuggaugugauuuuaaauaaacauaucaucagccccaacccacacgugaggcaagcagccugcaucuggcuccuuucccuugucaggaagcuaaguacccacaaagaagugaaggugagccaugcuguauguggucagcccuguuggaaaccacaguauuauaaguagcaaggaaagcauaugagggugaaggucauuaaccaauaguagguauuuugaaauacauuguacaugaaggaaugaaggaugguggccugauguauauaggcuggaagaugauucuagccuugaaggaauaaagucagaagugcuugagauaggaaggcucaguuggggcaguggucagcuugcauguguuagacuacguguaaguggugcagcuccaggugauuugggccaccuguaaagaugagagcaaaacagcgauuguaacuggcuuggauaauaagacuacaaauuuuguacacggugagagcaagacucuuauucucucaaagagguagaguuucaguguucuaaugccuuuuuucuucuuucagucucaucuuaaagaaauucaaagugcauuuguuucaguucuaucagaaaaugaugguagguuguuaauauuugauuucuaaacuuaauugaacuuguauuuuaaauguucaaaaaccuggauuaaugaacaugaaagaaaacuuucuugagcugugugauuaaaacaauuauuaaaccuuauuuguuaguaguaaggauaagcauuauguuaauguuuagaaaccaaaauuucuaguuaggauacaggaaacuuagauucuuucucauuuauugguuuauacauuagaacauguuccucaacucugcauuuuaaaauggagccgaggccuucuuuaacauuaguaucucuccuaauagcuuuuuucugccucugguuacuuuuccucucugauuuaagcuaggagagagugaacguauauguguuaaaucuuucaguacuaagcuuuguuuuauaacuuguuuuaaacauauggucuugcauugacuuuuaaaaguuaggucugaguguauugagaucuugugaggcuguuuuaucucugauguaugacuuacagcccauggauaaucugucgcugcacuguccagugacacuguauagguccaucaguauugucuagauuugugaacuggaucuucugugaaugugguucucauuuacaguaacuuguguggugccauguccccugaaaugauuauuauuuuuaacaaaauaggcauauugauucuguuuuuauaucuuuacuuugauaucauuuugggucagugucaacauaacuuuaaaaauuuugauuucauagcaaguagacaaaauuuuuuuuaaagugauacaaucuugucugacuuucuuguagaacuuagccaagauguugcaucaaagggccuuggguugguuuaugaacuaggcaaugaacaagaucaacaggaauugguuucuacacuuguggaaacacuuaugacuggcaaaagguauggugaacuugaaaauuuuagauucaagcccauagaggaagucucuacacauagugagaagaugcuggagaaggaagauucggcuuuccauguuuugguuuaugaagccuuuucuaaguugcgaguccauaauuguugugcuguggauagcacaauuauuccaggguauacuguuaacuuuaggagcaugccacuaggucaagcgucgaaaguuuaauggucucagauaauguauuggguuagaaaaaugccguaauuacuguuggcuaaauggaaguuaagauacggagaagaagcuugcauaucauucauagucuaacccgugaagagugugaggggaaaucaucuguguaagggauugcugcuucauguugccucccuuguaggaaggauaguuuuucaugugcuaccacauuuaauucaguggaaauuaugugaaaugucuuuuucaucuguuaauuuguucauucugaauucauuuuauaaaauuugcagccuguuggaaagggcuguuuuuuguuguuguuguuguagucuugcucuguugcccaggcuggagugcaguggcacgaugucagcucacugcaaccucugccucccugguucaggugacucucccgccucagccucccgaguagcugggacuacaggcgcgugccaccaugcccggcuaauuuuuuguauuuuuaguagagauggcguuucaccauguuagucagaauagccucgaacuccugaccuagugauccacccaccucggccucccaaagugcugggauuauaggugugagccaccgcgcccggccggaaaggacuuuuauaucuuguacacaguaaaugcuugauaggaaguuuuaucacuuuguaaaugaaucguauuggcuaguugaauguugguaugaaaagcuugaagcuuauugaaauuauuguuuugguuuagaguuaaacaugaaguuucuggagagacagugguauuucaagggggagcucuuggcaaaacaccagauggguaaguaugcuaaauccauugaaugguaaacaucuuuaaauauauauaugcauuuauuagucugguaaauagagcagucaugaaguugauuucuacccucuuaggaaauguuaucuauugguggaagaagaaaacuuacauggaaaaaagucugaugucuuuuuuuuuuuuuuugagauggagccucacuuuuguugccuaggcuggagugcaguggaguaaucucggcucacugcaaccuccgccuccuggguucaagcgauagauucuccuaccucagcuucccagguaacugagauuacaggcaccugccaccacgccuggcuaauuuuuguauuuuaguagagacgggguuucacuauguuggucaggcuggugucaaacuccugaccucaggagauccacccaccucggccucccaaagugcugggauuacaggcgugagccacugugccuggcaggcugacgucuuaaauugaguguccugggaaacaaacucugaguuagauuucugugugggaaauuuacuggggagugcccuaggggucacucuggggggaugaggaggcaggauagggccuaugacugagggaggggcggaacugcuaccaucguuucaguggauaccagccucuugaggagcucugagcuggcacagguggccuuucggaguuguucugcuuugaggcauggagccuggcccuuuauguccucucagugaccagccauugguggugggcugcugcgugggagcccaugauguugggcucucagggcaguugugggagacugacuaggccaacagcugucagcucucaggcagcugaguccugcagaacaccuggaagcauagcuaggugcacccacugccgcuaguuuuggguggguguaauucuuuaucuuagaggccacuacuuuagcauuuaaaauaaauuccuugagcuugaccgccuuuauuuuaucaugcuuuauuucuacggaucguuaggcaaaucuuugcugguugcagggccuugcuguggugucacacacgagccugcuucauuguugucugcagcaggagaaagcugcaguuuguuccaucguugacguucccccacaguacacuguuaucacaucaaaaguuguuuucauuguacuuaacucuccuuguagacuccuucuaaguuuuuaaaaaagugcuuacauuuuacaaaauaacaaaacaauuagauauuugagccaauauuauuuguucagaggaaaguuaacaagacucaaucagaauuaggguggucuagcuuagaaaagacuuagggaagacagauguugucuuccaaugacucucuuaugaucacgugagauuaugcauaacauaaugaagaauuauugaguugcaucuccagguggugaguggaccguggcuauggacuuagaggugcauuuaggucauuuaucagcagcaauguagaggggcuuaggaauugcuaauaguugaauuaggugacuuuuuauauucuuacuaacuuguguucugucuccauggugauaacucaguauuagaaauugagugaaaauuugauuuuaguauguccuaguaauauugaugauguaauuuuuuaggcuggagagagagaaguguauuauugccuaccucuuuuucuuuguuuccaagucagggccuuucuacuuacaaggaacuuuguucucuggcaagugaucuuagccagccagaucugguguauaaauuuaugaauuuagccaaccaucaugcaauguggaacucuaggaagguaaguugcuaucacuggacaauuauuuauuuuuuucaugcaaaccaaacaugcuacauuggcagacaguggcaaaugguauguagugcauuuugugaaagucugugccugaugagaaagcugaaccccacaaaugcuguugauuggaaagaccaauaaaucaggcuguauuuaggcauaaguuuggagggagaauuuuuugcuauguuaauauuuuacuauaauggugcaucugagucacuucagccuauuauuuuuagggugcugcuuuugguuuuaauguaauugcuaccagagcuggagagcagcuggcuccuuuucugccucagcuaguuccucgacuuuaucguuaccaguuugaucccaaccuuggcauucgacaggccaugacaaguauuuggaaugcguuggucacugacaaauccaugguaagugucugugaaccccuguguuaggaaaacacuguagacuguccagggucaugcauaggauuuaaacccaguguccaucuuccuuucuacuuuuuauguuuacuuguuuaaacaaauaaauugucuuucauuccaugcuuucuuccuucuuucaagguaucaaagauguguauggcaacauuuauugaaaucuccaaaagggaaacaauauaaauguccacugggaagaugguuaaggaaaugauuauguauucacacaaauggaauaguaaauguggauagggacuguugauggaauggagaaugggucauagucccaucuccaaugaauucaguuagcuggggagacagacaaggaagcaggcaauugccauuuuguuuucucuguugguguccucucaucuggcuguuaaucauguucugucccacuuuuagauauuaagauuucucagggcuugucucugaguaucuuuugcucucugagccuucucuauaucaaucaguuccaaggcauguaaaugucaucuuuauugugaaaguucccaaccuuacacuuuugguccagaugucacuugcacuuuagacaugcauauguaacuguuuacuugaaaauuucacuucaguguuguuucagaauaccauaaacccaacaugcccagaacaggacuuaaaaaauaaccuucccccucuacucucacuguuuaccuauuugcccaagccagaaaacuuggugucauacuuuauuuugaucugugucucaccaccacccccaauugaaucuaguagcaaauucuguugauucugcuuccaaaguauuccuugaaucuacucucuucuuucccuaauucuuuacugaugaauaggucaucaucaucuuuuuuuuuccucuuugccguucuucauuuaauuaucuacauaguagcaaaaguaauuuuuaaaaaugcaaguuagauugugccauuuuggguuaaaauccuuuaguagcuuuacagcucacuuuaaauaaauuccaugauccuuacuaugucuuacaagucccugcccguaauguggccccuuccugucucuccugucugguacuaggcugaauauguuucuauucuuggugguagguacuugaggguucagcuuugaagacucaaugaguuuugcuugcuccaggagaacauguggcacuuuugggucagccaagaucuaguaggccagugggcuuuguaggucugagcucaggacacaagccuagacccuugagacgugagugucaucucuauaagugaaaggauuaagccacaaguguggaugagaucauccauggagaauguugagagaagcagacauaggaagacaucaguuuguuauuuaccucuuugucuugguuuucuuacauguaaguaaggauaacaaaaccuuuccuaccuacaaaaguggaaaagccguaaauuuuugagaaugucagcauugguauaagacugauucuaccauuauuuugucauuauuaccaaguugcuaaguguauaucaaaacagaacagaggcuuaaaaaguaaaacucaucuuucauucugaacagucaugaaccaggcacuggguaagguacuggggauaaaaagaugagugagacucugucccucaauaacugcacugaugaugagugagacacugucccucaguaacugcacuguugaugagugagacucugucccucaauaacugcacugacgaugagugagacucugucccucaauaacugcacugaugaugagugagacucugucccucaauaacugcacugacgaugagugagacacugucccucaauaacugcacugacgagugagacacugucucucaguaacugcacugacgaugagugagacucugucccucaguaacugcacugaugaugagugagacacugucucucaguaacugcacugauggugagugagacugugucccucaguaacugcacugacagugagugagacagugucccucaguaacugcacugaugaugagugagacucugucccucaauaacugcacugaugaugagugagacucuguuccucaauaacugcacugacgaugagcgagacacugucccucaauaacugcacugacgaugagugagacacugucucucaguaacugcacugacgaugagugagacucugucccucaauaacugcacugacgaugagugagacucugucccucaauaacugcacugacgaugagugagacucugucccucaauaacugcacugaugaugagugagacacugucucucaguaacugcacugauguugagugagacucugucccucaguaacugcacugaugaugagugagacacugucccucaauaacugcacugaugaugagugagacucugucccucaauaacugcacugaugaugagugagacucugucccucaguaacugcacugaugaugagugagacugugucccucaauaacugcacugacgaugagugagacucuguccuucaguaacugcacuguccuguacaauaacugcacccgacccccuugagggucugcaguauagugaaauaguacaguuauuguaugauuuugugugaugcuucuucagaaggugcuaugggaacagagaggagaguacccaagcuaaucuucucugggaaaggauggcuaauaugaaccuugaaggacaaguaggaguuagccaagcaaguaggaccugggaaggggauuguagggagagguggcaugugccaaggaauggaggugagacagaauaugguacuuuugggucuggaugagucauggaaggcuuugugugcaugccugggugaauggacuucauucucaugcacugaggaaaauaaaagcaucaaauguacauuuuagaaugaucaccuggcagcuuuauagugaccaaagugggaagagauuugugggcugaguggccuagagagacauggaggccguaaaauauagaaacauggucagugugguuaagugugguuaaccagugugguuaagaguugaguaauuugauuauugauggauuuugcauuuuaaauuuuauccuuuugcuuucauuagguggauaaauauuugaaagaaauucuucaagauuugguuaagaaccuuacaagcaauauguggcgaguucgagaauccagguaccguuuuuaggaauauaaguuuagucaaauaaaacugaauuuuuuucccuucaaaauuucuagguuuuauacuuugugcaaaaggaauaaauuaaaacuacuaaaaagcuggccgggcgugguggcucacaccugugaucccagcacauggggaggcugagguggguggaucaccugaggugaggaguucaagaccagcgugggcaacauggugaaaccccgucucuacuaaaaauacaaaaaucagcugggcccaguggcaugugcauguagucccagcuacaugggaggcugaggcaggagaaucgcuugaacccagccagggggcagagguugcagugagccgagauugugccauugaacuccagccugggcgacagaaugagaugagacucugucucaaaacaaagcaaaacaaaaaacuaccaaaaagcauauuucuuguuggcuacauuaguuauuuuucuuuaacuguuuaagcuuuggucaaugauuuuccuaaauugucauaguuuauguaaguaugaaaucaaagaaguugaagauuaccuguuaaauugguagacaccaagauguauuuuguauugucaugacuuuauaguauagcauuucuguauacaaguuagauucauucggugcccaguguguauguggcagugugcuaggccuuggaggcacacuggugaauaaaaaacgaugugucaucucaaagggauuguauuauaguugugggaaacaagcauuuuauaauuguaaauuacauauauauaugguauauuugagggaccuggagagaagucauugcuguuuuggggugaggggaugagaacucgaauuagaggcagaaucuguauucuuuuuuaguauaaauguuucauaguaaaauacugaccuuuuucaucauauauugaaaugaaauuuugauuuucagcuguuuagcuuugaaugauuuauugagaggaagacccuuagaugacaucauugauaaacuuccagaaauuugggaaacgcuuuuuagaguacaagaugauaucaagguauuauagaaauaaaucagcauuuauauauacaaaaaguuaaauuggaauuauuaaaauauuuauguuguguaugucaaaauuccauuuccagauaauuuuaagagaccaacguuuucccccaaaguuucagucuuaaugugucugugaaguugcaagguuggguauccuuagaucuaaauuaaauagacuuagggaaaaaaaagguggcuguauaccuucuuucaauagagaucucaugauucuauuggauuagggacaaauaacaguuuuggacauaguaacaguauuuugaucaguucuguaaaugggauuaauuauucucaaguaauguggccaauuccucugaauuuuucuugggcaaucuuaauuuuagguauuuugguauuuuaccauuaaaauuaggcacuucaguuuuaccuuucuuuuugcuuuauuuauuggaggcuuuuaaguguuucagaauucucacauagaucuuuauguauuuacuuuuauaauacauuuaguuucucaacuguuaauagcuaaauuuuuuaaggucaaaauagguuacaguuaauguuuaaaaauuaauaguauggcaugguaauguguuccuugaugggcagagagucugaugagauaccaauuuuuuuaacaugauaugaaauguaagauuuuccaccaaaucucuguagggccugaggcaauuaaauugcaaauuguagaguagaugauagugaaacucucuaacuuguaugaugucacacuuuugucauuuuuaggaaucuguacgaaaagcggcagaacuagcucugaaaacucugagcaaggugaaaaccccgucuuacauugggaauggaguggagcaggguucugggugaccaugacaaugauuuacuuacugucauaggaaaagacauuuaguugcaguauaauuggcuucauguuguaguucacugcucuuagaaugaaugagaaagugagugcuguaaacacugcaguacuaguguguugaacagaguauacuguggucucuuuaaauggugaaauuaagauaaaacuucgacuuaacccugaagagcacaucacucagaucaagcaacaccugucuuuucucuugcuuuugcuguguuuauauauaaagcuaccuuucauauuugugagguuggaaagcuuuuugaaacuaaauuaucucccacuugaacuugauuuugugauauaucaggaacuuuacauucuaguugcacaaaccuugccauaggucacauaaauaguaaaaccagguuuuaaauacagguguuuuccuguuucacaugugaucuugaccacuauauugugcugugacccagcguuauugaugaugaugaugaugaugaugaugauaacacuucaaaacuucuuuauuuaauuuuuuauuuuaauuuuuuuuugagacaaggucuuacucugucacccaggcuggaaugcaguggcgugaucacgacucacuguagucucgaccugccggggucaggagauccucccaccucagccuccuggagagcugggaccacagguguaugccaccaugccuggcuaauuuuucauacuuuuuguagagacagggucucuucauguugcccaggcuggucucaaacuccugggcucaagcaauccgccugccucggccucccaaagugcuggcuuuauaggcgccggcuacugcacccagcccuaaaccuuuuuuaaagugcuuucuuacauauuuccugguuugaucaucaucuguuuuguucuguauuucacaaauuggaggaccagugcuuagagagugaaaugcauuaccaaauuuucuguuuaguucuuggcagaccuaggacucaaucuccgaucucauuccucugugucucuguagugucagagaaaguagauucacuuauucuucccuguagauaugugaaguagaaagucuuuugucagaugaauucuuuauuggaugcgcggucacuuucacuaacguccaugcucuuuguaugugaggucugugugaaaaugugugacccugccaaaggagcagcuggccagagaaccaucgcugcccuucugccuugccuucuggacaaaggaaugaugagcaccgugacggaaguucgagcccucaggugugcauccguugaugaaaugaauguauuggauuugcucaguuccuagaaauuguguuucuuucaagguuagauucuggaaaauauggagaaagagguuuaggagaaugacccuugggucauuugugaaaacuugugagucacaauauuuucacagaaacauucucaugagaccuuauuuuugccuagcauucugagucaagcguguuguucuguugucaucagccucugcucccaacaagcacgucuuccuguuacacuguagguccucaggagcauguuuguucauuauaauauuuaguaauauuucacagauuauuagauuuaagagaagcuguuuaccaccugcaacgaugaaauauucaaaaaauguacuuacacguuuugauauaauauaugacuacuuuaaguuaaaaccaauaguguaggauucuaguuuguauguuuuguuuguuuuuaaaguacagugcugucuaggaacuuuaucuguuccauuguuauuucacucuuaagaguagaacaaauuauuaauaauacugccagugguauuucauggcaaguagauaguugaugaaagaguuuuuuuuuuagaaggacucaccuaacaaaugcaaaggcaugacgcaauuaagagugucacuuuggcugggccugguggcuggugccuguaaucccagcacuuugggaggccgaggugggcggaucacuugagguugggaguuugagaccaaccuggccaacauggagaaaccccaucucuacuaaaaauacaaaaaaaauuagccgggugugguggugcaugccuguaaucccagcuacuugggaggcugaggcaggagagucgcuugaacccaggaggcggagguugcggugagcccagauugcgccauugcacuccagccuggacaacaagaacgaaacucugucucaaaaaaaaaaaaaaaaaaaaaguaucacuuuuugcucuccucaguaaaauaaucuaaguagugaucauuagaugccccuaaauccacugggugaauggcugaagagaacuuuauaaugauucagggcaaccagaccugaaccuaccaaucacuccuuauagcacaaaaagacaaccagugcauggugaugugauggaauaggaggaauaggacacacagcauugccuaggaaggauucuuuguguguguguguguguguguguguguguguguuuuacaaaauugaacgugaacucaguuuagccuguagaucugugcaggggaaagaggaacauguuaaaugacaugacuggaauacaaucaaagaggacgaagaagaaaaaaagaggagaguggagacuguuaaaaaagauuuaagaaaugcaguagauugcaaugugugagugagcuuggauccugauucaaacaugccaacuguuuaagaagcuaaugaaacagagaaauuuggauacuugauaugaaaaaaucauuaauauuuuuaaagugugaaaaugguauuaugauuaugauaaagagccuuugcuuuuagauauucauagugaaguuuaguuaagggauaugcuuucaaaugcagucacacgucacuuagugacaaggauauuucugagaaaugugucguuaggugauuucaugguugugcacacauuaacaugaaguuggaaaaauggugcaguuagauugcuugaugcaggguugccacaaaucuguucacuucauaucucuaugucauauuuugguaauucucacgguauuucauacuuugcauuacuauuauaucuguuuuggugaucugugaucagugaucuuugauguuauuuuguaauuguuuuggaguuguaugaacuacacccauuuaagauggugaacuuaauuggucaguguuguguguguccugauugcuccacugaacagcuguuccccaucucucucccucuucucaaaugucucauucccugagacacaacaauauuggaauuaggcuaauuaauaaccccacaaugcccucugucuaaaugaagggaagaguugccugucucuuacuuuaaauagaaagcuagaaaugauuaagcuuagugaggaagggaugucaugaaagcugagauaggcugaaagcuaggccucuugugccaaacagccaaguugugaauguaaaggaaauguucuuaaacgaaguuuaaagugcuauguuagccaacacacaaaugauaagaaagcaaaacagccuuuugcuaacagggagaaaguuugaauauucuggauagaagaucaaaucagccacaaaauucccuucagccaaagccuaauccagagcaaggcccuaacucucuucaauucugugaagucuaagagaaguaaggaagcugcagaagaaaaguuggaagcuagcagagguuggcucaugagguuuaaggaaagaagcugucuucauaacauaaagaugcaaggugaagcagcaguugcugauacagaagcugcagcagguuauccagaagaucuagcuaagaucacugauaaaggugucuacacucaacaacagauuuucaauggagaugaaauagccuuuuguuggcaaaagauaccauguaggauuuuccuagcuagagagaagucagugcccggcugcaacgcuucaaaggccaggcugacugucuuguuaggggccaaugcagcuggugacuaaguugaagccagugcucauuuaccauucugaaaauccuaaagccuuaagaauucugcuaaaucugcucugugcucuagaaauggaacaacaaagucuggaugacagcuuaucuguuaacagcaugguuuacugaguauuuuaaguccacuguugaggccuacugcuaaaaaaacaaaaacaaaaaacaaacaaacaaaaaaauaacaacaaaacaaaaaccaaaccaaaaaaaaccccaaagauuccuuucaaaguauuacugcucauugacagugugccuggucacccaaaagcucugauagagagguacaaggaaaugaauguuuucauggcuguuagcauaacacaacauccauucugaagcccauggaucaagguguaauuucaacuuucaagucuuacuauucaagaaguauauuuuguaaggcuagagcugccauugauagugauuccuuugauggaucugggcaaaguaaauugaaaaccuucuggaaagggcuuaccauuguaggugcuguuaagaacauucaugauucaugggaggaggucaaaaugucauuaauaguuuggaagaaguugauuccaacuuucauggaugacuuugagggguucaagaugucauuggagaaagucacugcauaugugguggaaaucguaaguggggccugaagacgugacugaauuguugcaaucuccugaugaaacuugaacagaagaggaguugcuucuuaucgaugagcaaagaaagugguuucaugagaugcaagcuacuccuggugaagauucugugaacauuguuaaaaugaccacaaaggauuuagaauauuucauaaacuuaguugauaaagcaacaacaggguuggagaggauugacucuaacuuugaaagacguucuaaugugggcaaaaugcuaucaaacugcaucucaugcuacaaagaauuauuuugugaaaggaggaguugauugaugcagcgaacuucauuguugacuuauuuuaagaaauuacgacagccacgccagcauucagcaaacaccacccugauuagucaguaggcaucaccauugagguaggacccuccaccagcaaaaagauaaugacucgcugaaagcugagaugaucaguagcauuaagauauuuuaaaguuaacuaauguacuuuauuuuagacauaaugcuauugcacacuuaauagacuacaauauaguguaaacaaaacuucuauaugcacugguaaacuagaaaauucauguggcuuucuuuauuaugguggucuggaacagaaccugcaguauccccaagguauucuuguaugaucuuaugggacuacugcuggacauuguggucuguuguuguugacugaaaugucucaugcagcacaugacuguaauacaguggcaggggggaauagcggcuguauguauggaggagguauaaaugaaacaaaauuggucaaauguugcuaauuguugaacuggguggagaauacauggaauuucaugccuacuauaaauuccuaccauaaaauuucacuauaaauauaaauuccuacuauaaauaaauacauggaacuucauuccuacuauuaaugaagguaggcuuuuccuacuucauuuaucauucuaccuaccucuauauaugcuucaagguuucuuuaauaaaaguuaaaaaaaguaaugcccagaccaggcucugcaaccaugugaaaauaugcuuuaaugcagugaacugcagaacauccucaugguuagauuuguaggucuucucacuuuuguuaaaaggacucaggaguuguguuccauauguuuguagcauuaacacccuugugaagaucagcaaaagugcaggagccauguugaaaccgcaugcaccaaaacucauuccagcucugcuagaguccuuaaguguauuggagccccaaguucucaauuauuugagccuccgggcgacagagcaagaaaaggugaguggauagcgcaggcauauugguaaguaucaugagggaagagcccuguuaagauaccaagguucauuugaaugacacugucacuacuguuaccagaacucacccucugucaccacaugcaguguuuuacuguuuuuuuggagagagguugucagcucauacacugucuugugaauuggaugaaaacugacacuuccaucuaaaaaaugaauuaacauuuguuuaacauaguuuuuuguauauuucaauuuuguuagggcuuggaucuauaccuucagaguccuuccaugggcucccucgcccuguaagcaaagaguauuugcaccuagacuuuggcauaucucaaaauuguucugcuuuuuagguguaauggagucaccuggucucugaucagggucauuuuuauuuuuauuuuuauuuuuauuuuuuuggagacggagcaucacucugucacccaggcuggagugcaguggcaccaucucggcucacugcaaccucugccugccagguucaagcgauucuccugccucagcaucccgaguagcugagauuacaggugagcgccaccacacccagcugauuuuuuguauuuuuaguagagacaggguuucaccauguuagccaggauggucuugaucuccugaccucgugauccacccgccucagccucccaaagugcugggauuacaggcgugagccaccgcacccagccugaucagagucauuuuuuaaaacuucagaugaaacauauuuauugugaaaaguuaauacagaaggauagaaaguaaucccauagaaggucucccaaucaccacaguaucauucccugaggagcaccugcugucaaaaguuuccugugccuucucucaaauuccuuuuuagucauaggcuaccaaaccaaacaaacauacuaauuuaaaaauaguaucagaccgugaauguuguucugugauuuguuuuuuaaauuaacaguauaucgugucuauauauacacuuauucuuuuuaauguauguauaguguucuacagugaggugauuuugaauuuuugauggagagguuuugcaacaucaaagguuuuaaguguucuuuuuuucuccguaccuuuggcacuguugaauaacguaugugugauaacaagaaucucauuuuucugauuugcacucuuuuccuagcauuguccauugccuuuucaauauuguauuagucguuuauauuucuucugugauuguguuuauguuccaugucuauuuuucuauuugacuguuuuuuuaauuuauauauuuuuauuagaacuguuaaacccuguuauauacaacauguuuccucuguucacuauuugaucuuuaacuugccuaaacuucucuaauaacuuacucucuuuacccuuugccucuaauauugcuguuucuucuucauucauuauuuuucccucuuucagcaguagacuugcaccuuccugggugcccauaggauguuuacuaagcauugagaauuuggaaacauaaauucuagucuaaacuuuguagcccuaggcaagucacuuguguaugccuuacuuuucucccuuaucauaucuggauaguguuaaccucuccuucagcacaguuguuagauuaaaauaccuucauagauacgaaggguaauuacaaaguuaaagaacugcacguauaaaauuuucuacugcuuagacacaauuuuaaaaaccuuagaaauuuguuuagucaguuccuuuauuuaguggauggagaaccucaggcucaagaaggcuggaugacuugcccagagccauacuaugcugauuucuuaacuguuaucugaauuucucaccuguaguguggugcugguuccccugguaaauuguugaguguaggucaaaagaaauuagaguuagacuugauguuugccuuuguuauagcuacggauuauuuuuuuuuaaaguucuuuagcuuggaagugaaagucuuuuauggguguuugugcggauuauuccuaauuaauugaaugugccgggugacuuuaauuucucuucuuuaggcugcgauggauagugcucggcuuagugcugccaaaucuucuccaaugauggaaacaaucaacauggugagugucuuaaauaauaaugagaggguuuguuugcuuaccugaaaguguaauucuucaaagucuucaggcuauguuaaaugaagcagagacuuaugggaugagucaagcagcuguugugacuccaguuuuuucuuaguauauuucucuuuucuucucuguuacuaaguggaauaaauaauuccccaaauaccagaaacaguugguccaaauuuguauuacaagagacaacaacauaucaagagcucucuauaaauuuacaucuguagucuuuugaucugccuauuuagaaagguucagaguugugccugugccuaauaguuaucuuugggaggaacuaggaaaguuauaagcuguggagguauuuaaugaaguagguaacauaaagguaugugaagagauugggcaaugucgauauguuguuuuagucauaggaaggcauuugcaguaaagggcugcuuggcauucugagguucugauuucuaaacuuccuggagucuugguaaaguuacucuguugugcauucccuguaaugguuaguuagcuaugauuguguuuacuggaaauuaguuugcuaagcagaucuguaccuuuagcaggacucugaagguauagauccaaccccuaaaaaaacugaaguguacaaaaaacuauguuaaacuggugaagagaaguagcuauuuuuuagugccugcugggggaguauuaccaaaauuuggucuaagaauguuaugucuuaguuggauuauuggggggaaauaaaaauuuaaagaaauaggaauaguuagugaauaccauuuaguuauauucauuaguaauagaaaacauguuaauugcauuuucaaaaauaaaggccagcaauuuauaggaaaagucaucuaagaaguugacucauuagaggggguuugguaggguaggcccacuguagaagaucaauauuuaguuuagguuuuuuauacuaaacauggauugauaaagaggaaguaggcccagaaagauucuucauucuugaguaaucauuauuuuucuuuuuuagcaaauugauguuuuucauuuuuuuguuuguuuuuaguguugaaucacugaugaauaauuuuucuguuuguaguacaauagugguuuuaauauugaaaucagagcagaagcaagcagugauuuuucaacuucaugucaaauccaguugguacacguuugacaagggcaguuuuuaauugaagaugugguccugacuuauuugccaaggcuuaccuuuauauuuguccuuuuucaaaagugccugcaauaccuugaugugucagugcugggcgagcuaguuccuagguugugugaacugaucagaagugguguaggucuuggaacuaagguaaguguacuuuccacaagaggaaaugugcaucuucauuaguucuggccauaaggauauaacagccaucauguuugaaauucauguuuuaccacaaaaucuaauauuauacacuaaccauuuuauuucugugguugcacugauaacugaaaacauguaacugguucaagaaauaaaacaucuaacuguuccaguaaguauuaacuuauuuaguggaaucauuucuguucucugguugccguguacauacccucuggguugucauucauuagcaguucauggaaaugcacauccaguuauuagggcauggauuguuuuagguggcaauugcauuuuucacagaggggucagcaguguuugaauagaaaaauguccuaguuuucaagaucuuugaaggaucagacaccccccuaccacccuuuuaacaacaaauuaauaacucacauuuuuucuuaugacaaaauuaacacuugcugguauuuuaaaauuuuagcauuuauagauuaggagaaaguuaaaauaaaaauuguccagaauuuugccauacagagauaacugcuguuaauauuuugaaguguuuccuuccagucuuuucugcacauguaucuucugcaguguccucuucuaauggccguaugauacuccacuguauggauguaacaucauuuauuuuacuccaucaaggaacaucugauuuguuuucaguuuuugaaaaaaauaguaaagcacugugaugagugucuucaggcacaccugaagauauuugguuaaauuucuggaaauggaaauguuagcacagugauggacaagaugacauauuuugcuuuuccagaagauuguaccaguuuucuuucuuuuucacaaugucugagaucacccaucuuucucuuggagguuuaaaaaaaaucgcugcauuacuaguuuaagaguuugccuuuuucuauauugaguccuggaggggguauuaggcuucauguauuuuauauguuuaaauuuuuggcaccuaagccaaugguuugguagguagaacauugugaccaucagauuuagaccuuugcuuuuguaacccuguaggguggcugugccagugucauugugucauuaacuacucaguguccucaggaccuaacaccuuacucaggugaguuugucaagggauguguggugauauuuuugcacagcccugucuugugugacagaguuuuaaaaaggaaaaauacuuaucauucagaccugcuugugaugcugugugccuuuucuccccucaguccccugacuccuucauuucuuugucugcaggaggugcagaguuuaucaaguuuagcagcuuuucacuguucauaaacauuugauuauuccuuagugguauaaggagguaaaaguauccucuuuuccacaggacuuaccauugauagcugauuuuacaucagcauuuuucucuucuuagauuggcuucuagacuggacuaguguucuuuauauaccucguucuuauuuugcaucuuuuuccacgauauucuaguuuaauuuuaacuuuauaucauguaaaaggaagcaaauggauauauaaauauaacauccagaaaucuaaacuacuguggaguaaaucagauguuaauuacaggguuagguuuguuuggguucugggaacagaguggaacauuuggucaaccaaguaucagauuuuuuucucuuuauuucugguagguaaacuuaugagugcuuugcugaguggccugacagaucggaacagugugauucagaaaucuugugcauuugcuaugggccauuuaguucgggugaguuaaauuucuugcuuaguuaaauaaaacucuuugacaguuauaaagaaauacuuaggauuguuucuuuuucagaccucacgggauagcagcacugaaaaacuccugcagaagcucaaugggugguauauggagaaagaagguaccuuucuuuuucuauuuuaugucauuuuaaauuuagauguuaacagcccaguaaaacaguacaaauuaggucuuacccuccaugauuuuaugugauuugcuagaaacauuuguuucuuuucuuuucuuuuuuuuugagauggugucuggcuuugucgcugagguuggagugcaguggugcuaucucagcucacugcaaccucagccuccugggcucaagcgauucuugugucucagccuccugaguagcuggaacuacaggcacgugccaccacgccugguuaauuuuuguauuuuuuguauaggugggguuucgccauguugcccaggcuggucuuaaacucccgagcucaagcuaucugcucaccuuggccucucaaagugcugggauuacagguguaagccaccacaacccagccugcuagaaacauuucuaauugauuuuaccuguuuguuuugcuauuauaugaguugaacaauagccuguuuagaucaguuacccuuaaaaacaauaaauaucguaaagauuuugguuucuccuuuucagaaccuaucuacaagaccucuugugcuuugacuauucaugcuauuggacgauacagcccugauguauuaaagaaucaugcaaaagaaguccugccucuggcauuuuuaggcaugcaugaaauugcugaugaggagaaauccgaaaaagaagaauguaauuuauggaccgaaguguggcaggaaaacguaccugguuaguaguguggccugaguuaaaccugcuucuuaggaaucacagcuagaauuuuuuacuugcauucguuauucauaaacuccucugaaguuacuuucccaggaccuuaauaugcaucccauuuaguuuuaaacccauccaaauugcucaucccauuuaguuuugaacccauccaaauugcugaguucucaagguuggcacucaggauuuuugucuuuacucauucaucacugcccacaugagagaauauaaacccugugagcaaggagagcuuuacauuuuuaauuaagagugugauuuuauguggccuuagaguauuuuagaguaguuuucuaaauguguuuuucaccuugucgcauauuaauugaugaugcccauuugugugauacguuccugugggcacccaaguucguaaaguucuacuauugugagaauaagucacaacaccaacacacuuucucucccuuugagagagugguguguuuuaacaguugagagucacugcuuuuagacuguuggucacugacuuuuuuucagguuuagaaaaaucaguuaauuuuucuugucacuuaaaaguuguuuuaauuuugcuuuccuaggauccuuugguggcauucgauuauaccugcaggaguuaauuacuauuacccagaaggcuuugcagucucaguccuggaaaaugaaagcccagggugcaauugccauggcaucaauugcaaaacagacuagcucucuaguaccuccauaucucggaaugauacugaccgcauugcugcaaggccuggcuggaagaacgugggcaggaaagguaaaggaaccauucauacccaguuaaagggauucugacuucaucuuucauuuugcauaauaguaacgaucugguuuuguguaacuuuuccaauggauuauuuuugugaacuagauuuccuagacaguggaagcuuuggguaaaccuugccugauuaacugugguauuuccucucaaacugcaacccguguggccuugcauaauggacaguaaugcuggagauagauacauuuuccauauucagccuuccaaguuacgucuuaaaccaacuugucagcauuuuguaccuguugaccucaugaacagaucaggauugggcauagaaagaucaggauugggcauaugugaaauagaguagcaagguagccugccucuaaaccuggggcugaagaugcccaucucugggaccuaugaauuaguaacaguuauuuuuuuacacaagagcuuuaguaggauucuuaacagugaacacucaguggggaacaugagauugugguaaccuaaugaucuuuauguuguaaaggucaauaguggcccaugcaggaaugaaguaguaccggacugggagucagacaucauuccaauucugugguugacacuguuuucugugagaccugggucgaaucaguucuuuaggcuucuaugaaauggaggugaagauaauuauccuacauccaugguuuggaguaaaacuugguggaugugcuuaaaauuaugcauuaaagauaaggugacuguuguuaauuuuuguugucauaguuaucaaaaauuccuaagguaauuguaaucaugguuuagacaguguaaaugacauguuugggcuuaauaguauuuccucaucuuucaaccccuuaggaggagcuauugaaagccauugccuguguggugacagcuugcagguaaauguucuuucaaugaagaugccauuucuuaaacuggacccgaaaacugcagccuuuauuaacuucugaugcuuuuguauggacccuguagugcagagcuggaaaagucugugcccaaucaacccagcacaaaugaaauucuucaagcuguucugaaggaauguagcaaagagaaugucaaauacaagauuguagcaaucagcugugcagcugauaucuugaaggccaccaaagaggacagauuccaggaguucucuaacauugucauaccucucaucaagaagguaauaccaccuguauccucaguucugguuuauacuuuaaaaagaaaaaguuaaaaaauuguuuuccccuauguccugauuauuaggauuaguuuagcugcaaguagcagagaaauuccaaaauacggccuuaaacaagauagucaaugcuauguuucucacaaagcguugggagcaucacaaaguguucagguauuccgucucuuuacagcucugaacucugccauuucuaggguguggucaucauccucaugguccacaguguguuuguguucuaggcaggaaugcagaggagaugaagcaaggaugaaggauacagugggcaugccaugucucucuugaggagaguuccugggcaccgcuagauggcacuuugacuuauagccauccuguuggucaguacuuagccacaccuggcagcagacugagucuucauucuggguguccauuugcccuccaugggagaaggggagaguggauuugguagugaaugaacaguuuaugucauaauaagcuuugccuuggcuaauaagcuaagccaccccagccauccuagaguaaaggcaagaagcucagugugccaugugaauugccucugccauauaguggaggauuugggucaaaaaaagacucaaguuucauguggaaaauggaauacucauuuuuaaaaguugggcacuggucccccccccaaaaaaaagggugugguuucccuguuuauuugugaaacaugaaauauuuuaaguaacauucuuauuucuuauugcuccuaaauugcaguuguuuucuuucaguaauaaggcuauuuaaauaauuuccauuacaaacauagugauagcauauggauuugggagacuuguguuuuaaguugauuacaucacuagcaagcuggaccaguugcuucucuuagccucuguuucucuaucaagaaagaguuuggauuuagaucauuacugaguuucuuccaucuuuaaaaucugauucuaaugcaagucuuuucauguuaugcucaaaagacuacauaugcaguauuuuuuagcuuuuguuuacagaugccuguaaaguauugccuaaauuuauuagagauacaguauucugguuauaaauucuuguuguaaauagggaaacuuaugguagagaauuuaucauuuaacucuugguuaauaucuccugccuugguugguacccugauagcuuuaauaguauaccuguaacuuugaagaagaaaauauuacauuuucuuuucuuugauauauccuagaacucacuugaaagcagugggguccggacaaccaaaaaugaagaggagaaugaaaaggaaaaggagcuccagcuggaauaucugcugggugccuuugaaagccugggcaaagccuggccgcgaaacgcggagacccaacguaagcaccagaaacugcauuugaagugcuguaaccagagguuacuuaaugagagcgaagaauuuucucuaugacaaauuauaguuauuguuucuuaucgagccugauugauuaauaaugagaauuauccagugaaaguuuuuugucuacaugagucugugaucucacugaucauuguaccgcuguagcuagggcugcuguaagaaaguaucacagacuggguggcuuagcagaaauuuauuuucucacaauucuggaggauagaagucugagauuucgagaucaaggcgucagcaggguuaguuucuccugagaccucucuccuuggcuugggaauggcugucuucucccugugucuucacguggucuuuggugucucugugcccuaaucaccucuuccuauaaggacaccaggcacgcuggauuagggcccacucauaugaccucuuuaaaggcucugucuucuauuuaauaauaauacagucaaauucugagguacugggggauaguauuuuaacauacgaauuuugggggcacaguuccaccuauaauaaccaugauacauuuuaugcagauaguuugauagacgaguucuacugaucuucuugaugaucauagcucuauucagaggaaugcacaaaguuuauuagcagggucucuuuauccugaaaugaauggucuuguuaccaaguguucaguaagcaacugaaaucccuguuucagugaaaaacucauuacuauuuggacaauuuucagaacuggacauguauuucccaaagauuaaaugaacaguaaaccucuauuauuggaugagguugcaguuaguuuggaguccccugacagggccuuaaccuugggaugauacuacccuuuacacuugaucuuagccaaaaggccaagaagugaugaugcuacccuuuaagcuugccuuguguuggguccuacagugcauccugcugaagaucuuaguauucguuuuuuuuuuguuuguuuuuuuuuugagacagggucuugcuuuguugcccaggcuggagugcaguggugcaguucuugcagccuuuaccuccugggcucaagugaucuuccugccucagccucccaaguauuugggucuacaagugcaugccacgacacccagcaaauuuuuuuugaagaggugaggucuugcuauguugcccagguuggucucaaacuccugggcucaagugauccucccacuuuggccucccucucaaagugcugggauuauagguaugagccuccaugcccagcgacaauauuauugaauguuauaaaaaguacuguugauuauuugugauuggauaugucuagaaucaguuaagguucucuuugagcccugucauccuuugugugaacuuauauauuugcuauguuuauaggaaggguuucccagaagauacaaauuugcaggugguuuuauuucuuaauauuauguuauagacugccauggaaguccacuaauaugaugccauaaagaguauuaacuuuuccuugauagguagagaaagcuaaaguagggaauuauaugagaaagaugauacaaacauaaagcaguuuauuuuaauauaagacauagaagguuguuaauagaaaugugcauuuauugagaaccaaggccuuuucuuuaggaacuuaacuguuacacauuggcuucucauauauaucuacaauuucuggguuuuguuucuuuaaaacagagaaagaaauuucaagcucuuaugagacaauccuagugcagaauucuagauuuuuuauugccuccccccauuuuuacauuuguuugagcccuacuaaauccuacaguaauuaaaaauaacuucguuguugaguuuucugcugauucaucaguuggcauaauauuaauuauauaguuauaauuacaguugcaguuggcauaacagguuuauaauaaagcacuguugacucuugguaaaccugcaauuugcagaagcuugugagcaucuagagaggagcuucuggccuccagaguucuuucuguggcugucauucagggaguuuugaggggcaaagggagugugguuaaagugcuuucucaguuccauggagaaccauaugccuugaaagugaauauuugugaacaauuauauugcaccuuugugggggcaguuucugaucaaggaaauuuguuuggggauugaguacaaagucaugcugaaguuuuuggggaaauuucaauggcuuuaauuaaaaguauuuauuguuuuauuucucuuuuuccugcuuuucucucucuuauccuccccaccuucucucuuucucuuucccucuuccuuucucuugcucucucugccugucccucauuuauuccaucucuuguucuuuuauacugucuccugcucugucccaccuugucuuuuuuucccagguuguuaucgucaggagcugugcaaacugaugugugaacggcuaaaacucagcacguggaaagugcagcuaggaguccugcaaucaaugaaugccuuuuuucagggguaaauugcuucauggcucaguuuuuuauuuuguuccuccccgcagcauuuuauguauaaucaauggaauuuuuauacauuuaaaaacugguagcuaaagugacagugauacauacagauagaaauugugacaggaaaguuuuagacuguuucuuaauaauuggcauuuguaccuugcuuucugauuuguauagguuaaugcuuuuggaagaagaacaugccgauccugaggcuuuggcugaaauucugcuugaaacuuguaaaucaaucacauauucuuuaggugaguguaguaaacuaaaacugaugagggaguccuaauuuuaaagcuaaggagcugagcuucaaauauuuccuacuuugucuuaggaacuaaauuucugaaauagcuacuggacucugcuacuuauuauacuccauguguaccccuuaacuggaauauuuaaaucuggaacuauaacaggauuuuagcaucuaguuuagaaaaaccuucgugacaaguauuuuuacaaaauuguuacuugaaaguaauuucaaacuuacagaaugguugcaacgacaguacauguaauacucugcaauauguauacacuuuaugcagaaucauuuguuaacauuuugugccauuugcuuugucauuuggacuucuauauacauguuuuucuccugaaccauuugaaaguauguugcuuacuucaggcccccuuguuccucaauuauuuagugugccacgguacaguugucaacuuuagguaguaaacauggaugcaguuuuuuaaaucaaauguuuaucguucauauucuaguuuguucaguugauucgguaauguucuuuauuuuuauuuuuauuuuuuuugaguuggagucucgcucugucacucagguuggagugcaguggugugaucucagcucauugcaaccucuaccuuccagguucaagcaguccuccugccucagucucccaaguagcugggauuacaaguguguacugucacgcccagcugauuuuuguauuuuuguagagacagggcuucacgaaguuggccaggcuggucucaaaacuccugagcucaagcaguccaccugccuuggccucccaaaguacuggaguuauaggcaugagccaccacacccagccaguaauguucuuuauaggauuuuuucccccuccccuccauuagggaauccaguccaggugaugaugaugaugaugaugaugaugaugaugaugauaaugguuauuauuauuuuugagacagggucuugcucugucacccaggcuggagugcaguggcgugaucuuggcucacugcaacucugccuucuggguuuaagugauucuccugccucaguuucccaaguaacuggaauuacaggugugugccaucaugccuggcuaauuuuuguauuuuuaguagagacgggguuucaccauguuggcuaggcuggucuugaacuccugaccucaagugaucugcccgccuuggccuccaggauuauuuauugaauuuuauugucauauauuuuuagucuccuucaaucuggaauacuucgucagccuuucuuugucuuaggacauugacaauuuugaagaauaaaguccccccgacuucccuuuuugaaaaaacagaauguuucucauuugguguuugauguuuucucaugauuauauccagguugugaauucccaguugggauacauacauaagugauguguccucacauuaagaggcacacaguguccaucugucaucauuugugauguuaauuuugauuaccuggucaagguacuaucaguuuuucucuacuggauaguuacuauguuuucuuuuugugucuaauaaguagccugugggaacagaucuuaagaucauucaaguaauuuguuucucuucuuuaaaauuucuucucuauauuuagcaugcauugaugauucuucccugaaccaauuuuuacuaagaugauuuugcaacucuagcacuuuguccacauucaccauuugauaguuggaauucuguuguaagcaagauucuucucuucugcccauguuuuuauuuaucuguuacuggcauugauucauggaaucuuucccccuucaaaugguuuauaauuuaauuuuuuaaaucuaauucguuauuccaguugucccagauuuggccaguggaagcccuuucaagcugccuccuguguccuuuugacaggucaccgucacucuuuguagcacuuuuguacuuuguagcauaacaagaugauaaggcccaucucaugccuacccugcuuugggcuugguuguguguugauuuuuuugguagacaauuucaccaugaaccagacgccgugucaaagaguggaugccaaggaagcauguuucauucgcaguuguuggcagcagcauccuuuuauggauaaagaacaggcagccaacagaccucucuuugcugaguuccaggugucccugaucggcuuaaacacugggucauauaauguucuuugguaaaaugaggagggucauguagaccuaaggaucguucuuauccgugauacgaagaugauuuuguguuugagauaguuuuuucaucucccacuucuaaaauggaucauuuaaauauugccauuuguuguggugauugguauacuuggcugacagguuuuuguuuuuccaaaguaaagacuguggacauuagcacacauuucaaguauuugauacuuagcaaagggaagcuuccuuuaaaaaaaaaaaaucagauauacccuucccuagaguuguaauuucuggacaucuuucuuucagcaacacaaauuuaaucuuggagguuguguuuuucaggcaggccauaugaacuguaugauauuucuuuuuagaaaauaagaccuacucaucugugagaacagaagcuuuaucugugauagaauugcugcuuaaaaaacuugaagguaaguuguuguuaguucugacugggggaccauaaagccauguggcauauguuuuagaaauuuuuuguuucguuuuugcuuauacucuuaagcauauacucugaaauacaaaucaguauguaugcacaugcaagaagaauggacaaagccaaaacuauuaaauuuuacuaaauauuuaaauuugauacacuuuuauauauuuuuaauauauuauuaagcuauaguugucuuaaaguaauaaaguuuuuguuuucaucgugaauccugauuuaaucuugguuaauuacaggaauugguugacaguggcauguguacauguaaauaagcagaacgacacacugaaaaguggaguuggaaaaacauuuuuaacaguuaucuaccugagucaucaaaucugacaguagcaauuuucuuaauccuauuucuucuccccuaaccucuuuuucuucuaauggucuaucaguggguggggugggggggaacuguuagcauuuucuccagugguguaucuguuacugacuucagaaggaggacccucuucuuuuuucucucucucucucaaauuguuuucacggauuaagaauguagaagauggaaacguuuuuccugcaaccuuguguauuugcucuuucuacuucucuaucuuugcuuagcaauuaaaacaccucucuuagggcuccaucaaacagaacuuuuagacugaguaacgcuaaacaucuccuaaucccuuuuuuccuuguugagauaaaagagcuaggcacuuagucguauuaccgaauucucaguuugccagauauguacuaauauaguccagaugaggaaaauaaggcugaaggcaagcuaaacuugccugaagccacauugcuaggaagugacagaaccuuguaaacaagauuuaagauuugauauacuuucuuauuuucuaaaaauuucaaugugcauguaguucucagaugcuuuccucgaagaaaagggagugucaucuauuuaucugaccuugcaauuaugacauuucuuagaaguuuuuuuuuuuuaacugaccguaucuuaugaaauggucuugcgaugguguuguugaaaugacuuuuuugcugcagugugccuugcccugauaauuccuucuuccuacuaugcuucaguguaauuauuucucuuacucccacugauacugggggaaggagaggaaacucccugaugugccucuacgcuacugucaagaauuagguuuugagacacauauugacaguauguaaugauaauuauauacugaucuguuaucaagagguugcuuugcauuuauuugggggauaggauauuuuuaaauuuuuuucuugcuuguucuauaaggauucuuugggguuuuuucuuuuugcuuuguuuuuuguuuuuuuuguuuuuguuuuuuuuuuuucaugcagaaucuaaacagugggaauguuugacaucugaaugcagagugcuccuaauugagucuuuagcuacuauggagccagacagcagaccugaacugcaggagaaagcagcguuacugaagaaaacacuugaaaaucuggaauaaauuagaaggggaagaaacaaacaagugccauguucauuggggguugaaguggugguguucuuugaaaaaccaagugggaaaaaguaaagauuaaucuguagcaugcaucauuccuuggcugaaauaaaaagaaaaagccuuaaauuuuguuccuuauuagcuuuauuuuacuuuauguuuuuaaaguaucugggcugagugagcuuaauggaaccuuggauguuugaggggugguuguaaaggaaacuggcagaaauaguuacuaaaagaguucaagcuguuauuaaaggaauuaauagacagaguugcagagcaagcuggauaaaaaucuuagaacugcauucaaauuaguuauuucaggaaggggcccuauaaauaacuuauuuuaaccucccucuuacaccugaagaaauaggaagcugugucaucucagaggcuuucugaggccugugccaaagucagaacccagguguuuaaugucuggcccuggauacuuucuuuuauggccaucugccaaaucagugcuaaccccggcuuacccaagaaacuuccaagaugagguacguuuaggguggcacacagcagucuuugugccagaacuaaacugacccuuaccauuggguuucugaaagccagaagcuaaacauugucuugucauguguuuaggugguugauuuggagaaaaugauuguuuagcaucuuuacagauggagaggacagagucagucuccuucggauaauuccaaucgucuuccuuuuacagguggauaaaguagauuaggacaagaucacacauucuaucugugucuguggcugcauauuuugcaaaaccagaaacaaaaucgcagacugccgugguuuagaccauuuauaaugucaaaacuguaaugacaaauuucuguucacuuuuaugcuaccaguaugacuuuauaggggagaaggaaagccuuuuaauuagccaccugggaauuacucuuuuaaaaaaugccuuuucucaaaagaacaugauaccacuccaaguaaaucauugccacuagggguuuuccuccuuccuucuguugcccaugccccugccugaaaguguaggguaagaggaaaaacaaguaaaaccuuaguguugaugguaaacugagaacucuguagcuuaccuuggauuccagagcagaagacugguuuacauucaguacucauccuuauugacguuaacaccaggaaucuccauguuuauuauuuuucguggaaacuccauguuuauuauuuuugguggucucuauugaccaauguauuucaaacuuuuuugacugcaagucauaauaaaaauaacuuuuuacaucacg

SEQ ID NO: 191376 - RNA, 31597 nt, Homo sapiens
agcgcagcgggggcgggaagguuguagugccgcgaguugagcuccucuugccuaaguggucgcgcccccuuuaagagcagcgauuguaaggagaggcggucccgguguccucgggucccagguaaguacgacagucuggaggcaccgggcaauagaaaaguguggcuccggugcuaaccugucgccgccgucuuuguugcuacaggcagcgaccucccuuccgaccuugccaccuaacauuucuggcuccuacuugcuuccuucgucucguucacagcccgggcccagccggcucugcacauccguaggcagggaccuuucuggcacgccagucuacccugucacaagauggcccuguuguccuccaguccuaaccccgcauugcucgcucuguguuucagccgcuggagacaccuaacgauucauuuacuaaaaaccggugucuguuuucuaucccuugugucuuucccgggcucccuagacuaaggcaucacucuuugcugccaaugaaaucaauucuuugccuccggcacugugcccaccuuuuaaagagcggguuuguuaagcuuuuuuuuuuuuuaauuaauaguaugguugcuugaauaagacuuuauuuucccuucugaaagcaggauuagggucuugcucaucuuggaucuccccaggauuuaguacgaaagcacgaaguuuggaaaccagcagcccaaauaauuccuacuagcucuaugacccuggguacgguuuccucaucuauaaaauggugauaaauaaauaaaggaacuaauuucgagcauguuacacaguguauggugcagagcagauacaguacuccuuuaccuuuuuuagcuuucaguguacacaguaguuuuuggguauguguuuuagacgaaugcagagacaccauagaugaaugauuuuucuuccuagcaccaugauuauauugacucuaucaauugguugauauauuugguaaauacaaccuaaugacguuuauuaaagacaguaaugcuaaaugguaugaacaucugcaagaauaaacaaugccguauuuaauuaaaugcuugaggcacuagcagaguuuacauuuguuucagucuguguacauuucaaauguaucuuucuuucuuuucuuuuuuuuuuuuuuugagaccgagucucgcugucucgcucuguggcccaaacuggagugcaguggcgcgaucucggcucacugcaaccuccgccacccggguucaagugauucucccgucucgcccucccgaguagcugggacugcaggcgcuugccaccacacccggcugauuuuuuuuuuuaauuuuauuuuuaguagagacuggguuucaccauguuagccaggauggucucgaucugcugaccucgugauccgcccgccucggccucccaaagugcugggauuacaggcgugagccaccgcgcccggcacaaauguaucuuucugaagagauuaagaaacagcaaacauuucauuguaaggaggcuagcuguuccuuuuaguuugugauuaaaauauggugcauuguauauguguguacacauauuuuauaggugauugugaagugcugaccaauugccacuggacauacuugaaacaaaauaggaaaauggcagcaaacucuucaggacaagguaaugacagcaggaauuucuuuacuaugaacauuuccccaauauaguaaauguauuugaauaagagaaaauuuagcauagggcaguuacuguagccagaauuuaaaaaaugaauagcaggccgggagcgguggcucacgccuguaaucccaguacuuugggaggccaagucggguggacugcuugaggucaggaaccccgucucuacuaaaauacaaaaauuagcugggcaugguggcgggcaccuguaaucccagcuacuagggaggcugaggcaggagaauuucuugaacccaggaggcggagguugcagugagccgagauugcaccacugcacugcagccugggcgacagagugagacuccgucucaaaaaaaagaaaaagaaaaaaagaagaacaucaaaguaaaacucuaaauuugaaauacacuugugcugaauaaugauguuuaggucaaugacagacugcuuauaggaugguggucccauaagaugguaauggagcugaaaaauuucaaucgccuaagugacaucuugauaauccugacccuguguaagccuaggcuaauguguuuguuugugucuucauuuuuaacaagaaguuuaaaaaguaaaaaaaauuaaaaauuuuaaaaauagaaaacuuuuagaauaaagauauaaauaaaauacuuuuuuuuuuuuuuugagauggaauuucgcucuuguugcccaggcuggagugcaauggcaugaucuuggcucacugcaaccucugccucccagguucaagcaauccuccugccucaaccucccgaguagcugggauuacaggcacacgccaucacgcucagcuaauuuuguauuuuuaguagagacuggguuuuuccauguuggucaggcuggucucaaacuccugaccucaggugauccgcccgccuuggccucccaaagugcugggauuacaggcaugagccacugugccuggcccaguguuuuguguuuuaagcuaaguguuauuacaaaagucaaaaaguuaaaaaaauuuaaaaguuuauaaaguaaaguuacaguaagcuaagguuaauguauuauugaagaaagaaaaauugaauaaauuuagugcagccuaaguguacaguguuuauaaguauacaguacuauauaguaauguccuagacuuucacauucacucacaacucacucacugacucacccagagcagcuucaguccugaaagcuccaugcauccaugcaugguaaaugcccuauacagguauaccauuuuuugucuuuuaaaccguguguguguguguguguguguguguguguguguguguguguguguauguauguauguauguguguauuuuaagaucucaauuggcuuuauuugugauucuagaaucaggcaacacuucauuucauaaaauagaauaaguguucccuaaaccauauuuuuacuguaccuuuucuauguugagauacacaaauauuuagcauuguauuacaguugccuacacuauucaguacaguaacaugcuguacacguuuguagccuuggagcaacagacuguaccguacagccuagguuguguaguaggcuauaccaucuguguuuguguaaguacacucugauguuugcauaacacaaaaucaccuaacaaugaauuucucagaauguaucccuguuguuaagcaacauaugaugguagaucugacauuggaucagauauacaacauccuuuauauuauuaaucuuauauuuuaaucuauuuuaagauuauuuacauugaaauuguauucacauuauucaccuuauggccucuucugacaucuauguucgcuugcucuuuuacuugaaaucagaaccacuuuuaaagaaguuuuauugucaucacacauuaucugugccuuuaucuucauugcuguaaaaacuuuuguacacauuucaccuguguuaagauagcuccaaaacaaaucaagucagacacauuugcugcuaucaaggaguuuuuauuuuaaaauuuguauaaaaguaaaauuuacucucuauaaaguauugaaucucacuuggcaaguaguuaaccacuuaacuacuugaaggacgccucuauuuccguucuguaucaagucugaauuccuguuugacucuauguauguuugacccaucuucauauuuuuaaauuacucaucucuguucugauuuuuuuaaucuugguuuugucuuaaacuuauggacucuuaaaguguauacucauuugguccagcuucuuucauugaccauacugucugugagauucauccauauugugcauggaucaguaguucauuccuuguuauugugggguaguauuccaugguaugacuuuaucacauuuuguuuauucauucuucuguuuguaaacuuugggguugucucaguuuuggcuguugugaauaaagcugcuaugagcauuuauaagucucuuuugcagguacuuuuuuuuuuuuuuuugagauggaguuuugcucuuguugcccaagcuggagugcaauagcgugaucucagcucacugcaaccuccaccuccuggguucaagcgauucuccugccucagccuccugaguagcugggauuacaggcgcgugccacugcgccuggcuaauuuuuuuguagaaacgggguuucaccauguuagccagucuggucucgaacuccugaccucaggugauccgccugccucggccucccaaagugcuggaauuacaggcaugagccacugugcccggccucagauaccuuuuuuuuaagagacagggucuuguucuguugcucaggcugggcucugagguggaugaagcucacugcagccucaaacuccugggcucaagugauccucccaccucuaccuuccaaaguggugggacugcaugcaugcaucaccaugccuggcuaauguuuuuauuuuuuguagagagagggucuugcuuuguuggcugggcuggucuugaacuccuggccucaagaaauccucccaccucggccucccaaaauguugggauuacaggcaugagccaccaugcugggccacuuguaccauuuuauuauuuuaguauaugcgcuucugaagagagcucucuuuguacuguuuuauauucucuccagcaauaugugaauauucugguugauucacauuuaguguugucagucguuaauuuuagccauucuagaauguaugaaguaguaucucauuguaguauuaaaaugcauuuccuugaugacaaaugcugagcacuuucguuguacuuauuggccauuguaaaucuuccuuuaugaaguauuuguucaaaucuuuuacucauuuuuuaaaaauuggguuauuucuuuuauuagcaaguuguuuuguuuucauucuucggucuggauacaaguccuuugucagauauguuuugcacguauuuccucccagucucgcuugccuuuucguguucuuaauggugguguucuuauccuguauguaauguguuauuuuucucuggcugcuuuuaggauuaucucuuuguauuucaguggucugacuaugguaugccuagaggugguuuucuuguuugggguuuguugagcuuuuuggaucuguagguugaugucuuucacuaaauuugggauguuuccauccauuauucaaauacuccaaggcucugcuuauuuuuccucaauauuuuuuucuguguuuuucugauuggauaauuucuaaugcucuaacuuuaauaacuucugccaucuccaaucugcuguucauucaauccagugaacauuuuguuucaauuuacuuuuuagcucuagaauuuccacuugguccuuuuccauaguuauacuucuuugcuaaaauaccccuuuuauuuauuaugucuuuuucccuuaagucuuugaacauauuuauaauggcugauuuuaaauccuugacugcuaauuauaucauugggguuaucuuggaguugguuuuuguugacagcauuuuggugcauaugcaucacguuuuccuuuuucuucuuauaaguugugauuuguuauuggguacuggacauuguggaaacucuggauucuguuauauucuucugaaauugugauuuuuguucuagcagacagcuugacucaacucauacucaacuccaaacucuugucucuccuguguugggcagaaaucuugcaguguuuuucagcuuccaccugcugcuuuauugaugggcugccugggaucuccccuggauauguguaguucagcagugagugaaacuuugaguggauuuuauaugcaugaauugggcuuuauuccuucugccucucccucaagccuugccccuaauuuuuuugcuacucugucagcccuaaacuugaguucuccucugacaccucaagcuaguaaggugaggcuaaccaagcuguuaguggauuggggaaugcuucaggcaaaaggccacaaguucccaaaucucaccaguugcaguuucugccugauacuggucagacuccagugccuuuaaguagugaauuuuuaauauuuuaguauuauauuuguggcaggauuagaccaaccagacuacucugccaguacuggaaauugaaagcuugcugauucuguuuuaguuuauuaguuauauuuaggacaaacuaaagguuacaugaguuucguagaauuauaguauuguaaaaagcaaguuguggugacagcuuucccagcaguaaccagcuaauaccauucuguucuccucucacauagccaugugcgauuugugugcucuguggacuaaucauagguccacauucccuugugguuguugaccucuuuauuuuuccauuaaauuauaagggcccauauuaaaaauaacuuaauuugagcucagaugaaaacuaagagaagacuauuuuggaaagauaacaugcugcuaaaaaccacacaaugcacugcaaaugaaaauaaauuuuaaauuaucccacuauucgcacagagauuuacaauaugcugguuacuuuuuucguaguuguaguaaaaacgcaaucauuuuuaguauugccuuugacugacccauagucagauccacuaugaaacauccccuaaucuaaauagaaaugaauuuagauuagcccuuuggcuuccguugcuccuuugucagggauuuuuguugaugucauggaacugcugcuacuaggaaccagcagagggaguccacaucauguucuagagacucccggacuccagugaaauuuuaaaauucuuauuuauucagaucuauuguauuuuucucucucucuuuaauuuaauuuuuuuuuaagaggcagggucucgcucuguugcccaggcuggagagcaguguugugauuguagcuccgugcagccuccaacuccugagcucagcaucccaaguagcugagacuauaggcacaugcuaccacgccuggcuaauuuuuuuucuuuuuuuuuuuccuguagaaacagggucucgcuuuguugcccaggcuggucuugaacuccugaacuccuguucucaagcaguucucucaccuuggcuucccaaagcauuggaauuacaagugugagccaccaugcccggcuguauuuuacuuucuguaguaaaucauuucuguacuguuuguauguauaagaauuacuuaauauggagauuaauaccaagggccuuaauuaucuuaaaaugauaacugaaagaaccaugauuuaaaaaaaaucuuuauguguuguaauuuauuaauguaaauaaauagauuuuacuuauuaugucugguguagagaacaauuccguuguguuggggacuaagcccucuuucagaucuagcagucuuucaugccgucauaguaaucaggacugcuaaauuucauacgcccuugacagucacugcagucccauguucuucauacuguccaauguaguguagaacauuugguaggcuuucaaucaugagaauuuuaguaugcagaggcagauugucaaccugggguuuggacaagguaccaaaagcagcacagagucuuucauuauugguaaauaucaagguccuaugaugaugugauggcauuggauugguucagccugauuuuagagagaccuggugaaauacugaguaaggaacaugaauucuuuuauuuuuuucaauuuuacagauaucugaaaaugcuuauaguaguaacuauaagaucugcagaucagguaguaggaacuauugauuuugggccaguccaggugcucucagcugugauuucagcaugcugcauaggaguagaauggcaaggcuccugggaagugucuuguuugaccucagacccaaguacaagucuucaccuaaaccauauaugguccagaaggaaagcaaguuuauucuucacguuuauacuaaaguaugccaccucucaauuaagaguuugucccagugcagugaugcauaaauagcaucugaaaauucuucuauuuguaccuuuuuaaagaugagaguuuguaugcaaagacacaauuuggaguagguuucugaaggcuaaaucucuuuuuguugcauuuuaauugcuauggcaaagagaaugaauuagauuucugaugcuaggcuugaccuguaggcuccagauugaaauuguaacugggaagaauauuauguaaaguaaucugagacuguuuguguaguuaggagagaguauaggauccacacaugcacucagacuggccugggaguucugaaaugugaauguaauuagaaagcugcaugccaauuaguuguggccuaucuaaugaaaaacuucacugacagagaauugucaaugugggaugacaggaaucuagugauguuaaccugaugacuagggagaaagaaugcuagauaauaauaacaauaauaguguguauuuauuaagcaacuaccauguggcaggcaguguucuaggucuuuuacuuauauuuuucuguauuuccuguaaccacccuuugaaguguuacuguuauccccuuugguccugaggcauggugagguaguuuuccuaauauucaguaguaagugguagugcugaggugagaacccacguugauuccaugucccacguuccuuauucauucuguuuucccauaccgcccuucaguagggggaauuacaacauucugaugauagaucugauaggaaaccacugggcgcuugagacaaggggcaaaagaccucuucuugaucuuuauugggauuaaucuaaucgucuacauugguuauuaagcagaaaaugcuuuaaaugaaaagggccugugaguuuauaugugagaagaaaagaaaaauaaguggggaagaaagguugauucaagcagaagauacaucaucaucuuacaaaccucaauggguagaaaaaguggcaguaguuuuaaagaaguaaguccuuaggucuaggugaaagagaaugugaacacagaucaccugagcagacauuagggcuugauuccuuuucuuuguuacguauuuuugguaaacucugaaagguggcuaaugauugaguaauuuuuuaaucuugcaagauauaggaaacauucgucauuaacuagauuuaggacagagcaagaaaauggauucuuuccuagaauccauuuagagacccugucuuugaaaaaaaaaaaaaguuaauaaaaaaaauuagcugggcauggggcugaggugggaggaucgcuugaguaugggagguugaggcugcugugagcccugaucauaccaccgcacucuagccugcacaacagagugagacccugucucaaaaaaaauaaagaaaaugaaugcagcccugucaacaucuugauuuuagcccagugagaccucugaccuauagauccauaagaaaauagauuugugacguuuuaagccacgaauuuuggguaauuuguuacagcagccauagaaaacuaaugcauauuuaacugcaagaaccaaaaaaaucuaggaacccuccaugacaccuucuuccucauuccuucauauugaauccaucacucuccuccugauuuaacuuccuaaauagcuauuggauccguuuguaucucugcauuuccauccacuaaaaacuuuuauuaucucuagcucuuucuacugugauaguuuccugacuauuuucucuugucuauucucaacauugcaguuagagugaucuuuuuaaagggggaaaguuuauuuuguuccucaccccuacuuuuaugccuuagauuucaguucaagcaucacuuccuuugaaagccuucucugacacugcuccccccgcuuucacgcuaggucaaguuuauuuagcauucauuccuacaauaaugauuguuauaaaugcucaucaaaugguuucuuuauuucagacuacucauguuagauuuuaauuacacauucauucaugugauuauuugauugaucucuauuuucacuggacaguuugaaaaccaugaaagcuagaaucaugucaaguuuugccuuaucauugcauccuuagaaccuaacuuugugccuguaugugauagcaugaaagacugcuagaucugaaagagggcuuaguccccaacacaauaaauauuuguugaaucaauaaauaacugaaaacauguuaaacauguuaauagugccacagugacguugcucuaguacuaaacauaggugucucaacuaugguacuuuaauguacuauauaguugugaagaguauauagcuuguaggauaaccacuugacaggauuuaaguaaucuuuuaaaaauuauuguuaugaaaguguaguagauuguccauaacugcauaaucaaaauaauuuucacuuuuagcuuuagauuuuuuuuacaauaagaagaauuucaguuagucuuuaagugugauagagcuguuaaaggaaaaugaguaucagcucuuagauuuuaaaugcaaucugauguaaugcuaguuacuugagaauguuuuuagugacaaagaaaugugcgggaggaaaaaaaagaaaugugcgggaggaaaaaaaagaaacgugugggagucaaaauguuucuaugaaugaaugagaaaaugagaacauacgugauuaugaauggagauaguguuauaguuccaaaaguggaaauguuuuuucaaacaaaaaccaggcaacagaacaagauccugucucuuaaaaaaaaaaaaaguuugaaacagauuuuuuauuuguuuuuuaaaaagguuaguuauaaagggauauuaaacauggcuugguuuaaaaaaaaaaaaaaaaaaagaggccgggcacaguggcucaugccuguaaucccagcacuuugggaggccaaagugggcggaucaccugaggucgggaguucgagaccggccugaccaacauggagaaaccccaucucuacuaaaaauacaaaauuagccaggcaugguggcuaaugcguaauuaugcuggcaugauuacgcaugcuugcaaucccagcuacucgggaggcugaggcaggagaaucgcuugaaccugggagguggagguuguggugagccgagaucacgccauugcacuccagccugggcgacaugagugaaacuccaucucaaaaauaaauaaauaaauaaauaguuucugccagguuuggugguucacacuuguaauccugguacuuugggaggcugagguggaaggaucacuugaggccaucaagaccagccugggcaacacagcaagaacccuguuucuauacuauuuuuaaaaauuaaaguaauaguucuuaccguacaugagauaauauauuaaacaucuuugugcuucugagacuaaaaagagaugcauugaauuauaucaggagacuauauggguuaaaaagaaacccucauguagugaguauaacauuguuaaaaguuauauauugaugcccuaguuagaguaaguuugaacccugaaauuaagagaaucuuaccauagaaaauuaugggcugggugugguggcucaugccuguaaucccacuacuuugggagucugaggcaggaggauugcuugaagccaggaguuuaagaugagccugggcaacauagugaggcccugucucuacacaaaauugaaaaaaaaaauuagccaggugugcuagugcacaccuauagucuuagcugcuuuggaggcugaggcaggaggaucgcuugagcccagggauuugaggcuucagugagcucuauuuuuaguuuuuugaggaaccuccaaacuguucuccauugugguuguauuaauuuacauucccacuaacagugugcaaggguucccuuuucuccacauccuugccaauguuuguuauugccugacauuuggauaaaagccauuuugacugaggugagaugauaucucacuguaguuuugauuugcauuucucuaaugaucaauggcauugagcaccuuuuucauauugcauuauuucuugaacaagucucuaucucacugccugucuccgauccuggauuaacuuuucccugcggcaggucucuucuacccuguaaucuauucucucuuaccaccagaggguguucguaaccgugccaagacugaucucugccucguccuuuucuaaauacucugaguagcuccccauugccuauuugaucaaacuaagaaucuacauguaauacaaggucccuaaauauauggcuccuucuuaaccuucccagcugcuucuuucacugcuuuuuccacacauaauuugggcuagagucacuuguauuuauuugccaauucccaagcauucuguuccauuucauucuuuaaugucugaagauauuuggggcauggagaaaaauacucaucacugcucauaauuuaauacucaguuuaguaaaccuacuuaucuaauacacuaaaguucuaaaauaaaauuuuuuuaaacauuuaggcugggugugguggcuuaugcguguaauuccagcacuuugggaggccaaagugggagaaucacuugagcccaggaguuugagaccagcaugggcaacacaaggggaccccauuuguauaaaaacuuuuaaaaauuagucagguaugguggcacaugccuguggucccagcuacuugggaggcugaagcaggaggaugccuugagccggggaugucaaggcuacagugagccuugauuaugccaccugcacuccagccugggcaacagagcgagaccuugucucaaaaaaaauuuuuuuaaaaacauuuagacauuguuuauaagcuuauuuaguuaaauuauguuuaauaccaguuuaaguuacaauuauaauuaauuauacugucuguuaaacuucacuuuauauaguggucaaaaauuuacuuaaauguauuuuaaaauauuaaccuguugguuuaauuuauucauucuauacuuuuuuuuuuuuuuuuuuuuuuuugagacagggucucacucuguuacccaggguggaaugcaauggcacagucauggcucacugcagcuuugaccucccagguucaagccauccuccugccuaagccuccugaguaacugggaccacaagugugcaccaccacauccagcuaauuuuucuuauuuuuaguagaaacgaggucucacuauguugcccaggcuggucuugaauuccugggcucaagugaaccuccugccuuggccucccaaggugcugggauuauaggcaugaaccacugcauucagcugauauauuugcauuuuuauauuucccuagaguuauaauacucuuccagauuucuauuucuauacuuuccagaauuauaguaauuuuucuauaccuuuguagguuacaguaaucuuaccacuaccaaaacaaagcaaaauuucaaauuacugagaguucagaguuguugauggauuugauucuuaauuaaaacacaagguuugguuaugccuaaagcuuacccaaacuguguugaugggcaaccuaaaguguuggugugcauuaguuccccucuauaauugaauguuaccugcucaggaggauuuuuuuuuaaguucaugccuuucucauagacuguuaguuucuugcagccuagaguuauuccauuaauugaaauauucuuuauuuuuugugugaucaguguuucauagcucagugcucuguugucauuauaacuugcccuuuucugguagcaguggugcuaggaauuauagauguuuccuuuccugagcaaucaggguuccggucuguacugugagcucucuaggauauuggacuaauucaccguuuuagaacucacaaugucuacucggucauugugugugaucaaacucaucagccacugcgucuucuuuaaaaauacauauugcuguauguguuagggccugugcugaucugaauuucuuguuuuugguaugugaccuacuuuuuuuggaacuguuuggcuuagucgcacacaauucuuuguaacuacccuacccuccuuguacugaaacaaaaaaguauacggcuauacuucauaaauagacauauacuuaacaggagaaacaaaacaccuaaguauuaacaccaaccuaguuauuaauauaauaagacauuggauacccuauuauuuucacccuuuuuuacaacuaucuuuuuauguaucuuagcuuucccuuuugcaucucauuaugaauucauggcuuaucacagacuuaauuuauuccacuuagcuguaauuauuauucucuuucuaauguucaaauugugacagccuggcuaaccucaaacuggcuucuuuguccuuuuagcacuuacccuuggacguuuuuuaaaaauucuucucggcugggcacaguggcucacgccuguaaucccagcauuugggaggcugagguggaaggauuacuugagaccaggaguucaggaucuugucagaagcaagauaguccaaucgauuuugauauuuuuuuccugcccuaagacauggaacuaguacucucccuuguuguuguuguuuuguuuuguuuuuaaagagacagggucucacuguguugcccaggcuggucucaaauuccuggccucaaaugauccucccacuucagccuccgaaagugcugguauuacacaugugagccaccaugucuggccucugguuccuucuuaauggagaauaguauuagagaccaaaaucuguucaacauggaguugaggauaaggagggaggcauuuuugcuggccacuguagugacagagcaggagaccauguuucucuuagagcauauguuaauaaugucaguccaguuuaacauuacuaaaucuuuuucuaucucaccauuuuucuuuauuauaagguugcauugaccaugaacacuaucauauuggcauauaacuuucuguaugaagaucccucugccauggaaugcuuccucucaccccuuuucacuaguuggcaaaguucuuggccaaguaaaaugagaggaggaggggguagaaugaauuucauuuaaagcucaaccuaguucagaaauguuaaacaaaaccagagcaauugaauauucuucugauaucuugcaguauuuuuguugaauucauuuucuuccacuaaaaaaaaaaauucauacaaacaauauugaaucaagcuauccugucagcuugguguuauauuugaaaaucauuugucaaauuauauuuacaucauacucuuagcauuuauaaauuuuucauccggggacagugucucaugccuguaaucccagcacuuugggaggcugaggugggcagaucacaaggucaagagaucaagaccauccuggccaacauguugaaacuccguuucuauuaaaaauacaaaaauuagccaggugugguggcacgugccuguagucccagcuacuugggaggcugaggcaggagaaucgcuugaaccugggaggcagagguugcaaugagcugagaucgugccacugcacuccagccuggcgacagagcgagacuccgucuaaaaaaaauaaauaaauaauaaaaaaauucuuacauuacuuggaacaugagcguuuugcacaacuuuucucuuucccaugccacccucacucucauguacuuugaaaacaaaaauauucuugugcgauuguaauuuucaauauuacuaaucagacuguacacuuuaaaaaauaauuuauagaaguuuauguauguugaagggcauugaaaaacucaguugugcuccuagucauaugaacauuauugaucagauuaucuuuauaggcuuuuuaaugcuuuuuccauuguuggcuguacuucauauaauuuuuauauauguauaauuacugacagugaccccaaaauauuuuugugugaacaaguuaaucuugagggaaauugauacugcugcaaacaacagaucaggauuuuccaauguggccauuuacuuugcucaugacaaaauuuagacauuaucagaguuuaaaauuugcuuuucaagaauuauguguguguguguguguauguguauauauauauuuuugagacaguuucacucuguugcccaggcuguagugcaguggcacaguccagucauggcuaacugcaccuugaacuccuagauucaagcaauccuccugccucauccucccaaguaguugggacuguaggcacacaccaucaugcccugcuaaauuaaaaaaauuuuuuuuuuuuuuguacagacaaggucucgcuguguugcccaggcugaucuugaacuccuggccucaggugauccuccugccucaacuucccaaagcacuaggauuacaaaugugagccaccuggcccuauuuuauauuuauaguaucucuuaaucgcuaaaaagauggaaccacauaauuaucuucuaaaaauguaguagccuccacugagaaaaacaagucuuguccuuuaguugacaauaagcaugugcaauuuguauauauacaaaugggagagugccaauuucccuuggaaaacauucuucacuuuacaaagaacucaccuuuggauuccucuaaaugagacauuccaguauacuuaaacacgucuucccauaauuaucuuaccuuaauucguauuauguaacuuuuagggaaacgucuguuguauaaaaucaauaauaccuguauuuacaccuuuccaucugauucauuguaagagcaugauuuguuugcuuauuuggguaacaggcucacugugaaguaguaaauagagcaauauaugagaacaacauaacucuccuuaguggacugcuuuuauuuuuguuuuuugagacagaguuuugccuuguugcccaggcuggagugcaguggcacgaucuuggcuucacugcaaccuccaccucccaguucaagcaauucuuaugccucagccuccugaguaccuggaauuacaggugccugccaccacaccugacugauuuuuuguguuuuaguagagacgggguuucaucauguugcccaggcuggucucgaacugcccaucucagccucccaaagugcuaggauuacaggcaugagccaccguuccuggccagugggcugcuuuuauaaccauauuaauauauaguugacuaacagucaaaggaaauuuuauauauauauaucuguuuucuguuuuuucuuuuugagacagggucucucucuuuugcgcagguuggaaugcaguggugcaaaaauagcucacugcauagcucaccacucuuggccaggaacuauauuaauguuaguuuggagccuauaguuacagauuuccaccuuugauuuccauggaaacagggagguuacuauaccuaccuaugcucugauugucaaacaugcaugaaguuuuugaaagugaggcucuuccuucuugaccaagccaaucaagacauacaaguauguaauuuuuuaaaaaguugaugaaucuuauaaaauuguuuuuguagguagaaaaucgucaaauauaggcaguuuuaacuuaaugccuaaaaauuguaguaguuauguuuauauaauauucuuuauauuauauauuauauaauauaauuagguauauauaauauauauauauauuauauauaccuaauuuauaagucuuuuuggagauggcccugauaaaaugggagagaaauugucauucaguugcuuggguagugguugaagaaaagaucuaaagcugugguuugugaacuauacaccauggcauccuagcaccccauggaaaaaucccaggggccucauggaaaauuguuuugaaagcaaacacagaacuaccuauacuaguuggacaccacaugaaguaguuugagauaguucacaguuucaacagugcacuccauuccuuucaaugacaucauaucuuugcaaaguuagguuuuuagcaauugcuuugauaaccaacaacuacugugugaaaaucaguguggaacagggaaugaggauugguggugucugaacugauuccaagguuugaaaagugauacauagcccaggcacacauccauuaguaaguaauuaauugugguuauuuaaaaaugaaauuaaauauuuuuuauuucauguuauguguauuauuuuuuaaaacaacuacaagauguaaggacacaaauacuuacuagguuguuuggaccugacuacuuacuaaacagaaugguuauguauuuguuggccuggggugucaugcaaacauugcugagauacuaagggcacacugugaaccaagaaauuaugagaaccucuggcuuaaaguaauuagacuaccccaucagaauucacauagcugaccaagucauugauaccaaguggaaagguacauucaacugaaauuucucauggauagcguuuuuagaguugccaccccauucugcuuguuuaauauuaugugacaaacaucuguacaguaauccucccuuacccaggaggaauauguuccaaaaaccccaguagaugccugaaaucacagaugguacugaauucuuuauauacucuauuuuuuccuauacauacauaccuacgauaaaguuuaauuuauaaauuagacacaguaagagauuaacaacaauaauaauacaauuaacaauuauaacaauauacugcaaugaaaguugugugaauguggucucucucucucucugaauaucuuauuguacuaccuuggccuauuuuuguacugugguugaccacagguagcugaaaccgcgaauauggggugacuacuauacguuuuaaauucugauuacuacuaaagagaaagaaucuuuuuuaaaauuuuguuauuuuuuuuuuuagagacagggucuugcucugccgcacaggccagagugcaguggcccaucauagcucauuccacugagcccaagugauccuccugccucagccuccugagucacugggacuacaggcauguagcaccacaccuaacuggaaaaaaaaaauuuuuuuuuuaagagauagggucuugcuauguugcccaggcugaucucaaacuccuguccucaagugauccuccugccucgaccucccaaagugcugagauuacaggugugaaccacugaaccuggcccguuuuuaaauaaaaauaauaaugcaaauaagaaauaauuuccuaaaagaugucucagguauuaagacaccuagaaauucagaaaaucaaugaaaauaauucuguagccuggaauucaaacauuauugaagucugaagaacaauucccuucucuacgucuguaucuggagggaaagaaggcuauuauaugagagucacugugguguucuaaaauaugagaaagagacagaccauuuuucugcuccuuaagauaguuaucugaccagcuuuguuaaaacugggaaucuaaggaucucuuaacuccauuuugguuugaagaaagauauuaauauugaaauacauaguugcacaccaaauggcaguggggucaggguugggguacacuuuuauaucugcucucauuuuuccaucccugccagauaguuguuauuucugauucuaauuguuacuucugauucucuaaaucaguggacuuguaauuauauauugcuuugcuaauuauguuuccuuaacauuauuuugacaaaguuucaguuauuauuuacauauggcuccuuuuaccaucagauugccauacacaggcauaaaugucacaaauauuaagauaguugaaguuuucagagcggcagacauuuggggaaaauuauggaaccuucauguguuggagcuggaaagagccuuucagucaggacuacuuuaaucauuucuuuuuuuuuuuuuuuuuuuuuuuuugagacagagucucgcucugucacccaggcugaagugcaguggcauaaucuuggcucacugcaaccuccgccuccaagguucaagcaauucuccugccucagucucccgacuagcugggacuacaggcacgcgccaccacgcccagcuaauuuuuuguguuuuuaguagagaugggguuucacuguguuggccaggguggccucaaucuccugaccucaugagccacccaccucagccucccaaagugcugggauuacaggcgugagccaccgcgcccagccuacuuuaaucauuucauuuaacaugaauuaauuugccuguuuugggauacuuuaagcaaacugcccuaagcaaauaacaacuguuuauggaaggauuuccauagguaaugauguuuucauaacucugauaugagacugggagguauuuuucauugauucaaacuuuaguauuuccuacuucuguucugccucauuucuucuuacugaauccuaaauugagauagaagaauaccuucuuacuuuccuuucagaaauaaccaauuguguaaguaauacauucuuggaauuugguuguugugauaccaugauauaauaagaaacauauuuggucauugaccaugguuccuaacauagagcuccuaaaacucuuauaauuuccugagcaguagggguacuaggagaauguuuuguucugauauuugguuuuguuuuguuuuaagugacagggucuugcucuguugaccaggcuggaguguuaaaggcacgaucauggcucacggcagccucuacuucaugggcucaagcgauccuccugccucagccucccaaguagcuagccuacaggcacaugccaccaagccuggguaauuucaauuuuuuguagacauaaggucuugaauaaccauucuguuuaguacauagucagguccaaacaaccuaguaaguauuuauguccuaacaucuuguaguuguuuuaaguugcccaggcuagucuugaacuccuggccucaagugguccucccacuuuggccucccaaaaugcugggauuacagguaugagccaccagccuugcucugauauuuguccuugaaccccauuuccuaacacagagcucugaagaccuuugugauuuccugggugaugggagcaucuuuuguucaaugugaugacucuuuaugggcccuggauggaggcugguugccagggaaaccaacccuauaauuugaggguuggaacuuucagucccaccuacugaccuccggggaaaggagagggacugagguggagcugaucacaaauggccaaugauuuaaucaaucaugccuauguaauggagccuccagaaaaccccaaaaggacaagguucagaugagcuucuggauagcugaaugugugaaggugcuugaaagauggugugccggagagaguguuaaagcuccaugucccuucccacgugccuggcccgaugcaucucuucaucuggcuauucaugucuaaccuuuguaauacccuuuauuaauaaacuagugaauguaaguaaaguauuucccugaguucuguaagccacucuagcaaauuaaccaaauccaaggagugagucaugggggcccccgguuuacagccagucagucagaggcauaggugacaaccuacugccuacuugccauuggcgucugaaguggcgagcagucuuguagaacugagccucagcuuguggggccccacacuaucuccagguagauaguaucagaauugaauuauaggacacucagcugguguccacugaagaauugcuugguguuagaaguuuuguguugaaugagaguagagaauaguuuguuuuuuccaaaaacaguuugguuuuuccucugucucucaaagcuguauuaaaucuuuccuugaguagaagacuucucucgagacaggcguauccauaagacuggguggagccagucaugacgugcagcauggaaaggccccacagagcuucuuccaccggaagauuaagcucuaagagaucaggcaggaaaaagggauuggaguuaggaugagaguaaaugaucaauacccuggaaggcuuagaaaacucucuucagaaagaccacaaugggcuuagcucaguugcucacaccugcaguccuagcacuuugugagacuaaggugggaggaucgcuugagcccaggaguucaagaccagccugggcaacauggugaaauccugucucuacaaaaaaaaaauacaaaaauuaguagggcaugcuggcucacaccuguagucuuagcaacuugggagacugaggcaggaggaucgcucgagcccaggaguuugaggcugcagugagauaugaucacaccacugcacuccagucugggcuacagaacaauacccuggcuuaauacauucuggcaugucuucuucuucuccuucuucuucuccuucuucuucuccuucuucuucuccuucuucuccuucuucuucuccuucuucuucuccuccuccuccucccccucccccucccccuccuccucucccuuccuccuacuccuccucuuccuccucuucuuccucuucuucuuuuuuaaugaauuaucuuauccaaauagagggagucugcuauuacuagaguuugaugacauagcaugggugggcagagaggggaaaaugggagaugauagaaaugaaugugccagagguuuauuuugcccagaauccuggccacagacaguaugcuaaugccugauugaagaacagauuuagcugaaaacacugcaaaaggaguaugaauacuccuucuacagccuacaccaucccuagcuagucucugcuccucucccaaggagaggaaaaaguuugcauccuaccaccuaauucuuccuguuuauaaucaguauaaaauucuuagacuccuucauguggguacccuuaggagugccuaggucugcucugcuuggaaaaugugcuuuccucccauauucauucuucuggccuaaugauuccagucuccugagccaucaucguccuuaucuuuuuuuuuuuuuuuuuuucuguaguucuguuuuccaguccuuuaaucuuucuuuuuguuuuucuaaauuagggaucagaaacucaaauucuuacagauaauguaaacaaggugauaaggauuguaaugagcuggagagugcccagcuaaaggggacaacuauuucuuaguucuggugaauuguugccgugggggcauauagaucacuuguugccagaucuugagauauauuucaagagaagcuaggaaucugagaaauuaguguacaguuucucaauguuuacauguuaguauuuaauucugauuuuuaaaacauagcuaggaguugcuacugggccauaacuuggcaaccucuacccuauaucuuacguaaguuugaagcugaaaauccagcccaguauuaaguauuugacaaaggccauaucucuuuguauccugucaguuacgcuccauuucuuucucagaauugcuuucuggucaguugaaauucuuugacauguuccuugaaaaauuauccaacauaucugaauggaagcaguugagaagaagaaauauuuugaucugaguauguuuacugcuuuuuccccccaugaaaaaggcaugcagaaagaggcuucaaauagaagacuaagaacaucugcccucccaaagauugacucggcaggauagagacugcacaggccccugcagcauuuggguccucaaagauuuuguuaaaaaacaaaugcuguaacuuauaccuuggugauuaaaauucuguagaacuaagucuuaaaaguccucagcuacacuuuaaauauaauaugauuugauauuauauucugcuuaaguauucaugaauuaugcuguuaaaguuacugggaaguaggagggaagaaguaaccauuuagggaaaguacuuacuggugaauucauuaucauguuagagaauaggaguuuugcuuucuugguucuagaugacuuagguuauaaaaauaggucuaaaauguuucugauuacucucucuuucucccuuuucuccuauuccccucuuuuuuuuagguuuucaaaacaaaaauagaguugcaaucuuggcagaacuggacaaagagaaaagaaaacuacuuaugcagaaccagucuucaacaaaucauccuggagcuagguauugacacuauaauguggguuuuuuguuuguuuuguuuuguuuuguuuuguuuugagacggagucucgcccugucccccaggcuggagugcaauggugcaaucucggcucacugcagccuccgccucccggguucuagcgauucuccugccucagccucccgaguagcugggauuacaggcaccugccacgacacccagcaaauuuuuguauuuuuaguagagaugggguuucaccauguugguuaggcuggucuugaacuccugaccucaggugauccacccgccuuggucucccaaagugcugggauuacaggcgugacccaccgugccuggccuguaaugugguuuuuauauucagugauauaaaaauuucuuggaccaaauaauucaaguuggcuggcaaugauuuuuuucuuuaacacugcaaucuauucauuguguuuucuuuguauaggggaggcuaaacuuuaccugugcccaacuuaguucuuauugggagggaccucuguaacaaaagacagauuaacaagagaaaaacaaauuuaugagugcaugcagcacacaucacaagggagaaaccuuauaacucaaaaucauggcuuagaacucuacuuauauagcaucuucaacaaagaacaauaaauguggaacaaacaaaagggauuuuaggcuucuuggggugggaaacugagaagguaaauauauggagaaaacgaauggaguaaggcuuguuggcagaguccucugcugcugucccuaggcuaagagucuagaguugucuccaguagaggagaaguucuauccuaucuuuaggcagaaaguggggaggggagagagagagcuuuuccucaguuugcugcugccuuuuauuuuuauuuuuaagcaacccuauuaacugagcugcuucuuaauugcuuucagcucaaaaauaauuuuuauaucaaagaagcauauuuuaggugacauauucuaguucccuucauuuccuagucagacuuuuaacaaacuguuuaguugauuaaauuguaaacauucuaacuagaauauuuaauuuucccuauagacuucauagccuucagacuuuuuuuuuuuuuuuuuugagacagggucuaacucugucaccuagaguggaguggaguggcacaaucauaacucacuacauccugagucuccugggcucaggugaucgccccugaguaucucacacuacaggugcacccuaccauaccuggcuaauuuuuuuguuuuuuaguagaaacaagugaggucuuguguugcccaggcuggucucaaacuccuggccucaagugauccuccugccucagccucccaaagugcugggauuacaagcguuagccacugcaccuagcccuuauagccuuuuuuuuuuuuugaguuuuguaugguuuuuuauuacugcaauugcugcuagugccccacuuuuuaaucauucugcaaaguaggccaaauuuagguagcuugaugaucuuuauuauagguauucagucucugccauauuuaguaucuucccucagauccauuauugccgggcaugguggcucacgccuguaaucccagcauuuugggaggcuaagguggguggaucacuugagcccaguagcucgagagcagccugggcaacguggcaagacccaucucuacaaaaaauacaaaaaauuagcuagccaugguggugcaugccuguagugccagcuaccugggaggcugggugggagguucaccugagccugggagguuggggcugcaaugagcugauugcaccacugcaauccagccuggaugauauaguaagacugucuaaaacaaacaaacaaaaaagauccauuauccccuucagccaccaccacccuaacucucuucugucuuucucuuaaagcaauuggcuguacucaucuuuacuuucucacuuauugaugccucaacccgcugcagucugacuuccaggcccuccaucaaagaaaauguucuugccuaggucucuuguaaccuucccggguuaaaucuggcagaccagaguccuuuucuuaucagacaucuuaguguuauuugacaccacugaucacuuucuuucuuuucuuuuuuuucuuuuuucuuuuuuuuugagacagggucucugcugugcaggcuggaaugcaguggcacgaucuuggcucacugcaaccucugccucccauguucaagugauucucgugccucagccucccaaguagcugggauuacaggcguaccccaccacacccagcaaacuuuuguaauuuuaguagagaugggguuuugccauguuggccaggcuggucucaaacuccuggccucaagugauccacccaccuuggccucccaaagugcugggauuacaggcgugagccgcugcacccggcccacucucuuaaaguacucucuuggcuuccauuugcucacucggagaauguaaaacacaguaggaggagacuaucuugauuucuuuuguggacauuucucuauuugucccuugaaugcugacagcccuucgaauucuguucuagaccaggcuuccuagccugccuguuuucacuggacaguugcaucuuuucccacaugcuguuauuuacgugcuaaucacuuacgcauuugcagcucuagucuguccuuucuucuaagcaccaccucugccuccuggaugucucuacuuugauguccacaggcauuucaaauguaguaugucccaaccugaacucauucuccccgcucuccaaucagcuacugaauauucuuguguauccugucucaguaaaugguucaggcugccaucuacuaguuacaaagucagaaaugugaacuucaguuguuuaccauuccuuucacuuucaucuccaagcauucaccauucucuugugauuauacuuugaaaggugucucacaucugaccauuuccuucauugcuacugaugcuauccugauuccuggccacucucauuucuugccucaauuauuauaacugcuucagaguuccuguggucuuacgcuucuugaauacauucaucaguugugucauuuagcaagcuuuaaucgggaaguaacagaaauauaacaaaauuggcauaaacauuuggguaucuguuaaccaagagugugaagauaagguaguuccagaguagcuuaauucaguggccacaauaucauuagugaugcagcuucauucaucuuuccuuucugcuuuaccccaugggucaguggcucccucaggccagaauaugacugcaguggcuuaggcaucaccccgcacugagccaccuguagaggaaaaagccugaaagguuccuauggugugucccauuuguaagagugaggagaacacucucagaagccuuccuguagacacccaucaagucugguugcccagauuauguaccuuucucuugccuaaaccagaaaccagcuaggggaaugacauugucuuacaucaaucaaggucuacccccuggggcaugagccuggccugccuugaagcaugugacuacugauaauugaaccaaguuuggguuccaucagcaaggaggaaaggagacaaacaacuguugaggaggugaccaacacugucugccacaguagugcaauaguggucuuucugaacuacaggaugauaguucuuuuuuuugagacagggucucacucugucacccaggcuggagugcaguggcaccuucuccagaccucccaagcuuaagcgauccucccaucucagccucccacguagcuggaaucgcaggcacaugccaccauaccugguuaaucuuguuuuuguagagauggggucucacuguauugcccaggcuggucuugaacuccugggcucaaaugauccuccugccucggacucccaaaguccugggauuacaggcaugagccaccacgccuggccaagaggguuauacuucugaucaugucacuccccugcugccuaacacucuuuggaggucuccuauuacuguuaggauaaggucuacauuuuauaacauuuuccagaccauuuaaaaucucaguaaauaacauagacuuucuuauauaaauucaugaagauagugagagaaggaaaaaagacuuauucuuggagguuuuuuuuuaccccuauaaagaauauauaaugaaaaguugugauucagaaguaaggacaucucuuuaagagauuuacuauauagcauagugacuauaguuaaugauacauacuugaaaauugcuaagagaauuuuuugcuaagaaaauugcuaagagaucuuaaauguuccacaaccaaaaaugguaaguaugcgaggugauggauauguuaauuagcuugauuuaaccauuucacaacaaauacaaauacuaaaacaucauauuguacacuggaaguauaugcaguuuuugucaaggauaccucaauuuaaaaaaaagaagauaauuuacuaccauccaaaaaaaaguaaggauguuucugccuuaagcagcugaguaaccaagauucccauuuuagcauugcacucucgagacccucucuuaauaaggacuuccgggaucacgcugagcagcagcauauugcagcccaacagaaggcagcuuugcaggugagcaguguaacugacauucuugccucgguggagguuuccuggaucucagaagccggcacauaguuauuuuauauuucaguggagcaauaucaauaaaaauguuccacacauaauugcaaugguuugcugauguucagucaagcccagaggauuugaaggaccagugcagcaguaaugaaaguaucuuuuaugguguugacucggucaugauugauucugugcuucuacaugccaagggauugcuugugcacaagagucuaggauauuuggcuggacaggaaucaucuuaaaaauugaacuggcuaaauaguacaugcauuuuuuuucaaaucuaucaugucauuacauccuuugauaguuguauuaguuuauuauuguugccuggauuuuuuuuuuuaaaugcucagcacaacuguugugcaggaaauauuucauagcuaacucuuacuauaggacuagaaauguggugcuucgucaguuaaaaaaaauacucuucagaguaauaaauaguuuuaguguuacagucucaucuugaauaauuuaagauuucuagagacuuuggacauuuuuuucccauaggcauaauuuaaucacuuguauuuuuaaaccuuagaaucccagaauuggaaggaacauuaugaccaucucacuuuauuuuauuuuauuuaucuauuuuuuagagacaaggucucacgcucugucacccaggcuggagugcaauggugccaucauagcuuacuguaaccucgaacuccuggguucaaguaaucuucuugccucaggcuccuaaguagcugggacuacaggcacaugcugcugggacuacaggcacaugccacugugccuagcuaauuuuuuaauuuuuuguagagauggggucucacuguguugcccagacuggucucaaacuccuggccucaaaugauccucccaccucagucacccaaaguguugggauuacaggugugagccaccauugcccagcccuccauucacuuuagaugacuuaaaaacagucuuuuuuuuuuuuuuuuaaugacagagggaaguuacuggugguuuucuguuauuuacauuccaacguucucuaccaaauguugguauuuuaaucaccaguaaucucacugccuuuuccccccucuccuuccaacuacuacccuucuuucucaaguuccugguuuguugaccaagaucagaguacuuugggaucuuugauacuuguuuuccucacuggaaggaacaaaacaguucaugucuuugagucauuuauggacugaggaugaucacaggguagagagagaggaugauaaaugaguacuugguguaacuuguugacccagauucuguauuacuguccauuuccugucuauuuaaacacaaccagcagcagaaaaacugauuuauuuauuuauuuauuuauuuauuuauuuauuuauuugagauggagucucgcucugucgcccaggcuggagugcaguggugcgagcucugcucacugcaagcuccaccucccagguucaugccauucuccugccucagccuccugaguagcugggacuacaggcacccgccaccacgccuggcuaacuuuuuuguauuuuuaguagagacgggguuucaccacguuagccaggauggucucgaucuccugaccucgugauucgcccaccucagccucccaaagugcugggauuaccagugugagccaccgcgcccagccaagaacugauuuuaaaauaaauuccaucucagcaauaacaaugaaaaauaaaugaauaaacaaauaaauuuggucucaagcauucagaaagaguaauuuuaaugccuuggucgaagaauugugacucuauuuaauagcuuaauugccuuuuuguuuuuaaucuuucccagcaugcucaugcacauucaucuggauacuucaucacucaagacucugcauuugggaaccuuauucuuccuguuuuaccucgccuugacccagaaugaagaaaacauuugcgauggaaaagugacuuuguaauaucaaaugccaaagcuacuaucauucagugcuacaugaacugugacuuuaagaauuuuggugaacuuugauauuuuuuguuugucugaaagaaaggaauguguaagugaaagcugaaagaagaauaaccaggaugaugagagcuguggaagcuguaucguccaaggaauugauuauguaccgugacuguaacuuuuuuguaaugcuguuuaacucucaaucagacugugaacuggauggucacgaagucauuccccaacuccuagcaaguuugacugaauauaucauguccacaguagauuuucaagaaucauuuauaguacuuaacuuuaaagaaacaaggcugcuuuuaaaaaaugaacuaauaggcuuaaaucaauugcauccauauuugcuguuuauaggauugcuaucaguauaccuuuugcguuuauagucaacauguaucauccugaaauauucuuucuggacuuauaacuacuucccccuuuuucacuuuaaaacaaaccucaagaauaaauuacuaaccagucuuaaccaucuuuuauaaacauaugcucuuauaaauguugugacuagaugcaauuaaaaauaauagggaaugugguagguuuuuaauuuguacauccucuuauuuaguguuaccacauaaaugaugaguuugugugguucuguuuuccauuuuuguucuaacugaaaacuuuuuggcugggcacggugccucaugccuguaaucccagcacuuugggaggccaaggcgggcagaucacuugagaucaggaguuugagaccagccuggccaacauggugaaacccugucucuacuaaaaguauaaaaaauuagccaugugugguggcacacgccuguaaucccagcuacucaggaggcugaggcaggagaaucgcuugaaccugggaggcagggguugcagugagcugagacggugucacugcacuccagccugggugacagugagucuuugucucaaagaa

SEQ ID NO: 191377 - RNA, 8580 nt, Homo sapiens
uuuccaaaaauauauuuauuuuuaaaaacagaaaaucagaucaguuuuauagagucaaauuuucaagagacaaaccagaguuuggauuccagcuuagagugcaagugaagcaucaguaaucucaugcagaagauuugucucugcaggagguacauucugcuugacugcaagcacucaauucucuaaaucugguuuguacuucugccaucauuuuauuccauuccagcgcucuggcaugcaagauaauccaucucuaaaauucaagacuuccaaauugagaugaacgauuauugggcuuggguugggguuuauaaccaauccgaucauugaucauuuguucccggcucuugggaucacugcuaagcccaauggcuccuucuccaucacugccuccuacaacuuccacaucuuccuucuguuucuuacgggucugaaaguauaaaaguuuuaggauuaaggcaacauucuuucaauuagcaaauguuuauuuagaacaccuaccauguacuaggcaugggcuaaaugauagaguuaggguguaaagaacaauaaacugaaauccuagguuuggaguacuuaggggcacaaugaggauaugguguuaaaaguuguaaccccugaucacuugaggucaggaguucgagacuagccuggcaaacauggugaaacccuaucucuacuaaaaauacaaaaauuuggcggggcacgguggcucacaucuguaaucccagcccuuugggaggcugaggcgagcggaucacgaggucaggagaucgagaccacccuagccaacauggugaaacuccaucucuacuaaaaauacaaaaauuagcugggcaugguggcgcaugccuguaaucccagcuacuugggaggcugaggcaggagaaucgcuugaaccaggaagucggagguugcagagagcugagauggugccacugcacuccagccuggcgacagagcgagacucugucuuaaaaaaaacaaaagauguaaccccuacccuccaggaugucacagucuaauagggaaacaggcaaacagacgauuauagggugaucagggcuaugaccuaugacagagagaagucuacacugccaaagagacaagagguaaggaguugggguguggugguacaacaggaagcuacaauuggaaagcuguaagagcagacaagugagagcaaagggcauuucaacaaauuuauuauucuagagaauagaaaaauaaauuggguaaagaaauaaccaccaaaaaucuauagccugacugaucccaugagauuaaaaguaacucaagaagguuuuaugcuaucuuaucaaaaggucuggguuuuguggcuucauuuuguuuucagauaaaagguuuggcuccuaagucacaugugacugcagaauccagaaaguaugucuuaguuugaucauuuucaaaaacagacacuuaucccauaacagccacuaccugacuguaaggauaacagaugauaacuuucucuaagagagugaaaugauguuuuauccaaaguuacuuaauagaagaauggcucagcuacucaaaucacuggaauuaccaccauucuucaccacuugcugcugaacugugggcauuuaaaugccaagcaucaggcugaccgcaguggcucaugccuguaaaucccagugcuuugggaggccaaggcggaggauugcuugagcccaggagugugacacuagccugggcaacauagugacacuccaucugucuccacaauuuuuuuuuuuucuuuagacugagucucugucuguugccaggcuggaguguaguggcgccaucuuggcucacugcaaccuccgccuccuggguucaagcgauucuccugccucagccucucaaguaguugggacuacaggcgcaugccagcacaccuggcuaauuuuugcacuuuuaguagagacaggguuucaacauguuagcuaggauggucucaaucucuugaccucgugauccgccugccucggccucucaaggugcugggguuuacaggcaugagccaccgcacccggcccacaaaaaaauuuaaaaauuagccaggcaugguggcgcaugccuguauucccaguuauucagggggccugaugugguaggaucaccugagccuggcaggucaaggcugcagugagcugugaucaugccacuguacuccagccagggcgacagagcaagacccugucucaacaauaaaaauaaaaaaaaaaaauaaaugccaacacucacaaaguauuacagggaauaaaauaagguauugccuuuuauguggcaaaugaccuuccugauuacuaguaagugauguuagaaaguucuaccuaaauaccuuugugaaaacaaguucgaaaaggcaaacaacucuaucauucugagaauauccaaauggaaugaaaucacuuaaaaggcuucccacuuugagcaacugcuguuucagaagcuagagucacaguaguauaaucaaacucauguugguaauaaaugaaacaggccaguuuucuacugguuucacuuuagggcaugacugucccugcuuccuaaguuacucuaaaacaagguaaaacccacuagauaacugucuuuaguggaaagacuaacucaauagugagcugacuguagagucaaaguucagcaugcuagcauuuuaugagauucguuacaacugaaguuuaagccauacuuuaaagcucaugcuuaauaauauaugaguuuuuagaaagcaaaaauuacgauacuuagagaacacuaaagucucuugggaugaagcagggggaaagaaaucuaaguuauuagucuuaauaugaagcauauacaauacauaauaaagcuguuggugaauauaugcaaaacguacuguccucugccauauaguacaagauaccuacuaggacagcaaaugaaaauagacuugcauugagcccuccuuuggaccugguauugcagggaacagaugcagagagaaauauacuaaucccugacuucaaggagcuuauggcccagugagggaaaacaaaagcaaacagacaauuacaacagagagugaccgugccuaugagagagguuagcacaggaggauaagguugagccuaacccagcugggggcuggaaggaguaagaguuagccuggcaaagaaaaagaaagggcuuuucuggcaaagggaacacuguguauaggcacugagauuaaagauaacccagcagugaaaguggagagauaagcaaggaccagcucacaaggagcucauaugccaugcuagggaauuuggaauuuauucuguagaccacugaagaauuuaagucuuauuaauggacaucuaauaccauguagcaaggccacaguuaaaaauacauauggggccccuacuaugaacuagaugguaagaacucaauggugaagcaaacagacaugauuucugcaaucaacgucccuaauguaaaugauuuuacaauaaaaaaaauuguaaauuauaauaaaugcuaugaaaaaaauauggugcuuugugagagccuacagagauggaggcagcauggacgggaaugacacaugaaacuuggauacggucaaaaguggccucuuaaauugaagaguugacauuugaaugaagacuggaagaaagggagcacuccaggcagggggaaauaauauguggaaaguccauggaagugauaaauagauuggcauguucaaggaaaugaaagagagccaauguggcuaggguauagagagcaaggcaaagaauggcacaaaaugaaucuggagaggcacuagaacauacaaaaucuuguaggccauggugaagaauucagauuuuguuauaagugcagaaaacuacugaggaguuuuaaacgggaaugacaggauuugaaaauuucugaagaucauucuugauacuggaugcagaaugcacugaaagagacaaaaauggaaguagaagaccaguuaggaugccacuacaauuauacagggaaagacgguuacuuagcgcaggacuguaacaguggagaugaaaagguauggguggauuccagacauauucugaagguagaaucaaagggucuacagacagaucgaauauaaagcguaagagaaagggaggacucaggaaugacugcuagguuucuggccugaggaacugaaucaauacugagaugggaaacacuggggaagaauggaagggacgacugguucaagggagaaaucaagaguuuuucucucuucuuuuuuuaacauguuaaguguaguaggcugaaaaauggcccccaaagcuagcagguccuaauccuggaaccuauaaaugccuuauaugggaaaagggccuuugcaggugugacuaaauuaaggaucuugagaaggggggauuauccuggguuagucaggugggcccuaaacacaaucacacauaucauaagaaggaggcagaggaaguuuucacagacagaaaagaagacaauaugacucuggaggcagagacuggagugauacagucaugagucaaggaaugccagcagccaccagaagcuagaagagccaaggaauggauucuucccuagauccuccauagggaauguggcccuccugacaccuaaauuucagcccagcaauacuaauuuuuggccuauaaaacugugaaauaauaaauuucuguugucuuaagcgaugaaguuugugguacuuuguuacagcagccacaggagacauacaugaaguuugagaugccuguaaagcauccaaacagagauuucaaauaagcuguuggcuuaagagucugcaguucagaaguuaaaguuauuguguauguauguguguguauauacauauuuauguaugacagagagucucacuguugcccaguguggaguacaguggagccaucauagcacacuguaaccucaaacuccugggcucaagcaauccucccgccuccgccuccugaguagcucaggcaugcgccacccugcccaacauagagacaaggucucacuauguugcccaggcuggucucaaacuccuggccagaaaaugcuggcauuacagauguaagccacugugcccacacaagaauuauuaucuuaaauauuccuuaagcuuugaaaguuguauucauggcugggugcaguggcucacgcguguaaucccagcacuuugggaggcugagguggauggaucacuugaggucaggaguugagacuagccuggccccaacauggcaaaaccccaacucuacuaaaaauaaaaaaaugagcugggcgugcuggcaugaaccuguggucccagcacgcgggaggcugaggcagaggaggcagagguugcagugggccaagaucaugccacuguacuccagccugugugacagagcgagacuccaucucaaaaaaacacaaaguuguauucauaccuccagguccuuucgaauguucucaaacucuucaaugucaucaagcuuuagcucuaggcguguugguuuccgucucagcauacugaagucaacacuaagggccaaacccagugaacuauuagcuguuaaaaaugaaagagaggaggaaaaucugaaggugauaaagucucagauacaaaacauaaaaucaauuugcaagcauguauacuaaagugaauggaaauauuaaaaauuuauuugaauuuacacauagacuucuaaagucuuuuuuuuuuuuuuuuuaagagauaggaucuugcucuuugcccaggcuggagugcaguggcaugaccuuagcucacuacagccucaacuuccuggacucaagcaaucuuacugccucagccuccagaguagcugggacuacaggcguacaccgccauaccuggcuaauuuuuguguuuuuuguagaaaugggaucucucucugaugcccaggcuggucucaaacucuugggcucaaguguuccucccuccucauuuucccaaagugcuggcauuauaggcaagagcuacuguacccagccaacuucuaaagucuuuagguaugugauuauuacauuuuuguuacauuauggagaucuacagcucuauaaaaucaaaaacucuuucuguaagaauuuaaaauagcaaacugccuauaagagagaaauucuaggcaaccaucacuuuaaucucauguuccagucacauucaaagaacuacucuagcuaaaagaauaaacuaucacaucuuaguauaguuagaggaaaaaguggacaaaccagugaauuuaaucuacccuacaugagaauugucagagauuugugaucacucuugaaugcuaaaaucaguuugcuaaaucucaggaaaacuccaacucaccaauucacaggauuauccuccgcguccaaacagaucuuaaauguguacgucauucauuaaacaaacacuucuuguguuccagcuacaaaguuaaaagguacagucauaaucuguggggaaaacaaagagaaaacugugauaucauguaaugagaacccugaugaggauacuagcacuggcaucacacaggcaccuaauccagucugggcugagugugggguggacaaggaugucaggcaagccuuccuggagaaaaugaugucuuaguugacuucugaaggucaggcagagagaagaaugcacaaggaggcucaaguacagcuuugguaacguagcaagacccugucucuacaaaaaaguaaaaaaaauagcugggcugguaguguguaccuguaguccuagcuacucaggaggcugagguggaaggaucacuugagcccaggaguuucagguugccaccgugagccaugaccucaccaugagaccccaacucaaaaaaaaaaaaaaaaaaaaaaaaaggcucaagagagcauuccacagccugaaaucccaagguaauacuauguuaacaaaaaccauuuuguuuuguuuuguuuuugagaaaacacaaccccccaacugaguuuaauaucuguugauggcaucauuuguauauucuccacagcauccccuagaguguaucuauaaaaacagucaguaaauguuuguugacuagaaggugagaucauucuugagcaccgugcuguuuuuccauucccauucuuuacauucuuauuuuaacacaaaaacccugugaaguugacaaaaugauuccuauuucacacauaaagaagucaucgaagcaagcuguucaguuugguuaauaauuuuagccuccuauaaaaauuauaaaggucaacaugauaagcauuaagugaaaaugauggaagugaaaacuccuugaaaguauguacagauacaaauuauuacacguaucuaggaugaaacuaaggacugugaaguauacaaaggaagaaauaguuccuucucccaugaagcuuaggauacuacaggugauauuaucaacacaaaacacuggcacauuacauuucaaauuccuuuguacuaaaucaggcauuaucuucuaccagauuccaaugcagacaaaugguagagaaagccaaaguuccaaagagggaaagagagggauagggauaccuaaaagggggaaaaaaaaaucuauacauuuuaccuuuucugcaaacugcaaaaaacuggccacuagggagcaguauagauuaacaguuaaaagugcuggcuguagagguuaaagggcacagguuuuaaucccacuacaccaccgauccugaacaauucguuucauuucucacuagaccuuaguucccucaucuguauccuacucugcuguuguaggaagucaauaacguaauacagaguaagcucuuggaauauuauuuggcauuuaauaaauguucaauaaauaacaucuauuauugcuguaauuguucuaggggguugcaugaggaucuggccagcuagggaaacgucaauauuuugaggaucucccaccgcccauguggggauaaaaaccuuauccuguucgucucuaaugccccagcauccagcagggcagagagacguacagaguuaccugacaccuuccuauccaucaucuuacucucaaucugauacaaagaccaggcugaagacaaaucaacaaaaucaggccgaagcuccuccgccgggucuuuauuugacuuuggcacuagcgggcucuucuagcuuaaucucccgccgcagcccaaauccaccgccgagccaucaagcucagagggggagccugggaagacuuccggaccauggaggagaacaguccucguccccuagcuccaggccuguaccucggagcccaggcaaggguuucuaugguaacaugguccucggcuccaagaagacguaaacgcccccguacgcccggggggcacagcggaccccggaagcccuugacucgcuccagaguucagccccgagccgcgcgagucgacucaccuaccucuuuucaagccggccuagccccuucccggaaccucggcucccccccaacgaaacuacugcuaagccaacuggacuacacuucccagacugcuuggagccucucucuccgcagaaccucgucuuccgcgagcuuuuccuggagguucuaggagggaugccccucaaugccacgacgccauuuccuacuacgacuuccaucaugcucc

SEQ ID NO: 191378 - RNA, 413280 nt, Homo sapiens
gccauaggugcgcgucggcgcccaggaggacguguggcgcguggacuacaucagguccagcccugcgggaccccagccagcgcuuccgggcaagguucugugcaccuguuuucuccuucuacgcgaguaucuuuccccuccggaaagaaugggauaugccuguguccaaaggacaagaagaugcgcgccagcaagccuaaguuaaccacagcgcggaaguugagcccaaagcaagagcgugccgggcaccuuuaagcuguuuguaagcccacgugacucaccaagugcgggccccagcggucacgugacggcgcgcgcgcccucgcgcagggagagccggcggugcgcgcgccuucgccgcugccucccacccacccccucgacgggagggugaggcgcggcgcagugaucgggcggccgggguccugugcgcgugcgcagcgaacagcugucaccuagugcggaacaagucucccaaauuucccaaaucucccugggccggaggccacugucuucucuuccuccuccaccgagucgugcucucgccccaacccgcgcgccagguaaccgcuuuuccggagucugggggccagggcggggggaggguccggagaggucuucccggcacugccccccuccgcguggggcacgggggugcgggcguccgggcgagcggcgacgcuggggcagagacgcuccguccgugacugcagcgacugucaagcuggggagggagcggccggccgcggccgcaggggagggaugcgggggccggugacagcccgcuccggcccuuaccgagguucgguacccgcgcucgccguuuucccgggauccggagucggggucgccuccuuggggcagaggagcgcucgggcgguccugggaugcggaccucuuaacgccgccagucggcuguggcggacuccaggaaggccgggccuggugcaccccucggggcccucccuucccugggagugucacgacccgcggggugagggugggagcuccucuccugaccacccguugcaggcagucaucccgucauucggggucgucuucagcccucgcggcuguccuuuugguguuucuuucccccggcauggggccauuucuuccugcagugccuggaggaaccaugaugcgguguagacggcgggugcuuaaauaaaugcgaguuggauuagggcgcguggacugccaggcacagaacguggcguggaguggggacguggaggagggagccagacaggccggggcuguaggcaggagcuugggguuuuccucugugcuccgccaguaaagccagcagccgggauucagaugcuuuccgcguggacuugaugcugggcucccccuuugcugcgcggugcaagccugcgcuggcuggcucugauugugggcaauacuaccgggagggguuuugucagguuccuucuuccggaagagacaagguaaacuuuuuuuugcgcuugauaaacuaaccccgagaggugauuuauaaagcacuguucggaaauguagguuagaaaagcagagucacuuuuauccuggugaaaguuacuaguagguuccggccacuuagguucacacuaaacucugcccuauuuucacccauuucaguuugcgguauuuaaaaaaaugucuaaauuccgggcagcuuggcuuuacuguuucuauggcaacggugacuaauauucucauuucgaaguguugugguugaaaacuagugguuuuaauuuuuaaagguccauuuuuuauuaggaagcagucggcucugcuuugcgauuaucgcuugcuuucuuaccuugcuggccuccgcgcaacccgcccauaguuuguuuuggaacggauuacacgguuguucggguuuuuuaggugcuuuuucucccaauuucaguguuaugaaaaguuuucacauaagcuuuacaguaucccgcaaacuugguaauacaguacaauuuaaaccgaagacuuauuucuuuuuauuaacagacuuuagucaguugcuuuucuaaaguugaaaaucagacccggcgccguggcuccugccuguaaucccaacacuuugggaggccgaggcggguguaucaccugaggucaggaguucaagaccagccuggccaaaauggcgaaaccucgucuguaccaaaaauucaaaaauuagccaggcaugguggcaggcgccuguaaucccagcugaggcaagagaaucacuugaauccuggaaguggagguugccgugagccgagauggcaccacugcacuccagcgugggugacagacugagacuccaucucaaaaaaaaaaaaaaguaaaaauauaaauaaauaaauaaauaaauaaauaaauaaaagcuuuuaguaaaugaauagucuugugcaaccaucaccacaaugaauuuuugaauuuuuuuaauccccaaaagaagcucuguuccuauuagcugucauugccuaguucccuccaauucuauccccuucugucccuaggcaaccacuaaucugcugucugucucaauagauuuggcuauucuggacauuuuauauacauggaauaauacacuaucuggucuucugugagugacuucuuucacuuggcauaauguuuuuuaagguucauccauguugcagccuguaucaguacuucauuccuuuuaauggcuaauauucuauuauggauacaucacauuuuguuuauucaucaguugguagacauuuguguuaucucugcuuuuggcugaguaaugcuaugaauauuugugaacuaguuuuuguguggacgcguguuuucucuacucuuggguauauauauauauauauauaauguaauugcuagguuaaacaucuguugaaugacugcaugcguaaggagggauaguuagucuugggugauacucuuuuuuauuuauuuauuuauuuauuuauuuauuuauuuauuuauuuuuugagacgaagucucacucuguugcccaggcuggagugcaguggcacgaucucugcucacugcaagcuccgccuccuggguucacaccauucuccugccucagccuccugaauagcugggacuacaggcacccaccaccaugccuggcuaauuuuuuuuuuauuuuuaguagagaugggguuucacuguguuagccaggauggucucgaucuccugaccucgugaucugcccaccucagccucccaaagugcugggauuacaggcgugagccaccgugccuggcuuggugauacucuuucaagccuugaaggggccuguugaucuuucccuauuccacugccaacuucaguucuccaguucucuaaaguggggcuuuauucuaugguuaaugcuguguuuuccuuuccuggaugucuuuuuuuuuuuuuuuuugagacggaaucucgcucuguuguccauggagucucacucugugccaauggcgcgaucucggcucacugcaaccucuaucucccagguucaggcgauucuccugccucagccaacccaguagcugggauuacaggcacccaccaucaugcuuggcuaauuuuuguauuuuuguagagacaggguuucaccauguuguucaggcuggucucgaacuccugaccucaggugauccgcccaccuuggacucccaaagugcugggauuacaggugugaaccacugugcccggccucuggaugucaguauuaagaucauccuguucuuuuuuuuuuuggagacaggguguaacucugaugcccaggcuggagugcagcagugacagucucagcucacuguaaccucucugucugcugugcucuggcaguccaccagccccagccucucaaguaggugggacuacagguacaugccaucaugccuggcugauuuuuguggucuugccaugguaccccggcuggucugaaacucccgggcucaagcaguccgcuugccccagccucccaaagugcuaggaugacaggcgugagccacugcaccuggccugaucaucccuuccuguuagcacagucuuuauacugcucaugguuauucccuugauauucacuuauuugcucuauauuuagugauaagauagguacauucuguacuuugauuaagcucaauaucuacugaaaaauguguguucccuuuuguuaaauauuaguauuuaaugcuucucucccaaccucugucucuuuuuucuuuuucuuuuugagauggagucucccucugucgcccaggcuggagugcaguggcaugaucucggcucacugcaaccuccgacucccuggagugauucuccuccucagccucccgaguagcugggauuacaggcacgcccaacuaauuuuuuucguauuuuuaguagagacgggguuucaccguguuggccaggauggucucgaucuccugaccucgugauccgccugccucggccucccaaagugcugggauuacaggugugagccaucaugccugcccauuuuucuguuuuuauuauacuuuaaguucuaggguacaugugcgcaacgugcagguuuguuacauagguauacaugugccauguugguuugcugcacugaucaacucguuguuuacauaagguauuucuccuaacacuaucccucccccagccccccaccccacaacaggcccuggugugugauguuccccucccuguguccauguguucucauuguuccuucuuuucuuuuucaguuaaaaaaauuucuguuuguagagauggggucucaguguguugcucaggcuagucucaaaauucugggcucaagugauccuucugacuuggccucccacaguucugggauuacaggugugagccacugugcuuggccugcaagcucuauuucuguuaugaauuucuuaggagguguaucauaauuaaagucacaguaucuuuuuuaucgcuacaaauguagaccauuuuguggagccuaaaauauaauuuuauaauauaaauacaauauauauuaggucauugucuuuauauuauauaauauauaauauaauauauuaggucauugucuuuuuuuuuuuuuaagauggagucucgcccuuguugcccaggcuggagugcaguggugugauuuuggcucacugcaaccuccaccuccuggguucaagcgauucuccugccuuagccucccaaguagcugaaauuacaggcaccugccaucacgcccagcuaauuuuuguauuuuuaguagagaugagguuucaccauguuggccaggcugggcucgaauucuugaccucaggugauccacccccucacccucccaaauuacugggggauuacaggcaugagccaccacacccggccaggucauugucuuuuuuacuccccgacccucuaaagauucccuacuuccucauccuccuuacccuuccgcugguggggggggauggaugggggguagagggggcgugguuacgaucuucuaaauccacacuuucugggccuaauccuuuucccauacuaacagucagaauaauuccuuuaaggaagccuauccccccugcuccugcuucaaggcugcuuucucuagggaaaaaguccuaacucucagcucugugugugacugcccagccagucuccuuccuaccaaacucaucuuucuuccuaguucccugaaugggcuugguacucugcccaugcuguuguucccugugccuggacugcuaccccaguugcacuucuuugauugauuccaucucauucuucaggaagcucagcucaguugucaacuucuucaaguuaguguucucucaauccugcacacuggccauagcagcauucuguagucuccuucauagucuuaagcaaucaugccauuacuuguguaucucucuucccucccuacccucaugcaagcccagagaaagguucccacaaaaauauugacaguaguuaguaacuucugggugauggaauuguggguaauuuguuuccuuuguguuuaugugcauuuucuaaauuuucuccuaugaaucaguguuaccauugugaagagggaaaauaaguuaauaaaaauucauguuuguuagaaaagcugggaaacaggagaagauagaggaaaaagaaaaauaaucaguuauugcccuuuucacauuggagaaugcacuuuuucuuuuuuugagauagaguuucgcucuuguugcccaggcuggagugcaauguagcgaucuuggcucaccacaaccuccgccucccaguuucaagcaauucuccugccucagcuuccugaguagcugggcuuacaggccugcgcuaccacgcccagcuaauuuuguguuuuuaguagagacggaggguuucuccguguugguuaggcuggucucgaacucccaaccucaggugauccauccgccucggccucccaaagugcugggauuacaggaaugagccaccgcucccagccagaauacacuuuuaacaguuuuuguuuuguuuuaauaacuuagaugagauuuuguuauaguuucagcaucaagcuuuuauuacauuuuaguuguugcuuguauuacucagagauuucuagagaaugguaggaguacuuacaauaggcugcccaguuggaauuuccgauguugaaauucagcugauuauuagagaacagaauauagcauuagauauauguagcauagaacagaauauagacuauuaggguaugagcacuuaagugcuaaauaacucuuuucccuuuuuccuugaaaaauguccuaauugguucauuuauauguuucauaguacaaagauuucccuugcacaguugcucauuauuuguacuguuuguuuuauuuuugaugggugguauauuuugcauaguaguggauacauuucuucaguagauuaacuuguacuaugugccauacacugugucagauguggacagcagugaacacaauagacuggauucccuaugauuucauggaaguggauuauuuuaagagugugaauguuuaguuaacuguugcacuguauacuguucagauacacaugguauuucagcuacuaugguauuuaugaacugcuacugcauaaagccucaaauuuauucuggauucuucuggguuuauauuguauauuacuauggguggauauuuaaggagcacaaugaugagucaucaaagccuuugugcuaaugacuucuuuuuuuauaucuccauccaguuccagguauuaauuuggcaucucuacuuguuaaguauaacaaauguaacucugaucuuuccucucagcucugcuucucuggaauuucuccugcaucucaucucauuucauugcucacucauuucauuaugaguuauccaacacuucaugguuccucagcccucacauccaaaguaucacuuaacaccuuguaacuucugcuucaggaauaauauuguggggaucaauccgcuugucuccaccuccaaugcauuauccuaccauucacucccauccucccuccaaucucuuuccagcaugaucuuuaaggccuauugccuuauuggauuguucucauaggccucaggauauuuaaaauuccugccauaucucuuucuaccccaagcuccacccaugucuuaucuagaugguuuuucauguucucucuaccuauuggcuuuucuuuucuucaaacuguauacaaccuuccugaaugugcuguuuuuugccugacugauuucuccucucauuuucccccuuuucauacaucuuucugaucucuacuugaaaguacuucuucagagaaaccugaccuguuacucauuucucuucucugauuaaaucagcuucccuaaugaugagcugucuuaauucccuguauuuuucccuaacacuuagugguuuauaauuguauauuuuugugauuauuugauuguuucuacacuguaaagauucuacaagggcagagaccaaguauuuuuauuuccuucuauucuauauagcacacuguucccucacuagcacuauaguauaggugcucaacgaacauuuauugugcaaauuaaugacuuuuacauauaugcaaaaaugaaggaacuguaaaaccaggacacgcauugggaaauacaucuuacccaucgugacccaacacacauaaauauauaaaauugaaacaaaaguuucacaaaacuuuaucaacuaugcuguacucuauuuucuuuuucuuuuuuuugcagggggauggagucuuucucugucacccaggcuggagugcaguggugugaucucggcucacugcaaccuucaccuccuggguucaagcuauuccccugccucagucuccugaguagcugggacuacaggugugugccaccgcaccaggcuaauuuuugugcuuuuaguagagaugggguuucaccauguuggccaggcuggucacuaacuccugaccucaggugauccgcccaccucagccucccaaagugcugggauuacaggcaauagccacugugcuuggcaaaguaaauauuuuaaaauauaugaaaauauauuguauagguugaguauuccuuaucugaaauacaugaauuuuauauuuuuuucagauuugggaauauugcauuuuacuauacauuacagaugcuauaguuacaacugagcaucuguaaucugagaauuugaaaucugaaaugagcauuuacuuugagugucauguuugcccucgaaacuuucagauuuuggaguauuucagauuuuugguuugagaugcucaacuuauguaugauaaucguacaaaaagcuauaauuucaaguauugauuugcuguuuacugggaaggaaugggaaaauuuuugaaauuagaaaugucagacuuaggacaguuggcccccuuuagugggggucucggugugggacauuuuaguggaguucauaguccugcuuccauuuuuagcauuguacauuuagaaauaugaacuuuuucagucgaccgagagugucaggcauuggaagacuaaugucuucagugugguucccuaauuaaacuggcaagaagaacuagaaucuggaucugaaaugcuugugucugcucauuagggcucuuucuagaaagucucggucccugggaaagcacauaaaugaucacauaguuuuuggugacagguaggcaggccccagcugauggguagugcugaacaggauuuuuuuuuuuuuuaaccugcugggcuucccugacccuugagcauucaccucugcuuaucagaacauucuucucugccaguacguuuucucuuguugaauaagguuaaagaagcgauaaauuccuucauuuggcucccuuuuuaccuccaucuuugcauuuguuuuuuguaccagauguuuguuuaaauuccaguccucaggacaggcuuugucugaucauuaguauauuguugauucuguucuguucugagaguccaucagauacuuugaauggucacaggcaucccuuugagugggugaacugaaguguuuuuuuugcagguaguuuaucucauuuuguuuuuuaucuauuuaacuuucuuuuuugcuuuuuuuuuauucuuuuuugagauggagucucgcugugucgcccaggcuggagugcaguggcacgaucucggcucacugcaagcuccgccuccuggguucacgccauucuccugccucagccucccgaguagcugggacuacaggcaccccucaccucacgcccggcuaauuuuuuuguguuuuuaguggagacaggguuucaccacguucggcaggauggucucgaacuccugaccuugugauccgccugccucagccucccaaaguguugggauuacaggcgugagccaccaugcacggcccccuuuuuuuuugagacggugucuugaucugucaccuaggaugcagugcaauggcaugaucucggcucacugcaaccucugccucccagguucaagcgauucuucugccucagucucccgaguagcugggacuacaggcaccugccaccaugccuggcuaauuuuuguguuuuuaguacagaugggguuuugccguuuuuaguagagaugggguuuugccauguuguccaggcuggucuugaaguccugaccucaggugauguccgcuucagccuuccaaagugcugggauuacaggcgugaucuucugugcuuggccaucuggccaucuauuuaacuuucaaaaaggaauccuucccuaaaauuugggcacauaaagugauaccucucagucuauaauauucaggcagcuuucauuagcaggaagaaucuggcccugagauagguaaaaucauuuuccuuuuuuuuuugauaauuuuauuuauuuuucuaaguuuguauuauauauacacacauaauauuucuuuuaguauuuucaaauaggcaauacaagguauguaacaagauauaaaauucagaagguauuaaaggguaaaauguguacaugguucucacuuuuagccuuuagacagcuaguucccuucugucuaaaauucccuuuuagggaauaugaacuuuuucagucgaccgagagugucaggcauuggaagacuaaugucuucagugugguucccuaauuaaacuggcaagaagaacuagaaucuggaucugaaaugcuugugucuucucauuagggcucuuucuagaaaaucucggucccugggaaagcacauaaaugaucacauaguuuuuggugacagauaggcaggccccagcugauggguagugcugaacaggauuuuuuuuuuuuuuuuaaccugcugggcuucccuuuuagggaauuuuagagauauucuauauaaauuuauguguguguuuacauuuuuuuacacaaaugguugucuucaugcucccucacuccucaguaacucaauguguauuuccuacauuuuucuccauaacugcaguauauccaucaaaaucaggaaauuaacacugauacauuacuaucaucuaauuuuuagauucuucauauuucacuauuuguuauaguaauuaauguucuucauagcaaaaguauccaguccagaauugugcaauauguauucuuguuguaggucuuuuaagcauccuucaaucucaaauauggauuugagaaggauuuucaugaucuugauuuuuuuuuccuugaucuucauggucuugauuuucaugaucuugacacuuuuuguuuuucuuucuuuuuuuuuuaaagagggaguuucacucuguugcccaggcuggagugcagugaugcaaucucugcucacugcaaccuccaccucccggguucaagugauucuccugccucagccucccgaguaacugggacuacaggugcccaucaccaugcccggguaauuuuuguauuuuuaguagaggcgggguuucaccauguuggccaggcuggucucgaacuccugaccucaaaugauccacccaccucagccucccaaagugcugggauuacaagcgugagccacuacaccuggccuggaguuuguucauuuuaaaaaaggaaauuuucaucaauacucuuaagugaagcugguuugcaguuuucuugggucguuuuuaaguuuuguuacucauuuuaggcuucuuaagaaaggauuucuaagcuugcuguuuuuuuuuuccaugcaaucuggaacaucuuaaauaacaugucauacauuucuuaaaaauugaucagaauuguuuaucuaguggagagaagauuuguuccuuauuuagugggcuuuggugugaucuuuuuccuuuuuuucuucucuucucuuuucuuuuuuggcagcuggagagccuagcaaagaggucaguuauauuugggaucuggguccgggauacaaaacuuggagucaguucauugcaccuauuugcuguuugaccuuagaaaauuuauuuccauuucuaagucuugguuucaucauuucucaaaugggaauaaucacagccugcuaacuaacaucacagagaacuuuuaagaaugaaaaugaaguaacauauguuaaagcacaguaaagaaccaagcaaaugcaagacuuuuuuuuauaagaagguucuuuuuaauaagacgucaguacucaaagaguugucaaugaggauagaucucaauaucaugcuacugaaggaguuuguguagauggacaaugccuccugcuccaagagcaagcacauggagaaagggucaauggacacauuuguuuugcuguuuaacaacaaagaaaaauuaugaauuagacaaaauguagucuagauagaauuuauuuuugugaacauuaaugaggguuuggucauguauuuauuaaaaccauguguuacgccaugcccgguggcucaugccuauaaucacagcacuuugggagguugaggcggguggaucaccugaggucaggaguuugagaccagccuggccuacaugaggaaacccucucugcuaguaauacaaaaauuagccgggcaugguggggcaugccuguaaccccagguacuugggaggcugaggcaggagaaucgcuugauccugggugguggagguugcagugagcugagauugugccauugcacucuagccugggcaacgagagugaaacuccaucucaaaaaggaaaaacaaaacaaacaaacaaaaaacaccaaaaaaaaaaaaagaaccccguguguuguaaaucaaggaaaaauguuggguaacagacuaugacuugacuuugugcuuauaucaugauuguauuuaauuuuauuauaaguugguuaaauauuugagacuuuggggaaauuaaacuugucaagcugucaacuuaucaguuuggauuuaugguuuccuauuucauuuuguagauauugaaaauacaugucaauaucuguguauuucaugucaaggaagcuguguauugguaucaggauugagggaauacaugaucaacaaauacuuuuccaaguuucagugucacagauugcauauggcaugauaauacaucacauucauuucccucaaguuuguuuuuuuuuuugacagguaguuaacaaaaaaugugcaaauugccauaauucucuaaaauaguauuucuugcauucauuaauaaugaaaaaagcaaggauggucagauuauuguguuugauguuuuucaacgucuuuuuuuuuuuuuuucaauauagccgguaucguauaugguuuuugcgauuuugauccuuuuuuuuuuuuuuuuuuuuccuuuugagauggaaucucgcucugucgcucaggcuggaaugcaguggcgcaaucuuggcucacugcaaccucugccuccccgguucaagugauucuucugccucagccuccagaguagcugggacuacaggugcaugccaccacucccagcuaauuuuuguauuuucaguagagacgggguuucaccauauuggccaagcuggucucaaacuccugaccucgugauccacccgccuuggccucccaaagugcugggauuacaggcgugagccacugcgcccgacugugaaucuuuuuuuuuuuuuuuuuuuuuuuuuuuuuaagagaugaggucucuccaaguugcccaggcuggucucaaacuccugagcucaagugauccucuugccuuggccuccccccaaagugcuaggauuacaggugugagccacugcaccuggccugauugugaaucuuuaggaauaauuggaaaguuugcguauuaaauugucuugaaauauguuuucuaaguauuucaauuuuuuuaauuuauuuauuuuuugagacagagucuugcucugucgcccaggcuggagugcaauguuacgaucucagcccauuguaaucuccaccuccuggguucaagugauucuccugccucagccucccgaccagcuuggauuacaggcaugcgccaccaugcccugcuaauuuuguguuuuuaguagagacgggguuucuccauguuggucaggccggucucgaacuccugaccucagguuauccaccugccuuggccucacaaagugcugggauuacaggugugagccacugcacccggccaguauuucaaauuuaaggcuuaguuuuuauguuugaaacuaaggaugaguagucuccauggccucccaugaguccuucugauaggacuaaauaggcuggauaaucucauaaaagucacaauguagaauugcuggaaagcgcugguccaggccacagcugggugcaggggcaguacaguccaguauuuggugaggggcucgcugcccaggcugagugcuggagggccucaaugggugaccugcaugguaguugccaggaagccaaagcaggcccaagggguugugaccuaccugggagacucaaguagcucuugcagguguugggaagccucuccccauuccagccccccugagggagacagugcaagcccagcaggcuuucagugugaacuuaacacuccugugaaaugcaaauuuuggaaacuguuggaauggccuuguuuggcugccuucucccuuuaucaauccaguuacauaaaaauaaggauuuagaaaguaaaugaguuagguuucuaaauuaauauucguaggagaacagucuguuuuucuuuuuuuuuugagacagagucucacucuguugcccaggcuggagugcaguggcgcgaucucggcucacugcaagcuccgccuccuggguucaagcaauucugcugccucagccuccugaguagcugggauuauaggugccugccaccaugccuggcuaauuuuuguauuuuaguagagacgggguuucaccauguuggccagacugguccuuuuuuuuuuugagacggcgucuugcucuuguugcccaggcuggagugcaauggcacgaucuuggcucaccgcaaccuccgccuccugcguucaagcgauucuccugccucauccucccaaguaggugggauuacaggcaugcaccaccacgccugguuaauuuuguauuuuuaguagagacaggguuuauccauguuggucaggcuggucuugaacuccugaccucaagugaucuguccaccucggccucccaaagugcugggauuacaggugugagccacugcgccuggcacagauuauuuucuuugauuuuuuuucuuuuacuuuuuuuuuuuuuuuuuugagauggaguuucguucuuucacccaugcuggagugaaguggcgccaucuuggcucacugcagccucugccccccggauucaagcaguucuccugccucagccuccugaguagcugggauuacaggugcgugccacccccaugccuggccaauuuuuguauuuuuaguagagaugggguuucaccauguuggccaggcuggucccgaacucuugaccgcaggugauccacccaccucggccuccccaagugcuaggauuacaggugugagccacagugccuggcuuuucuuuuucuuuuuuguuuuuuugacaaggucucacucugucacucaggcuagaguggaguggugagaucauggcucacugcagccucgaccucccagacucaagugauccuccugccucagccuccugaguaacugggauuacaggugcacacuacuacaccuggcuaauuuuuuaauuuuauuuggagagacagggucucccuauauugcccagccuuaucucgaacuccugagcuuaagcgauccuccugccucagccuuccauugugcuggaguuacaggcugugcccagccacaaugugcaaaugcuaccauaaauuaccauuuuuuaaaaaacgaaagcagauacuuuagacaaauuauuuauuuaaugccagugucauuguugauguuauaguuuaugauuauuuaaaaguuaaagguauuuuaccaaaugagcuacacuugauuguccauuuaaucugucaguuuaauuuguauagguauucauaggccaggcgugguggcucaugccuguaaucccagcacuuugggaggcugagacgggcagaucacuuaggccaggaguucgagaccagccugaucaacauggugaaaucuuguuucgacuaaaaauacaaaaauuagcuggguguguuagcgcacgcuuauaaucccagcugcucaggucgcugaggcaggagaauugcuugaacccaggagacggagguugcagugagucaagaucgcaccauggcacccuagccugggcgacagagugagacucugucucaaaaaaaaaaaaaaaaguauagguauuguagauguguuacugguuguauaauacaguaagauugggggaagagaccuaggcaaguuauuuccauuuuaagggcuuggauacaaaugcauaaccaaacccuaggcauuuauuuuauuuauuuuuauuauuuauuuguuuauuuauuuuugagauggagucucacugcaaacuccgccucccgaguucaagcaauucuccuuucucagccucuugaguagcugggacuacaggcgcaugccacuauaccugguuaauuuuuguacuuuuaguagagacgggguuucaccauacuggucaggcugguuucgaacuccugaccucaagugauccaccugccucagccucccaaagugcugggauuacaggugugagccaccgugccuggccacccuagacauugaaauuaauguaacaaaauacaaugaaaaaacagucuacaguccucuguuggguucacaguccuucaccaggcaugcagguuugucuuccuuuagguaauauacaaacauauggaacugucaaauuuaaaaacucaagaguaauugcuugacauacagagggauuucuuaaagaacaguuuuacgcugggcgugguggcucaugccuguaaucccagcacuuugggaggccgaggugugcgaaucacuugagcccagaaguuugagaccaggcugggcaaaauggcgagacccugucucuacuaaaaauacaaaaauuagccaggugugguggcacacacccguaaucccagcuacuugggaggcugaagcaggagaaucacuugaaccugggagguggagauugcaguaagcugagacugugcuaccgcacuccagcaugggugacagaguguuuaaaaaaaaaauuuuaacauagcauuaaaauauuuucuugcagauauuuauagaaauauauuaccuauauugauuguuucaucuuaaaaaagguuuuauaugauacuuggggcaugcaaaagacaugguauaguucuaugaauucacccagauaucacuguauguuucucuucuaucucauccaucuucucuccuuggcaaccauguccugauuuuuguguuccauaugcccuugcuuuaaaaaaauggauuugucuuuuaugcauuuauccuuaaagaguagauuaaauuugauuucagauuugugaaaauggacuuacgcuuugguuaguuuaaggcuuucugagauucauccauauuuauuuucuuuuuuugagauggagucucucucuguugcccaggucagagugcaagugcaguggcacaaucuugucucacugcaaccucugccuccuggacuccagcaagucuucugucucagccucccgaguagcugggauuacaggcauaugccacuauacccagcgaauuuuuguauuuuuaguagagaugggguuucaccauguuggccaggcuggucuugaacuccucaccucaagugaucagccugccucggccucccaaagugcugggauuacagacgugagccauccugcuuggugauucauccauauuccugggaguagcuaugauuuguuaauuuucacugcuguguaguuccaucgggugaauauauugugauucauuuccuuauuuucuuguagauugauuuuugaguuuucaguuuuuaguucuuaugaaaaugcuguaaugaacauuauuguacaugucuauuguugaacuuacgcuagaauuucuugaggcccuagcaaaugguuuuuuuuugagauggaguuucguucuuauugcccaggcuggagcgcaguggcacaaucucggcucacugcaaccuccaccacgcagguucaagcaauucuucugccucagccuccggaguagcugggauuacagacauuggccaccacgccuggcuaauuuugcauuuuuaguagagacgggguuucuccauguuggucaggcuggucucgaacuccugaccucaggugauccgccugccucggccucccaaaguguugggauuacagcaugagccacugcgcccagcgacaaaugguuuuuaaacaguugcacugcugauguuuuggugcuugguaauuccuuguuguggggacuuuuuuauguuuaacagcaucuacccauuagaugcaacuugaacucuuccucuugugacaaaaaugucuccaggcauugccaaugucucaaggauacaaaaucaccccugguugagaaccauuguuacuuuugauacaugaacaauuaaaaauuauuuuugugcguuccguauaucccauagaaggauaacacaccuuucucuuuuuuauuuuuagagauggaggccucacugugucuccuggucuagaauguaguggugcgaucguagcucacugaagccuugaacuccugggcucuggguauucuccugccucagccuuuuggguagcuggaacuacaggcuuuacagguguaugccaccaugccccgcucaacacaucuuucuuuccuuuuuugagauggagucucgcgcuguugccaggcuggagugcaguggcacgaucucggcuuacugcaaccucugccucccggguucaagugauuccugccucagccucccgagaagcugggaauacgggccaaugccaucacgaccagcuaauuuuuuguauuuuuaguagagacagaguuuccaccauguuggccaggauggucuugaucucuugaccucccaaagugcugggauuacaggcgugagccacugugcccagccucaacacaucuuucuuuggcucaagucccauuuaucuucaaggccugucucaaacccacuuuuuuuuuuuuuuuuuuuuuuuaaguuggaguuuugcucuuuuugaccaggcuggagugcaauggcgcuaucucagcucacugcaaccuccaccuccuggguucaagcgauucuugucucagccuccgaguggcugggauuauaggcacauaccaccacgcccggguaauuuuuguguuauuuuuaguagagacaggguuucaccaucuuggccagugggucucaaacuccugaccucaugauccacccgccucggccucccaaagugcugggauuacaggcgugagcccgcgugcugggccucaaucccaccuuuuaaaggcuucuccuacugugcccauuuguagucuuaucuuuuccccaggaauuccuauagcacuuagguuuguauauugaguuugacccuuaaguuuuuauugucuuguauugucaacuuuuccaggauuccucacccuucuguauuuucauccccuacccccaaguaaggaaacaacagauuuucacuuacucuguagucaguugucuaaucuguauugcuguuguugauuuccuuuggauuuuggucaauuuaggcagcuaucugggaagaauucuuuuuauuaauauuauacuuuugguguuuucaucuacagcaggguggaagcagaccuuaagcacccaaagcucucuacuccuuucugccacuuacguucucagcaaaaccucaguaacugcuagguuuuaucuuuucaaagcugcuuuugagugaguuuguuaaccucuugauguucauguuaaguacuuaaauguuagcugccccagcuguuaagucaugcaaagagucuuccuucagcuucagcugggcacaucuccggggcugugggaggacuuuuagaaugacaaugugaucugccucauuuuaucuuuucuguagugaguguagcucuuucaguagugaaugccuguguuuuacauuuuugagauuguucccuuuaccugucuaagacaagaaaguuguuauaucuguucuccuuauugcccccagguccuugaaguuaaaauuuuuuuuuugagacuuagucuugcucugucgcccagucuggagugcaguggcgcgaucuugguucaccgcaaccuccaccugcuuccaccauguuuggcuaaucaaauguaacauucuuaacaagccauccucuagauuuaaaaugguuuguaauuggaaacugaaaugguuuccaacugcaagccauaaaaacuugaaauucuucaguuugauagucaggauaacuagucccaucauuccaucauuuuucuucaaaacauacagguuuucaggccuuuuuuuuuuuuuuucuccccauaaagacaggaucucacucuuucccagccuggagugcaguggcaaaaucauagcucacugcagccuugaacucuuggacucagggaaucguccugccucagccuccugaguggcugggacuacaggcaugccaccaugcuugccuaauuuuuucuuuuuuuuuuuuuuugagacagagucuugcucugucaccaaggcuggagugcaguggcaugaucucgucuuacugcaaccucugccuccuggguucaagcaauucuccugccucaaccuucugaguagcuaggauuacaggcaccugccaccaccccuggcuaauuuuuguauuuuuaguagagacaggguuucaccauguuggccaggcuggucuugaacuccugaccuuaggugauccucccgcuugggccucccaaaguccugggauuaugggcaugagccaccccaccauuccuggguuucaggccuuuguagcuaaauaacuuauucacucaagugacagcucucugcuuccacagcuaaauacaaaaguuuaucagauuuuuccaaggcccggugcgguagcucacgccuguaaucccagcacuuugggaggcuaagcugggaggaucaccuaaggucaggaguuugagaccagccugaccaacauggugaaaccccgccucuacuaaaaauacaaaaauuagcggggcgugguggcacaugccuguaaucccagcuacuugggaggcugaggcaggagaaucucuugaacccaggaagcggagguugcagugagcugggaucaugccacuacacuccagccuggguaacagagcaagacucugugucacaguguuacauuugugagauucgucuaucuagguggagauuuggugccuuuuuuuuuuuuuuuuaauuaugagaaggagucucauguucgcccagacuggagugcaaguggccuggcuaauuuuuuguauuuuuaguagagacaggauuucaccauguuggccaagcuggucuuuaacuccugaccucaggugauccacccaccuugaccuuccaaagugcugggauuacaggccugagcuaccucaccaggccugauuaaagucuuuuuuuuuuuuuugagauggagucucgcucugucgcccaggcuggagugcaguggcgugaucuuggcucacugcaagcuccaccuuccggguucaagccauucuccugccucagccucccgaguagcugggacuacaggugcccgccaccaugccuggcaaauucuuuguauuuuuaguagagaugggguuucaccguggucucgaucucuugaccucgugaucugcccaccucggccucccagagugcugggauuacaggcgugagccaccgugccuggcugauuaaagucuuuuaauaugaaaagacuuagauucagaacugagcaggguaaggagagaguggaaaccuguaaggcauucuugcuggaguagaucuagcagaaguagcuugggucugaagaaauaguucuggcacgauuccugaccccuagaucauaacuaauuugguguguucgugaaacaaacagguuccacagcaacuuccugcuccccagaucucagucaaggugcuaugaacuuggacccugaucuucuguuuguaguagcaguggcaguucccuugacagcuccugcugcagcaguguucugggagacaucccuggggauugagcugagagucugcucuugcaaccuucaacagugcucuaacaccagucaauaucaaaucccuuucugcuuaaguuaaccagagcagugucuauggguaauugaaucaugacugaugcuauuaucaaauauaaacugaugacaauggcaagugggaaaccugcuguuuuacaaauaccagaugugcaucacauggagguuuauucacuccuauuugcguuuugauaauaauccuuucuaauaauugguucauugguguaaucuuuaugaaauuaaccugaguggcucaaaauucauuuuguagcacugaaugcaauuacuaauugagcuauuuaagcaaacuagccagccaccuacagcuacuuaaucuuacuggccuacuauaguagcucugacucacccuuaucuuaaccagauaagggauaccauacauucucucuaaagaacaccacugaccucacacacagggcuaaguaggcuaugccuauuguuaauauauccaaauaccaguugaauacucagcaggucaacaguauuucccauccaguuuaugccagcuguguaaguaugagauauaauuaaaaauuauguaaauagauuagcugugaauacagcgguguuauuguuucuaccaaauuuaaguugaauccuuuggaaagcaccauuaaagaugagguaauuuauuuuuaaucucaaacgaggugugggaauuauaacaguaaaaaguuaagagaucgggaauuuguaaacaucugcaaggauucuggcucauauugcuucucaaguauccuaauucucauacuguuauuaaaaacaaacccacaaaaaaacgaaagagaaauuggccaggugcuguggcucacaccuguaaucccagcacuuugggaagccaaggcaggcagaucucuucgagcucaagaguccaggaccagccuggaaacauggcaaaaccuugucucuacaaaaaauacgaaaauuagccgggugugauacuguccaccuguaaucccagcuacuugggaaggccgaggcaggagaauugcuugaaccagggagguagagguugcagugagccgagauuccgccauuguacuccagccugggcaacaagagugaaacucccucucaaaaaaaaaaaaaaaaaaaaaaaaaagcgacuuuaaucauauuuggaaugucucauauaauguagauuucagcucuccagaaugcagucucuugaaggugcagauucuucaggcauugagcucaugauuucauuaugccuaugaugauucagucuuggcuuuuuggucccuucaucuuucuuggggccuugcauucucuugauucuacuuuucucugcugaucucuuuccuucucucauuuucuguuuaugcauauagcagacaguagcugcuguagccccucauggcauugucucugcucucuaguucugagucccggggaagugauugugccaggcuagucaauuguagucuguaggaguggcugccugaauuuaccccuguaggcugggaagcuucuuuggggcaggggauuuuucugaauggucuuauuacaagggccaagguauaguugauucucauuauuugcaguaguuauguucuauaaagucaucaugaacaaugaacuaguaaauacugaaauguugcuccuaguggaaguacaaguuuagguuccugucacccucuggucagaacauuuucaucaacugaucaauacauaaucuuguuuuuuguguuuuuuuuuuaaagacacuguauuuaaaauauaauuguugauuuauuaacauuaaauuuguugccaacagcacuguaacucaugacugaaccaaccuuauguaacaugaauuuuugucauaagccauauagcuauagccauaaaccaugguauucuuguacuuagaaacacaagacagcacuucagcauuaugcuugggagccauuuuaagcagcuaaaucaccaacagacaguguaaaagugcaaaaaucauggcacuaaauagaccauagaauggacacuuguuugcauuaugagagcugaaacaagaaagccuuuguuuggccucagcugggaaugugugcauugggcaauucaaauuuuucauugcgcuaugcgugucugugaaugaccauacaaauggugauacaaauacugauuuugggguuauaaauaauuuuuuuuuuuuuuuuugagacagaaccucacucuugugcccaggcuggcuggagugcaguggcauuaucucggcucaccugcagucucagccuccuggguucaggcuauucuccugccucagccuccucaguagcugggauuacgggugccugccaccaugcccggcuaauuuuugugcuuuuaguagagacaggguuucaccauguuggcccggcuggucucgaacuccugaccucaggugaucuguccaccucggucucccaagugcugggauuacaggugugagccaccaugccuggccugguuauaaauuuuagugaguagguaaauuuguagauacggaaucugugaauaaugaagauugaugacguguguggagugccgagagcauuuaaaaaggacguugucaguugguggggaguguugcccaaaaagcuucauaagggagucaacguguaagauaaaguugaaagaugaguuuugccagauaggcaccacugaggauaggagaagcaaauagcaaagcaguuaugaguagaaucucagauuaggcucauuucccaucuucugcuccuacuaacuugggaccuugagcaagcauuuuauucucugucauuagugaaauagggauauucauggucccucucucaauggaguucuuaugagauuuaauuaagagaaugaacauuaaugcacuuaacagaugucuugcucacagaagguauucguaacggcguacacgugacacauaugucuauauauagcacagcaaaggagggaaauggcuucacuccuuugggaacaucgagugguuuaaagugaagcaaagguuucaagugggcaaaaggggucuuugaggagggaggggaaaggcaggagcuagauucauggcuccauacuggaacgauauugagcuauugaaggguuuaaaagagggauagcaucaucaguuuugugucuagaaaguuugcuuuauguuuauauagauguauggaagagaauugacgguggugaacuaaaggugggaaaaucagcaaagacucuuggggugguugaagaaaagaacgacagaagucacucgggauaguaauaguugguauggagacuagagaauggaugugaaagaugcucaggauguugaauugacuacaaaggucaccacuuagaaguggagaguaagagaggguaggcuugggaaggcucuugggauucugauguuggccgugcaguagaggaugggcuugguguguaggagaugcuuucacuuuucacuucuuucuccaccuuuacccugguaaaagguagcucccacuguucuuguucuaaaggguuuugugguccucucugcuucccuuuauugcagcaccugaccugugguauaauaaccgccuguguacuuguucuuuccugcacuuguaagcucuuugaggauuagcuguggucagugcuggccacaaagaggcaagcuaaacuguggauggauugaaugaauaaggaccaagacugggauagagaagcagauuuuggaggacagauucguuuuuauccuuguuaaguuuuagauucauuauugucucuauacagcuuuauacucaucuucaaaugacugugccuagcagacuggacugagauucaugagagagaggcccauguagcauuuuuccgagguguauugggaaggacaguugaggccagcauggaugaaaucucccauagugucuguguuugguggaaagggaagauaacugcagaaagagacuugcagcauaccaauaguggagggguucgcugaggaauaggggcauggaaaggaguuccagagagugcagugaccaucagagagugaggaggggcuaguugcccaccacccacaaaagcugugccuggagaggcuuuucugguuucagaggcugcagaaggguugguaagaggacuaaaaacaacauauugauuguagcaauuaaaaaguuacuggcaacuuuuucuggagugauuucaauccauugguggaggcagacaucagauugcagaugaagauuugagucaggaggugaacugacaaagaaaccccguucucuguugggguuugucugugagaggcuggggagagaaggcuguagcuugggugagucuaggaggggacaugacauacaggaagccuuugaaaguuauaugggagaaauuugagcaucuguaggcagugaggaagaagcucauggaagauauuuaauuugaauguuuuuuuuuucuuucuuucaaagccagcaugcagauguuacuauagccuggcaauaugcuaaauucuuacauuuaguggcuuacuggauccccaucacaaugcaguugguuagguaauguuaccccauuuuacugauggggaagcagaggccucauuuaaguaacuuuccugaggucacacagcuacuaaguggaggaggcaugugggagggauuaaaauccaguuauuguuccugguccugaggagaaaauaaaaauccaguuaggucuguuauguccugccucagccucccaaguagcugggacuacggguacaugccaccaugccuggcuaauuuuuuuuguauuauuaguagagacaggguuucaccauguuggccaggcucguugugaacuccugaccuccagugguccacccaccuuggccucccaaaguggugagauuacaggugugagccaccacacucggcccacuguauucuuuauagcaaaagaaaagaggaaaaaaaaauccuuuuggucuaggauccaaggcacucuguuccagaacuaucuccuugagucugcucuuccauuccuaccccuggccucagcaggcagguggaacaagauggaguggugaucggaaugggaugaaacggaugaaauaaaagcugcuuggacuugugagagagaaaugaguccuggcuuaggcaaaaauggucaggaggcucagggaguuucuuugcuguguugcuuucuaagcuggggcccaggccuggggggcccuuucaagcccucuugugguucaauaacuggguagaugugcuaacgauuaauggagaguuguggagguggccugcgacuucccuuuuccuccccaguuuagaaccauuugagaaggaugaaguuagaugaaaagucagaguauuaggagcuuugcuguugauaaagcuaagauuggagaacgugguccucuucuccuuucccuccagucuggcccuucaugccuguauuaguuaccuagggcuaauguaacuaauuaucacaaacugggaugguuuaaaacaagagacgucuauccugucacaguucuggaggcuaaaggccaaaaucaagguguuggcaggaccguguuuucucugaaggauuuaggcaggaaucugcuuacagccuuuguuguaguuucuuguguuugccaggaguccuuggcauuccuuggcuugcagcugcaugacucuagucccugccuccaucuucacauggcacucuuuccugugucugucucuucuccucuuccucuuuuuuuuuuuuugagauggagucucacucugucacacaggcuggagugcaguggugcgaucuuggcucacugcaaacucugccucccggguucaagcgauucuucugccucagccuccccaguagcugggauuacaggcacccgccaccaugccuggcuaauuuuuuuguauuuuuaguagagacaggguuuugccguauuggccaggcuggucuugaacuccugaccuggugaucugcccaccuuggccucccaaagugcugggauuacaggcaugagccacugcgccuggcuucuucucuuccuaaaaggacaccagucauaguggaucagggccgacccuaaucaaauaugaccucauguuaacuugauuacauuugcaaaaacuuuauuuccaaauaaggccacauucacagguguuggggguuagguuucagcgugucuuuuggggggacacaagucaaucccuaacaaugcccagccaaagcagugugcagagcagaagcuugcuuggcuccugugaggccacacccagugugcugaguguugggauugaaaggccagacuccaucaccucagguagggcccagaauccuucuuuuucuagccagagacauagucugcuaacugugagugcuuagguuccuagagggcuguguuuuaaaguagauacugaacuguucucuucagaggcagcagugcacaucaguucuguggcaggcuuuguuggagaaacuaauacacaaugagagcugucaguuuuuacuccucccacagaaguuguuuaagagaauacaagucagaaacacagguguagacagggaaggaaggcaauguuggauagaguauuacauuuggccggaaagcaucagacuugguuucuuuuuuauuaccaaauaaagacacguucucauuagaacaaggagaguagauguuuguccuuuaucauaauguaaaaauuuucagaaacaaacauggguuguuauaugaguuagugcuggacuuuauucaauggaaaggucuuuagcuuauuaaaaaaauucuuaggguacuugcuauaaauaucguuuuugcuguagguggucucagaaacauugaagaccagcucuguggaagcaagauaacaguugccuucagagauaguauugucauucacuuuguggacucagucaaaagaaggguagcauuuaaaaaaaugauuaucaccuucagcuaaaaaucauaguggugcuuguuuuaagauauaccuauuuuccugugacuuggaaacauuacuggaagaacauuuuaaacuucuguuucuucuugguucagaaaaauaaagguaaaagagaaacaagagggacuggggauuuaauuguagcaugauuaaguuuaguaaugauaaauauagauuaggaagaacucaaggaacagaacauuuauuaauauaaauaccuuuuaaauguaaugaauguaaguaggcaccucccagaaaaagaaaugcaaauggcuauguguguucaaaaaugaucacugucacuaagaaucaaauaaaugaaacuuaaccauacuuuuuugcccaucauauuggcaaagaucugggugguguagugaaaguuaacuuuuuagauuauuuaacauauuuaaaauuuuaugauuauccuauauuaacuuccaagauugaaaaaggucuaaaaccuaagcuaucuaggucuuuaaucuauguaucugauuuguagguagaaauaguuuuguguaaucaagggaguagugaugcuagaaacuggcagaguauauuuccuagaccaguuagcaaacuaggucaaggucuagguuuaauucuaguagccacuaauuugcugcaugucuuaacaauuucugugccucaauuucuugucagagccauuuuucauuuguuuguuuuuugagacggagucuuuaucuguugcccaggcuagagugcaguggcaccgucuuggcucacugcaaccuccgcccccgggguucaagugagucuugugccucagccucccuaguagcucggaucacaggcacgcaccaccacaccuggcuaauuuuuguauuuuuaguagagacaggguuuugccauguuggccaggcuggucucaaauuccugaccucaggucaucugccugccuaggccucccaaggugcugggauuacaggcgugagccaccacgcccaggcccagagccauucuucuguugcuuagaccagaaaucuugauucguauuucucuuacuucugucaagaaauuuuguucagaauguauuugcaaucuacaaucugagcauuucccucugcccaucaugguccaagcugccgucuuaacuugccuggguuaguguaaauugccuccuugucgaccucccugcuuccagccuuguccuuuuugacacaagagccagaaugugauuuacaauaugugagccagcucauuucucugcuucagaugguccagaaaaguuucuuuagagacagccauuaucuccuuaaaggggaauggauguuugaguaccaagaacuggauaacuaagagggggaggaaccccaggaucaguucccaucucaugcagaguaaaugccaaacuccuuuucuccccaguuucauuucucaccauucuccuccuugcuuacugaguuccagccacacgcaucucuuugcuguuccuugaagaguccgauagucucuuuccuuguuguuccuucagccuaaaauguucuucuuccagauaucuguaugauuaauucccuccuucagcccuuuguuccuccgaaguaccuucccuugccuacccuguauaaaauagccaccccuccccuuugcagucuauccccuuacccuugguucuucuucauagcauguacuuuuuauugucuguuucauuccauuagugucaggacuuuguucccuggugaaugacugcccagcaguuaggcauacaauaacuauuuguugaaugacucagugauuuccuuuuuccuauuggcuuuuuccucugccuagggaaaugcucgggccacccuuguucuuuagccugucgaagaugaacacugccuucuguguaccaaauguuucuacaaaggugaucugugggcuucuacccuguucucacugcccagauuuuucuguugcauuauucuuuaccagucaugcaagugaaucuguuuucuaaguaacuuuucuguguuugggacuacugcuuuccuuuuccugaauuugguaucauuauguaaauauguuaacaauuuggcacuuacuccuucauucagcuggcaaauaauuauugcagcagauacugugagccaggcuggggugccagacuguaugcuagggcuuaaagagguggcgagccggcauuucccuggaggagcugauggcucagugggugguuggaagugccagcaguugggacaggcaacugcuauaaugaacgcagagggggaguugggaacacggugaugggucaggcaggccuguuccagaggauuaggaaucucaggggugugcaggaguuugucaggugaggaagcaggcagaggcugcugugaggggaaggaauaccgugcagaaacacagaaagcuuugcuuguuuacagaagcacaagucagugaguauuguuggaguguaaaguacagugcagacagugaugauggacgaggccauaguaguuaggugagggccagauccagauuuuuguuuuuuuuuuuuuuugaaacagggucccacucuuucacccaggcuggagugggagugcaguggcacagucuuggcucacugcacccucugccccccggggugguaaagcaguccucccgucucagccuccgaguagcugggacuauaggcgcucaccaucacgccuggcuaauuuuuuuuuuuuuuuuuuugagauggcguuuugcucuuguugcccaggcuggagugcaauggcgugaucucagcucacugcaaccuccgccuccuggguucaagcaauucucccgccucagccucccgaauagcuuggcuuauagacaugugccaccacgccuggcuaauuuuuguauuuuuaguagagacgggguuucuccauguuggucaggcugucucgaacuccugaccucaggugauccacccaccucagccucccaaaguguugggauuacaggcgugagccacugugcccggccacgcccagcaaauuuuuauauuuuuuuuuagagacaggguuucgccauguugcccaggcuggucuccaacuccuggacucgagugaucugccugccucgaccucucaaagugcugggauuacaggugugagccaccgugccuggaccagauccagaugcuucuaaaggacuguguguauacuauauagagugaggcugcuauccugaagcccaugaauuuggggguauguaccugucuacacgugaacagaggcagguaggaauguagccuggaagguuuuucccuguugcaggcccccucccugaggcagggagaauucagaauauuuucuaccauguguuaauauauuuuugugcagauuauuuucuccuuuggauuguaaguuccuaaaggguggugagguuuaaauuuuauguaucuccuacuuccucaugugugcauugugagauagaugcucauuuaaacuuucuaggcugggugcgguggcucacgccuguaaucccagcacuuugggaggccgaggcgggugggaucgccugaggucaggaguuugagaucagccuggccaacauggcgaaacccaucccuaaaaauacaaaaauuggccgggugugguggugugauccgcucgccuuggccuccugaagugcugggauuacaggcgugagccaccgcgccuggccaaacuuucuuuaaacaaauaaugacuacaucacuaucuguagcccugcucuguuuuuuuuguuuuuuuguuuuuguuuuugagauggagugcaguggcgugaucugggcucacucacugcaagcuccgccuccuggauucaugccauucuccugccucagccuccugaguaacuuggacuacaggugccugccaccacaccuggcuaauuuuuuuuuuuuuguauuuuuuaguagagaugggguuucaccguguuagccaggauggucuccaucuccugaccucaacugauccgcccgccucggccucccagagugcggggauuauaggcaugagcccuagcccuggccagcccugcucuguuuuaaccuguuacuaucucaugacguuucacccuuuuaucugccccaucccucauuucuaauuuuucugucaggcagauuaaauucagcaaaaaaaaaaaaaaaaaaaaaaaaaaaagaggaaaacuuuuuuccaggaggauuuguuguuugugcugucagaugccagguccuaauggauuuagaagaagguuggggugggacuccuuccugaggcagccacuuuagugcuucuuacuuaccuuugcauucugugugccugucucaugauaggugcucaauaaauguuugcugaaggaaucauccuguuuauugacagcgagauuaagccuguguuuucauaguaaaaccugccuacuuuccuacuuugaucuccuauagucuuuccuuucuaugcuccagacacauuauuaaacuccuguccguuccagcgguacuuccagauauuucugcugccuagagugcccuuucucuugucuggccaacucccauaccuucuuauaagacuuaacucucccccuuucugggaaaaugauugcucauuaacccagguggaguuaguuacuucuuccugugucacuccaucacccaggcuggagugcaguggcaugaucucggcuuacugcaacuucuaccucccagguucaagugauuuuccugccucagucucccuaguagcugggacuacaggcgugugccaccacgcccggcuaauuuuuuauauuuuuaguagagauggcguuuuaccguguugcccgggguggucuugaacuccuggccucaagugauaugcccgccuccaaaguguugggauuacaggugugaacuaucacucccagcccuuguguacauuuuuauauugaaguuuguucagccucuagacaguuuggaaggugaagacagaccucaucccuuucugucuccaucgucauucuuuuccguguuuugccuggugcuuggcgauuuugcugaauggauggcuuguuaauuacuguaggaaggcaugauaugacaaucuguaagcacaccugaguaaacuaacgauuuuuaacauucucuacucagccuagacuaggccuuuguacagguacguaugugagugagagucuguuucagaacugguauauagaagcaacaucuuuuguaaacuugcaagguuagaaaauucauuuuuacggccagacacaguggcucaugccuguaaucccagcacuuugggaggccaaggcggguggaucaccugaggucgggaguucgagaccggccugaccaacauggagaaaccccauuuuuacuaaaaauacaaaauuaccugggugugguagaccaugccuguaauccgagcuacccggaaggcugaggcaggagaaucacuggaacccgggaggucgaggcuguggugugccgagauugcgccauuucacuccagccugggcaacaggaguaaaacuccgucucaaaaagaaaaagagaaaaggaaaauuuauuuuuacgucugggcucgguagcucacaucuguaaaucccagcacuuugggaggcagaggcuggcggauuggcugaggucaggaguucuagaucagccuggcuaacauggugaaacuccaucucuacuaaaaauacaaaaaagguagcccggcaugguggcgggugccuguaaucccagcuacuggggaggcugaggcaggaaaaucgcuugaaccugggagguggagguugcagugagccgagauugcgccgcugcacuccugccuaggcaauauagcgagacugucucaaaaaaaaaauuuuuauuuauuuuuuauuuauuuauuuuuugagacggagucuuacucugucgcucagaccagagucucacccugucacccaggcuggagugcaguggcgagaucuuggcucacugcaacuucagccucccagguucaagcaauuuugcugccucagccuccugaguaacugggauuacaggcauguaccaccacacccggcuaaguuuuguauuuuuaguagaggugggguuucaccauguuggcuagucuggucucgaacuccugaccuugugaucugcccgucuuggccccccaaagugcugagauuacaggcgugagccaccgcacccggccuagaaaauuuauuuuuacuuggaaggguuuugaggaggcuaacaguauagucagaucagugguucucuaccuggcauagggaacuuggcaagaggaaugacuagaggcccuuguuuguucagggguucaggcagagaugagggagucucccugagacugguagaagggaaugggaagugacugaaagagaaggguuccugcugggggagcugacauacuauuuguuaaaaaugaccuaaagcauauaauaauucaguucuguugacccuacugucuucucuccagacacugcccuaaccaucauggagguggccgagguggaaaguccucugaaccccagcuguaagauaaugaccuucagacccuccauggaggaguuccgggaguucaacaaauaccuugcauacauggagucuaaaggagcccaucgugcgggucuugcaaaggugauuauccuucgaugcuuuaaaugaaaaacaaucacuuggccuuuaauuuauguucuuaguuuucacgauuugggacauuguuucugaaggaagaaauuugcaaaaucuuuguucucguuaauccaugugaaacauuugauuucuucaaauaguaauugucuuauuuuuccuucaaguauaacuauucauacuagguugucuucuaaggcuuaaaaaaaaaaaaucaaaaccaaccaaggguggcugauggaaaccaaggagauccauguauggguuucagaggugugagaguauucauaguuuuugucaguuuuuuuguagacaacaauuauuaaccugaagguuaaccacaauuucucucuccuauccuuuuucuuuccuucuauguuuuuucuuuucuuucuuucuuuuuuuuuuuuuugagacagaguuuugcucuugccgcccaggcuggagugcaauggcgugaucucggcucacugcaaucuccaccucccggguuccagugauucuccugccucagccucccgaaguagcugggauuacaggcacccaccaccaugccccgcuaauuuuuuuguauuuuuaguugagacgggguuucaccauguuggccaggcuggucuugaacuccugaccucaggugauccauccgccucggcuucccaaagugcggggauuaaaggcgugagccacugugcccggccucuuuuuuuuuauauaacacuuauugauauauuuuaucauauaauaauauuguauaaugcauccauuuaaagugugcaauucagugauuuugaguauauucacagaauugugcaaucauuaccgcuauagaauucuguaacauuuucaucaucccccaaagaaacuucauaugcauuaagcagucauucuccauucccugcuaucacccccagcccauaggcaaccacaaacugacuuauucucucucuacauuugccuauucucuuuucuuucugguuauuuguucaacaaauguggagauugccugcuaugugccagacacuaugccaggugcuagagguagggauaugggggagcagaacagacgauguuccugcccccauggagcuuacauucuaguuguagcaucuuagaaugaugaaauaaggacauuuaagcacagauccaaaggauaaaaauaaaccagucuuuucaagauauggggacagaaagaauagcaaguccagcggccuggaggcugaccuguacuuuguggcugggaggaauaggaagguggucaguggacuugucuggcuaugguaaggcauuugggauuuuaaguguagagggaagcacugacaggcuuaaagugggagaggaagauaugguggcuguuuguuucuuucuuuugcuauuuuugggacauuauuuugaaaagaucacacuggcuccuacaugaagaaugaauugguguugugggggcagagcacaaauaaagcaccuugucugggauaguuauauuuaucuagugaagagccaauggugacccagaccagugaagaugggagaaguugucuuuggucuggauauguuugaaaauaucaucuuaucuuauucuuacgggugccagauaauauucuuaaaaaaaaaugguagugacuuaagccuuguggguguaagugacaugccccgagucauagggguggucagugaggugcugagaacucauugcacauuuggaugcauagguccaaaguaagaucuuugaaagagagauccacuauaugauauaauucaucguccaacuugagaugguuugugugucccuucuauaauguaagucuauuuuaauuaaaaaauuucccauggaagaauauauuucauugcacuuguuucaauuuauuauuguucuaaauguuaaauuuauaaucuggguuucuguagacuugucaauaucacugcauaaaucccugaguccugacagagucugcugccaggccgaaccacucaguugcacuuauguaaaggguucuccuugaaauccccagcuauggaggucagauagcauggaaaacagaagauaguugaggagagagcuuccagaacuauugggauugguguucaacuccuccugcaaauggaccugaugcuacuuguaacccacuacuuuacuguuucugguaucuguacccugaggccuguaauuagguuguauauauauauauuuuuuguuguuguuucuuuuugagacgggagucucgcucuguugcccaggcaggagugcagaggcacgaucucagcucacugcaaccucugccuccugguuucaagcuauucuccugccucagccuccugaauagcugggauuacaggcauguaccaccaugccuggauaauuuuuguguuuuuaguagagacaggguuucaccauguuggcuaggcuggucucaaacuccugaccucaaaugaccugccuuccuuggccucccaaaaugcugggauuauaggcaugagccaccgugcccggacauguaucuuguuaaaguucaugcccuuccuagaaaauuuuuuuuuuuucuuuuuuuuugagacagugucucauuuugucacccaagcuggagugcaguggcaugauauuggcucacugcagucuggaccuuccagguucaagcgaucccccucccucagccccgcaauuagcugggauuacagguaugcagcaccaugccuggcuaaguuuuguauuuuuuguagagccaagguuucaccauguugccuaggcuggucucgaacaccaggacucaaguggucugcccgcuuuggccucccaaauugcuggaauuauaagcaucagccacugccccuggccccuuccuagaaaaguuuuaaaauuugggaauauuaaguugagugaaaauuaauuaggggugggugagagagagaggaaacaagauaaagagaaaacaaacagaaacuaaagcuucguaaugacuuucucagaugagcuauccuuaguuuaacuucuuuauuggguuagcucaucaaaaaaaaaucucauuugggcuggguguggggcucacgccugcaaucccagcacucugggaggccgagguggguggaucacuugaggucaggaguucgagaccagccuggccaacauggugaaaccccaucucuaccaaaaauacaaauuuuagccgggcuuggaggugggcgccuguagucccagcuaaucgggaggcugagccaggauaaucacuugaacccgggagguggagggcagagguuggggauaaccaucucuucucuucucugggcucugaaugcagcccuuuguccuguucucucccacuuuuguuuccggaaaacauguacuguguuccacugaaauuaguggagugucuugugagguaggguggcacguucaguaacuuuagaagaggaaacagcagcuacccucacaagggagcugcaugcacacagagcacaccugcgucgcugucugcauuauguaacugaauaaaguuaaugagaacuaugauuacaaaacacaccugaguccagaccgugccucauuuuuaaaauugagacucauugacaaaguuggagacauuaauuuacucaauccugugauaauuuccuauuacucauuauuaggaauacaacgaacuguuucaaaucauuuuugccaucuuugacgucaagucacauaagcucaguuuuacuuacuuucccucuuguucuggaaguugcaguaguagcauauguauaaaacuguaccgaaucaaaucauauuauaaaaaucaagacugcauuaaugaagcugguuugcuuugggggcuaguccuggggaaccgagccacccaugauguucuuuguuaaugcacuauuuuuuuuuuuuuuugagacagggucuugcccuguuaggcuggguggugugaucguggcucacugcagccuugaccucccaggcucaagcaaguagccucccaaguagcugggacucagccucccaaguagcugggacuacccacgccuggguaauuuuuuuuauuuuuuguuuuuuguagagauggggucugcuguguuacccagaguggucuugaacuccugagcucaagugcuucucccaccuuggccucccaaagugcugggauuacaggcaugagccacugugccuggcccguuaauccacuauugacaagauuuaaugaauuggucuuaauuuaugauuugaagaaauuggucgaguaggugcaacaguagugacuuuagcuucagaugacagucugucuugguuuuucucuuucccauuuuuuagauucaugcuuuaaauuuaacauuuauuuuuugaguggaagguuugacacuuugacugucuacaaaguugauggucagguugcgaaagugaaaagaguggcagucucuucacauguaaaacuuguacuguuuuuguggaaggagauuaugaugaacuuuuuuuauauaugaagugggugaaauugguccccaacagaaaucugaacauagauuguccuggacuguagcuuaugcacaucauguaguuuuaugaacagccuagagagugcaaauagcuaucuuugcucacaaggugaagaaagauuauaagaagcaccacucuuucucuuccuccuccuugcucacuagguagaugguagaaauugcaauuuauuucaaggcaaguagugcaaaugcacauuuuagcagaaaguuucccacagggaauaggggccaggcuggguuugugggguuguugauaaaagaagguauauucuguuuugauauaaucaggaaggugaacuucagaaggaauggcuuucccucauuuagauucacuaaacauaaagauuuaacuuuggaaucuuuuaaagaucucaguauguuguguuucccuaugcaagaaaaucugaugucuuaggauuucaaauuauaguuaaaauaagauuuuuguuauagagcugaacuucugaaaauauauuccauuugaacucuuuaauuuaaaugaacuuguacacaaaaagcacaagguaauauuuggauuuuuguaaguuuauugugugccuugcuucucugucuuuagaaaauugcugcaaaauauuuuauaggcaagcaacuuccuuuuuucuuucuuucuuuuuuuuuuuuuuauugaucauucuuggauguuucucgcagagggggauuuggcagggucauaggacaauaguggagggaaggagggaaggucagcagauaaacaagugaacaaaggucucugguuuuccuaggcagaguguuugugucccuggguacuugagauuauggaguggugaugacucuuaacgagcaugcugccuucaagcaucuguuuaacaaagcacaucuugcaccgcccuuaauccauuuaacccugaguggacacagcacauguuucagagagcacaggguuggggguaaggucauagaucaacaggaucccaaggcagaagaauuuuucuuaguauagaacaaaaugaaaagucucccaugucuacuucuuuccacacagacacagcaaccauccgauuucucagucuuuuccccaccuuucccccuuuucuauuccacaaaaccgccauugucaucauggcccguucucaaugagcuguuggguacaccucccagacggggugguggccgggcagaggggcuccucacuuccccguaggggcggccgggcagaggcgccccucacuucucagacggggcggcugccgggcggagggucuccucacuucucagacggggcggccgggcagagacguuccucaccucccagacggggucgcggucgggucgaggcgcuccucacaucccagacgauggguggccgggcagagacgcuccucacuuccuagaugggauggcggccgggaagaggcgcuccucacuuccuaggugggauggcggccgggcagagacgcuccucacuuuccagacugggcauccaggcagaggggcuccucacgucccagacgaugggcggccaggcagagacacuccucacuucccagacgggguggcggccgggcagaggcugcaaucucggcacuuugggaggccaaggcaggcggcugggagguggagguuguagcgacgcgagaucacgccacugcacuccagccugggcaccauugagcacugaguuaaggagacucugucugcaaucccggcaucuugggaggccgaggcuggcggaucacucgcgguuaggagcuggagaccagcccggccaacacagcgaaaccccgucuccaccaaaaaaauacgaaaaccagucaggaguggcggcgcgcgucugcaaucgcaggcacucugcaggcugaggcaggagaaucaggcagggagguugcagugagccaagauggcagcagcacaguccaacuucggcuuggcaugagagggagaccguggaaaggggagacaggagagggaugagagggagaccguggaaaggggagacgggagacgggagacgggagagggcucuuuuuucuuuucuuuuuuuuuuuuuuuuuuacaaaacagaaaaacauuuaauucuacacauaauauuaauuuugauuguggauaucuuuauugcuaaugaagagccugaauaaaucuguguuccauuuuuuuauuauucuggcuuauuuccgaggaaaaaaguuaguuuuuauaacauucuuaaauauagugccccuccccuuucaauaugucaucaaaauaguaagguuauucauauucauaugaauguaguaagguuauucauauucauauagucugauuguucauauucuuuucaaauauugaguguggcugggcaugguggcucacgccuguagucccagcacuuugggaggccaaggugggaggauugcuugagcccaugaguucgagaccagcccuggcaacauagcgagaccacaucuuuuccaaaaaaaaaauaaauaaauaaaaaaggccaggcacagugacucacgccuguaaucccagcacuuuggaaggcugagguggguggaucacuugaggccaggaguuugagaccaaccuggacaaauggugaaaugcugucucuacuaaaaauacaaaaauuagucgggugugguggugcacaucuguaaucccagcuccuugggaggcugggacacgagaaucacuugaaccugagaggcugagguugcagugagccgagauugcuccacugcacucuagccugggcaacagugagacuccaucucaaaaagcaaacaaacaaacaaaaaauuaacugagcguaggagcaugugccuguaguccuagcugcuugggaggcugaggugggaggauuucuugagccugagagguccaggcugcugugagcugcgaucaugccacuauauucaagccugggcaacagagucccugucucaaaaaaaaaguuaaauaaaauaaugagggugugauuucaguaacauauacuaugaauguauaucuaucuauuuuauuuuauuuuuuaauuuauuuuuauuuaguucuuuugagacagggucuugcucugucacccaggcuggagcgcaguggugugaucuuggcucacugcagccuuguccucccgggcucaagcagucgccccaccucagccucccgaguagcuaggacuauaggcgugugccaccacaccuggcuaauuuuuguauuuuuuuguagagcugagcuuucgccauguugccuaggcuugucucgaauuccugagcucuaguuauccuccagccucggccuccugaaguguugggauuacaggcgugagccaccguuccuggacaguauucucauuuuaaacaaacauacguuggaggauauaaaauauguaguauccuuauauugcuaaugaaaauuaagguaaaauugacagcucacugugaggugguuuuauuuuuuuugagcuaacaacucucacuuauaagcuguauagcacuggccaaguuacucaucuccugaccccaaguuucuuuaucugaugacgcuugacuugaguuucagaguuauagguacauguagaccuaaaugugaaagacaagacuuuaacacucuuagaauauaaaguagaccauuuuuauguccuugaguagggaaauuuuuuuuuuuuuuuuuuuuuuuuuuuuuuuugagauggagucucgcucuguccccaggcuggagugcaguggcgugaucuuggcucacugcaagcucugccuccugccucagccuccagaguagcugggacuacaggugccugccaccaugcccggcuaauuuucuguauuuuuuuuuaguggagacgggguuucacuguguuagccaggauagucuggaucuccugacaucgugauccacccgccuuggccucccaaagugcugggauuacaggcgugagcuaccgugcccagccugaccuugucucuuaaaaaaaaaagauuggagggcaaguuacaggauaagagaauauauuuacaugcucuugugcagauaugcucucucucucucucucucucugucucucucucucucucucuguauaugccuccauauacacauacacaucgaagaguauucuccuuggauauauaaaagaauauauaaaagacuucuauacauuaauaaggaaaaacccaacaaugcaauaguaaaaugauaaagagacuugaauaaguacuuuauaaaagagaguaucagugagcugggcgcgguggcucaugccuguaaucccagcacuuugggaggcugaggcggguggaucaccugaggucaggaguucgagaccagccuggccaacauagugaaacccugucucuacaaaaauacaaaaaauuaucugggcaugguggcaggcaccuguaaucccagccacuagggaggcugagauaggagaauugcuugaacccaggagguggagguuccagugagcugacaucgcgccauugcacuccagccuggggaacaaaagagaaacuuugucucaaaaaaaaaaaaaaaguaucaguaaggucaguaaacauauggaugaaaagguuucuuucuucauuuauucggaaaauacaaauaaaauucacacuugaguaccauuguacacuuaacagaaagacuaagaguuaaaugauggacaguauuaggugaugaugaagguguggaggaaugggaacucucguauauugcaguugggagugcaaauugguacaaccacuuugcaacaguuggcaauaucuaugaaauuugaacuacacguauccuaugugucaguaauuugacucuuagaagugucuguguaugcauggauguuuuagagacccaugugcauauaugcacuagaauaucuguacaaaaauauuaauagcauuauuugcaauagccaauaauuagaaaaagccacaugcccaucaaugguuaucaguuuauaaauacauaaauauuuauaagacaaaauacugaguaggaaugaaaaucaaagaacuucagcuacauaggcuguuacauuugcuuauuuauuuauuuauuuauuuugagacagagucucacucugucacucaggcuguagugcaguggugugaucucagcucacugcaacaauucaccugccucagccuccggaggagcuuggacuacaggcauugaccaccacguuuggcuaauuuuuguauuuuuaguagagaugggguuucaccauguuggccaagcugaucuuaaacuucugaccucagguggucuguccaccuuggccucccaaagugcugggauuacaggagugagucaccgugucuggccuaggccguuauauuuaaaucucacaaaauaugagugaaguauaaaagauaaaccucaaguaguauauacuguaggguuacauuuuuauacauuugcaaaacugguguauagguaugcauauagaagcauaaaacuaaagcccagcaaugaagucauugccauaaacaccguaauugugguuaccucuugggcaauagggaagaugaggcuggaaaagggcgcuuggagggccuguaucgugccagcaauaucuugccucuuacaccugggcaguaggucauuugguguuugcuuuguaauaauucacagagcugugugcuugugauuaugcauuuucuacaugugugcuguuuuucaauaaaaaaccuuaaaaagauuguuuuaggccaggcacgguggcucaugcuuguaaucccaacacuuugggaggcagagguggucggaucacgcugucaagagaucgagaccauccuggccaacauggugaaaacucguccuauuaaaaaugcaaaaauuagccgggcaugguggugcgcaccuguagucccagcuacuugggaggcugaggcaggagaaucgcuugaccccgggagguggagguugcggugagccgagauugggccauuggaguccagccugggcaacaagagcaaaacucggucucaaaaaaaaaaaaaaaguuuguuuuaaaaaaauuaaaaaaacuucuaaaggugguaaaguggccaggugcagugacuauugccuguaauuccagcacuuugggaggccaaggcagaucaguugagcucaggaauuugagaccagccugggcaacauggcgaaaccccaucuguaacaaaaagaaaaaaaaaaaaaaaagaaaaguuccagcaauagaucaugaauugcuucaugacguuguacguucuauuuuaauuuaauuuaauuuauuuguuuaugagauggacugucacccagacuggagugcaguggugugaucuuggcucacugcagccuccaccuccuggguucaaagugauucuccugccucagccucucgaguaccugggauuacaggugccugucaccacgcccggauaauuuuuguauuuuuaguggagaucagguuuuaccauacuggcuaggcuggucuagaacuccuggccucaagugauuuacccaucuuggccucccaaagugcuaagguuacaggugugagccacuacggcuggcuguuaccuucuacuuuuaaauccuaucaauauguauuuuuggucuuaauguuuucuguaucuuuucacucuuaguaauuaaguacuuaaauacugcaggcaaacacuggugugcugaggcaccuuauacuggcauuugagaguugauagugcacaucucuucccagcugcuuauguagugaugucacguugguagguucagauuggccauggugggaguacuaugccauggacacagguaaaagcuacaaaucaagguuuccuccaccuuucuggaaagcugguuauuaaagaucuacuagcauaccgcugugcuaucgccauauugugugagaagucuauaaagaauauaauguuggccgggcgugguggcucacgccuguaaucccaacaauuugggaggccgagacggguggaucaugaggucaggaguucaagaccauccuggccaagauggugaaacccugucucuacuaaaaauacaaaaauuagcugggcgugguggcaggcgccuguaauccuggcuacuugggagccugaggugggagaaucgcuugaacccagggaagcggagguugcagugagcugagaucgugccacugcuccccagccgaguaacagagugagacuccgucucaaaaaaaaaaaaaagaauauaauguugacuauguauuuacuuauuuuucucauaauaauauaaacagcacauagguacuuagaucauauucaauaaagaugaacuucuuuggggaagaaauuauuuauguaaacauaauuucgucuuuuuuuguuuuuccugagacagagucucacucugucacccaggcuggagugcaguggcgcgaucucagcucacugcaaccccugccucuuggguucaagcgauucuccugccucagccucccggguagcugggacuacaggugcgugccaccacgcccggcuaauuuuuguauuuuuaguagaggcgggguuucaccauguuauccagguugguguugaacuccugacguggugauccgccugccucggccucccaaagugcuggaauuacaggugugugccacugcgcccugccaauuucaucuauugagaggcagguuaacauaaucgcucagugugaauucaaacuguuuuaauuagaauuucagcucaaguagucuuuagccauuuuaacuucaaauuauuuuacuucugugugucuuucaauuuuaucuuuaaaaucaagauguuaauaguaccuacucaaaaugaguuuaauacaaguacaguguuugggauagugaguacucaauaaauuuugcuauugaauaacaucauauugcuuuauugcaaauauucaucuuuuuuuuuuuuuuuuacacauuugucauagagauacugagaaauucuucaguuguaguuuaucagaauacuuaaaagcuaaauuacuuggaguauuuucaagaugauauuuuauuucauuauuuuauuuuuaggugauuccuccuaaggaguggaagccaagacagugcuaugaugacauugauaauuugcucauuccagcaccaauucagcagauggucacagggcagucaggacuguucacucaguacaacauccagaaaaaagcgaugacugugaaggaguucaggcagcuggccaacaguggcaagugaguagaaucaguuugcuauuucuguuuccuucaaagauuuauguaaauauguuaagaaacaaaguagacagaggagcuuauaaaugaaaagcaggagucucccaugcaauuuuucacccuucauugaacuguuucuguuuucuguucuuuaggugguugcugaacauuugacuuaaagaaauugcucuuuauuuuauuaucucguuccuagcaguuauaaguggaacuucuuauccuauaguugccaugaguuuucguuucuacacaugauucauguuuguugggcaguuuuuuugguguguguuugauaauguuuaagccuuaaaugauuuauauguauuagaagauuaguacuuuuaaaagcaaaccuugaaugacuugaaaggccaccauugcauuaguuauuuauugcuguguaacaaauuaucccaaauuggccaggcaugguggcucaugccuguaaucccaguacuuugggaggccaacgugggcggaucaccugaggucgggaguucaagaccagucugaucaacauggagaaaccuugucuccacuaaaacuacaaaauuaaccaugcgugguggcacgugccuguaaucccagcuacucaggaggcugaggcaggagaauugcuugaaccugggagacagagguugcagugagccgagaucacgccauugcacuccagccugggcaacaagagugaaacuccgucucgaaaaaauaaauaaauaaauaaauaaauaaauaaauaaauaaucccaaaucuuagcugcuuaaaccaacccauaauuucugaaggucaggaaucugaccuucagauucugccucagggucucaugagguugcaguuagcauguuggcugggcuacagucaucugagcauuuaauuguggcuggaagauucucuuacaagagugcuccccuuucauggcuuuugaugggguccucaguuccuugucauauggacugcucuucaugucauggcagcuggcuucucccagagcaagugauccgagagagaucgcaagaaggaagccacaugucuuuccuugcccuguuucagaagugacacacuguugcucucccucuccgucuccgucucccucucccucucccucucccucucccucucccucuccgucuccccacggucucccucucaugcggagcggaagcuggacuguacugcugccaucuccgcucacugcaaccucccugccugauucuccugccucagucugccgaaugccugcgauugcaggcacgcgccgccacgccugacugguuuugguggagacgggguuucgcuguguuggccgggccggucuccagccccuaaccgcgagugauccgccagccucggccucccgaggugccgggauugcagacggagucucguucacucagugcucaauggugcccaggcuggagugcaguggcgugaucucggcucacuauaaccucccagccgccugccuuggccucccaaagugccgagauugcagccucugcccagccgccaacccgucugggaagugaggagugucucugccuggccgcccaucgucugggaugugaggagccccucugccuggcugcccagucuggaaagugaggagcgucuccgcccggccgccaucccaucuaggaagugaggagcgccucuucccagccgccaucacaucuaggaagugaggagcgucucugcccggccgcccaucgucugagauguggggagcgccucugccccgccgccccaucugggaugugaggagcgccucugcccggccgagaccccgucugggaggugaggagcguuucugcccagccgccccgucugagaagugaggauacccucugccuggcaaccaccccgucugagaagugaggagcccauccgcccggcagcugccccgucugagaagugaggagccucuccgcccggcagccaccccaucugggaagugaggagcgucuccgcccggcagccaccccgucugggagggagguggggggggggucagccccccgcccggccagccgccccauccgggagggagguugggggucagccccccaaccuggccagccgccccguccgggagggaggugggggugucagcccccagcccggccagccacccccuccgggagggaggugggggggucagccccccgcccggccagccgccccguccgggagggagguggggggggucagccccccugcccggccagccgccccguccgggaggugaggggcgccucugcccggccgccccugcugggaagugaggagccccucugcccggccagccgccccguccgggaggugaggggcgccucugcccggccgccccuacugggaagugaggagcuccucugcccggccaccaccccgucugggaggugugcccaacagcucauugagaacgggccaggaugacaauggcggcuuuguggaauagaaaggcgggaaagguggggaaaagauugagaaaucggaugguugccgugucuguguagaaagaaguagacaugggagacuuuucauuuuguucugcacuaagaaaaauuccucugccuugggauccuguugaucugugaccuuacccccaacccggugcucucugaaacaugugcuguguccacucaggguuaaauggauuaagggcggugcaagaugugcuuuguuaaacagaugcuugaaggcagcaugcucguuaagagucauuaccaaucccuaaucucaaguaaucagggacacaaacacugcggaaggccucaggguccucugccuaggaaaaccagagaccuuuguucacuuguuuaucugcugaccuucccuccacuauugucccaugacccugccaaaucccccucugugagaaacacccaagaauuaucaauaaaaaaaaaaaaaaaaaaaagaaguggcacacuguuacaucugccauauucuguuuguuacaagccaguuguuaaguguagcuagccuacacucaaggggaggagaaugaagcucuacuucuugaagggaggagugucaaugaauuugugggcauauuuaaauguugucacaauuauuauuauuaaacuucuuuuaaaaaauucugauaugauaauuaaggccccagaugaaagcauaaaucuuacaaaaacaaaauaaaaaaaccugaaagaccaacaaaaaaucauaguuuccaaauucccuggaugggugugaaugagauuaagacuuugaaugaauuuagguaucuuccuuuaaaaaaauuauauuugacauuguaagcacaugaugcuacuugaagacucuuauuucugcauguuaaauuccuacuguggaacauucuggcuauuccaaagaaauugaaaauuuuauauuugauauaauuugaaucauuucuuuugaauuuuuuggguugguauuaauagaguuuuauucuuucagaucuuauuaaucgagaacaugaaacuuucaacaaagauuggaagcauuuucuuucagacucuuccagaauucuuuuauaagugcaaugcuguugaaacaagauugcagaggcaauuaaaccuguuuacaaguauaaacuauugacuguuuucuguuacuguguuuuaguacccauuuccagugucucucuuaaaguguuaauugaauagguuaggucauugaguaguaacucugcuuggcuccuuugauauuucaagggauacuuacuaaaaacuauuguuaauacucuugauaauugucauaacugccauaggaaagguacaaagugcuaugagguuucaaaggaauacaaggcuucugugguuguucauaaggaauggguaauuucauuuuguaggcacuauugagauggauuuugaaggauggucagaaacauuucuaccaguuacaaaaguaauaugugcuuauuuaaaauuucaaaaauaggcugguugugguggcucacacuuguaaucccagcacuuugggaagccgagguagguggaaugcuugaacccaggaguucgagaccagcuggauaacauggcaaaauccagucucuacaauaaauacaaaaauuagccaggcaggugguaugugccuguagucucagguacucaggaggcugaggauugcuugugccugggagguugaugcuaccgugagucgugauugcaccguuguacuccagccugggugacagagcgagacccugucuugaaaaaaauaaauaaaauuucaaauauagccauauauaacuuuaacucuaagaggcaaucauuguuaguauuacuuggcaauucaaaauauuauuaagacuugagccuugaaguucuuucuucucuuguuauaaagaaacuuugaucauccucucuagcccauuugauuauuucagcaugguaucgguuuucuacuucaagauaauuuuacugaguacacauuuuauacauaucucuguuaaauuauuacucuacugacuugguuguagauuuacucuuucugaagauagccauucaggugacauuguuuuguguaucacuguguacacagugcuugguauaguaucugggauaugguaggugcuuuuucaaaugaauaaauaguguuauaaaaacuaaaauccacuuaaaaugguauaaauuuuuaggcaaauuguaaagauuuacuuauuaacagaauauacauuucuugacauucugggguuuagagaugguuuaaaaaauuuuugguuuuuuuuaaguuguaaaauguaaccauuaugggaaauuauuugaaaaauuauuucuagcuuuaauuuuauuucuuuugaaguuaauuuacgcuggguacagugguucacgcuuguagucccaacacuuugggaggcugagguuggagaauugcuugagccaggaguuucaagaccagccuggucaacaaagugagacccugucucuacaaaaaauaaaaaauuagccaugcaugguggcaugugucuguagucccagcuacucgggaggcugaggcaggaggauuacuugagccugggaggcugaggcuucagugaguugugauugcaccauugcccccgagccugggugacaagagcaagacccugucuccaaaaaaauaaauaaauaaauaaauaaaguuaauuggucuuuugauuuggacuaguuucauuauaauuguuguaauguuaaacaacuuuugaaauucauauuuuuuguauuucuucugccaguuucauguagaaauuuauuucaaaugccaaggaaauggauuucuaagccucaagaaccaaugcucuuacuugucaacacagagcugugccaggaucaccugguuguggaauggucauguuaggagauuaauuuuuguuggagacaagagguuuucugcugggcugucuuuuuuuuucugagacagagucucgcucuguugcccaggauggagugcaguggcgugaucucggcucacugcaaccuccgccugcuggguucaagugauucuccugccucagccucccgagcagcugggaccacaggugcgugccaccaugccuggcuaaguuuuuuguauuuuaauggagaugggguuucaacauguuggccaggcuggucucuaacuccugaccucugauccgcccaccucggcuucccaaagugcugggaucuuuccauucaucuguuuuucuuuagcaccugaccuggcauuggugcaccgucuguaauguacucagucuuagcaguagagacgaugacaugcucauuugguugauaaugcaauguaguccaaagaaaaccuagagauuuccgauauaacucuaauauaaaaauuuauaaugguagguaauaugaaucacauuacugauguguacuuuccucuaggcacagagccaagugcuuuccauaauuaucugauggagcccucacaacaagcuuccuguuuuuaucccuauuuuuuagaagaauaacugaguuccagagaaauucagccccgugucuaggguuuuguggcuuaugaauggaagccugaguuuaaacauguguagccuggcccuggagcucaccucuuaagaacuguacugcaaugagugagagguucuggguaagaagauaugguugaaucaguaucgggcaaauuuacacuggauuuguggaauagcugugauuguccauuaggaaggacaguccauuaggaaggacucugaucaguuacuagccaagucauuuauuuuguuuagaauuaauauuuguuuaauauauuuaaggauuuuagaauuuaacuucaauggacaauaccaaacuuuaucuuucucucuuagaguuaugaguuuuaaaaaauugauacugcacaugccuguaauuccagcuacucgggaggcugaggcaggagaaucccuugaacccaggaggcggagguugcauugagccgagaucaugccaccgcacuccagccugggugacagaacaagacucucaaaaaaaaaaaaaaaaguuguuacugauugaguacauagugauagauuggucuugguauagguguaaagcagauuagggcuucaguuuccaacaaucuuggagguuucuguagaaguccuaauaaacagcaucucugcuaucuucuccuuucugaucauucuguguuuuggggcagugguccccaaccuuuuuggcaagggacugguuuuguggaagauaauuuuucuauggaugggaguggugggaugguuucgggaugaaacgguccuaccucagaucaucagacauuagguucucauaaggagugugcaaccuagaccccucacaugcacaguucacaacaggguucauacuccuaugagaaucuaaugccacugaucugacaggagguggaacucaggcaguaaugcucaccugccacugaccuccuaugcaucccuguuccuaacaggccgcggaccccuacuggggauuggggacccauucuccgggaaauagggauguacaccugucucugucaccugacucugaucuuuaguuagcuugcuuagcuugugccuggaauucccgauacuacuggaaccuacuagcagaagugguggaaugaugacagauuaauagugcuuucaugcuaauccuuuuuauuaaaaacauuuuuaaggcugggugcgguggcucucgccuguaaaucccaggaguugggaggccgaugcaggcggaucaccugaggucgggaguucgagaccagccugaccaacauggagaaaccccgucucuacuaaaaauacaaaauuagccaggcaugguggugcaugcuuguaaucccagcuacuggggaggcugaggcaggagaaucccuugaaccugggaggcggagguuucagugagccgagaucgugccgcuguacuccagccugggcaacaagagugagaccgucucaaaacaaaacagaagaaaaacauuaaaaaaaaaauuuuuaauucuuuagaaaauagagggucucacuaccuaggcagaccuugaacuccugagcucaaaugaucuuccugcuuugggcucccaaaaugcugggauuauagccaccaugcccaucccaugcccauccuuuuuauuuuugacugugcuuuauauucuaguguucuggguaaauucaaauuguucuauguuuuaaauacaguuguuaaauuaaguuguuugguauuuugaauacaguuguuccauuauuugguauucuuguuacacagauaacuaguuugggguccccaguauagugaguguagaugucgguuauucuguagucaaucuaaaauguccaguaugcuuuauagggauucuacuacugcuaaauaccuuuuuaacuuugcuucauuauauucucauuuguuucuuucuuugcuuauuuucuuccugaagaaacauugguauuccuuuuauguggugagauuauuguucaaauuccuaauaauacagagaaguaagugcuuuucuguaauuucuaugugagagauaaccauuaauaauuugguguacauuucuuucuaaugacuuaauauacaauuacagguuuuuuaaacuguaaauaggauauaguauacacacuauuauguaaccugauuuauucacuguggauagaauuugaugucaguaucuugaaagagcuaucuuguuuuauauucuguauuuuuuuuagcuaauuacuaguugauggauauaaacuuguauuuucaauuaaugcugcagcaaacauccugggucaacuguuauuguacacaucucucuguuguuagggugaauuucuacuuuuagauuuugggucagauaugucaauuuuuaaaaagcuuuuuauauguuuagaaaaauuauaugcuggaaugguuuugccagcuuauauucccacucuaguugucuaagaggugucauuauuuucuugccauuaauauauucagcauuuaccaauauaauaacugcaaaauaucuuauuuuaacuuuacuuucuuggauuuuuagugagauuauuguuugucaguguuucucuaaguguuaugucauuuuuauauaaauauguaaaauuucuuagcauaguauaguugauuaaagauuuuaaaaauacuuuaaagcugaaauaaugacuuuuaaacugcuuuucugcuucuauuguuguuuucgugaaaguaguuuucuaauaaaauguaaaguaauauugaguauucagcaaucuuaagacuauucagauagcuauguaaaucaguuuguauguuuacuuguuagaauugacaacaugcaguauuuucguuuugguaggauuuuguuuuagaaagugauuuaaaucaauuuggugggaaaaacccuaaaacugacuuacugguuuguacauuuuugucaucuaccuuuuacagauauuguacuccaagauacuuggauuacgaagauuuggagcgcaaguacuggaagaacuuaacuuuuguggcaccuaucuauggugcagauauuaaugggagcauauaugaugagguacauucauauuuacagugaguuuuguaaagaucauuggaugugacaguuuuguuaccauuuaagcaguuuagaaguguucuuuuguugugcuuuugggugauccauaauuccucaaaggacaacaggaaauauucaucaguaggauuucugcugcugguauuuuucaaacugaagcuagauaaucguacaaauaccugaaauuguucaguaguaacaugguaugugguuaucuggcugaucuuuucauuacauuaaaacuuuuuaaagcaaaaauacauuauaaaaauguuuggaaaacaggaaauaugaugcaucauacugacaccuuaaagcagaagcaguauuuuagauauauuuuuccaguacuuucccucaaucauuaaaaaaauguuauauuugaacaggcuuauauuguccuuuuuuucacagacaaauuguaauauauauauauauuuuuaaaaaguacauguuauuacagucuagccauuuuaaugguggcguaauucauugguuauauucuaauucuuuuugccuuuuccugauauuuuaaaacccuaauucuaaaaguucuuugucuuuugaaaccuucuaugcccucucucauuauuuucuuuuuuaauuuauuauuucuugaaauauuuauuucaaaacauacagggucucaguauauugcccuggcuggucuugaacuccugagcucaagagaucuaacugccucggccuccuaaagugcugggauuagaggugugaaccaccaggccuggcccauuauuuucuuucgaaaaauuucuuaucuacugaaagguggaacuagugcaauacacaccuggauaccauucacuuagguucacuaguacagguuaagcauccuucauccagaaauccaaaaucuaaaugcuccagugagcauuuccuuugagcaugaccuuugagcaucguguugaaacucagaaaguuugggauuuuggagcauuuuggaagggaugcucaaccuguaaguauaaugcaaauacuccaaaauggggaaaaaucugacaucugaaauaccucugggcccaagcauuauggguaagggauacuugaucuauaguuaauauuuugccacauuugcuuaauguuucuuugugucucuuuaucucuguuucuaucugucugucuuucugucuuugauguaugaugcaggcaucacgauaguucacccugaauuauauaagcauguaucuuuuaaugacaagagaguuuaacauuuauauaauauuaucuaguguauagaccauauucaaauuuucccaguaauguuauaacuguccccccgcccuccuuuaaggauucagucaaggauuccccuuuguaacuaauaagugaucuaugggguauacucaaauauuagcugacuaucuguccccaacagccuuucauucaguggauuuggcaucuauggcauucauucauaauccuugccuuaauuccauuauuauauuauuuuaaaaccuuuuuuauuuugaaauauaaaacaagcuagaaagugcauagaacauaaaccuagagcuuuaugaauuauuguaaagugaacaccuguguaccauuucugacacugaggaaaacauuaccagcaccguagaauucccuuaccugcccuauuaccuacuauaggcuccccuuuuccuccaaagguaacuagaucuucugacuugaagguaaucauuuucuucuuuuguuuaacaguacagcucaguguggccuguuucugaauuuuauauaacuagaaucauucagugugcauucuuuuaugucuggcuucuuauacuucauaccuuauaccuucuuauauaccuuauauauacaugguuagcuuuagaagaaaacauuuuuuccagcuuacacuuccuauagcaauguuuucaaguuuccuuugccccacauccucccuaacacucgauauugucauuucuuuaauuuuagccacucuguugguguguguagucguaucuuuugguuuuaaguugcauuaugauuuuuuccccuuauguucacugaauguuuggauuuccccuuuagugaagucucuuauacacuucuuuuuugucaugcuuuucuuuuucuuuuuuuuuuggcuuaaguucccuuuucugugguuuuagugauucuuacugguuuauacuucuuuauauauccugcguaugagguaguagcacaauuucaaauaugaauuuuuaauugcugaacacuuauuucaaagacgauucuuauuuuugaagauauaugauauuguagaauugucauauuggauggaaugauggcuauguaauuuucuuaauuuaucaauuaaagaugcauauugaaggauauaugauugaaauaacacgaggguugggauuuguuuuucaguuacuuaagaaaauaaaguugaauggauauagaugaaagaagauuggccccucccccugcccccccccccacuuuuuuuuuuuuugagacagucuuguucugucacccagguuggcaugcaauggcaugaucacggcucacugcagccuugaccuccuggguucaagcagucuuccugccuccaccuccuauguagcugggacuaccugcaggcgccaccaugccuagcuaauuuuuaaaauguuuuuuguaaagacagggucuuccuauguugcccacgcuggucucaaacuccugggcucaagcgauccucccucuucagcuucccaaaguguugggauuacaggugugagccacugugcccagcccagcaaaauauuuauaauugaagcuaguugacagacugguguuuuaaauacguauauguuugaaauaguaaaaauaaaaguuaaaaaaauagccuuuccucauucugcaucugaauuuuuacuaguauaaguaaucucuauguugagaauguauuguuuauuaaaguaguauauguacauguaggaaaauggaaaaauacagaaaaacgugaagaagagaauaaaaaauugcucauaagguuaucaaacaggaauaaccuuuuuuuuuuuuuuuuuuuuugagacagagucucacucuguagcccaggcuggagugcaguggcgcuaucuuggcucacugcaaccugugacuccuugguuuaagcuauucuccugccacagccucccaaguagcugggauuacaggcacgugacaccaugcccagcgaauuuuuguauuuuuaguagagacgggguuucaccaucuuggccagguuggucucaaucuccugaccuugugaucugccuaccucagccuuccaaagugcugggauuacaggugugagccaccgcacccugcccaggaauauccuuuuuaugauuuccuuuuggucuuucuguuuuaugugaguguauguauauaugcaugccugugauugcaugcguguucauguuuaccaccaaagaguugagaagguuuuuacaguuuuuugacuuuugaaacauuuccaauauugcuuuccagaaggaucauuucaguuucuuuuagcacaagccacaucuagacuaccaauuucaaaucguaccuuguauuacaugguggauuuuuguucguuucaguuucaaguguauuguuugcugauuuauucuuuagcaauaauaaauuucuuaugagcuaaauguaaguuuagcuguugugggcaagucauuagauguugcccauaggcaggggcaaguuaugcacaugugugauaaaggugagggcucagagagaggccaagagcagguucuagugcuuagagcaauugucugggaaggguguggcagcaaguaggacauguaggaaauugauggugagggaugugggcagaugggagugggcauauugaaaacauuugugugggucccguaucuuuaugcucuuaccaguaggcuuccuuaaggaauguggcaucuugccuuguuaaaccagcuucugugcgauuuccauuggaaugggugaggcagcuuaaguacuguuggccuuuuacacuuaacaaaacauggggcccagagagggucaagugcuuuuccaaaguugggaggcuaguaaaagggccaugacacgcucuuaucccccacaccaguauuagagaagucauuaugcauagucagucucauaguuguggaaauauguaaaacuaggucuuugucaacuagauauugccccugagcugauggguauauuuuguacuuucuccauaguuucuuccugugcguuguaaccuggcaaauguucaggcuucugagaagaagguugagcugaugggucauccagauccuggccugaaaguugcaugucugagugcuugaaaauaaaauaaaacucaaucuuaaguuuuuuuucuuuuaagauaauuaaccuuuuuguucccuuauuuuuguauauaugauuaagaguuagaagcagcauguuugggaacauuuucagaaaaauugauacaaaaauguccugaauuagcuguauguauuugguagugaaauagcauaagcauugacuguaaagaugagguugauggacuuugguuugcagugcuuaucaauuuacugcuuguguuugaaagccauuuacucauuggcauuucuucaagggaacauugacuuuagacuucagauuuguguaacuuuuguuauuaaaauccaaugaacaaaauccacugguuuguaaacacgcaguuuuaaaacauccucaucguuuacagguuuuagagcugggaauguaucauuuugguaggaccuacaaggcaguauuuuauagaauuucugcaggcuguguggaagcauuuagcagcuccugaguuggacugacauuuucaugcuuuuguagcauaaggaaagacaugagaggaguguuguaaacugcuucugguaaacaaaaccaaucacacucaagacaccuaaauucaacaaaugagaaauaacuuguauuuacccgccuugagguagacaaagaauaacaaaagaaaagagugcauuaaagggcaugauguagagugaguguaauaauugcuuacugucaggaauguuugaauucauuguaaugaaugugcauuuaaaaagcccauggauuguuuugcuguugacugucuuaucuuuauauuguuuaauucuuuaguucaguauuuaaauuguaccaagaacugguuucucgugguucauggcauuauuuugaaacgaauuauagagucaucaaauugcaguuuccuuuuuccuugaauuucuagugguagcuauuuaccuuaaucuuaaaagaaugguaagaaaaucguagccguuuuuuggugggggugggaguucuuggagaggguauggggagauaagagaaguaauuugugcaaggugcaaagauggauacgaauccugcuucucaaguaguucauagacuuugugggguggagggacaguuggugcagugggcuugacucuuugcagccugcgggagaggcaguaugagcaggccugcauucaaguaagacuuucuggaguggggacgacaucugaacuuggcuuugaugacuaaguuccagugaaaggagagagagugaaaggugggaccagagcuagguaaauugaagggugagaccacaccuaacagugucaguauuuuugcugaaauugcagguuguuugcugagcaggagcauaggagggugaggaaaaacucgaauagcagcugugggauaugggagaggggccugagacagggcugugguccugggucguggaucugacccauggccccacagcagccccaccugcuuuguuccagagucugaauuuugucucuuagccccaggcaaaucuuuuaaggagcagagaaggugccaugguaguuuucauccagcugggauauagcauaggaauuaggggugaggguguuuuuaaaggacuagaucagaauagucauccucgacagaagagggagagggccuggaaauccccuggcuugugucuugaucucucucucucucucuuuuuuuuuuuuuuuuuuuugauaauacuucaaguucuaggauacaugugcaacgugcagguuugauacauagguauacaugugccauguugguuugcugcacccaucaacucaucauucacaguagauauuucuccuaaugcuaucccucccccagccccccaacccccgacaggccccagugugugauguucccugcccuguguccaagugaucucauuguucaauucccaccuaugaguaagaacaugcauuguuugguuuucuguccuugugauaguuugcugguaaugaugguuuauagcuccauccaugucccugcaaaggacaugaacucauccuuuuuuauggcuacauaguauuccaugguguauaugugccacauuuucuuaauccagucuaucauugauggacauuuggguugguuccaagucuuugcuguugugaauagugcagcaguaaacauaugugugcaugugucuuuauaguagcaugauuuauaauccuuuggguauauacccaguaaugagauggcugggucaaaugauaauucuaguucuagauccuugaggaaucaccacacugucuuccacagugguugaacuaauuuacgcucccaccaacaguguaaaagcguuccuauuuuuccacauccucuccagcaucuguuguuuccugacuuuuuaaugaucaccauucuaacuggugugagaugguaucucauugugguuuugauuugcauuuuucugaugaccagugaugaugagcauuuuuucuugugucuguuggcugcauagaugucuucuuuugagaagcgccuguucauauccuuugcccacuuuuugaugggguuguuuguuuuuuccuuguaaauuuguuugaguucuuuguagauucuggauauuagcccuuugucaggucuuagccucucuuucauucuuuuuuuuuuugagauggaguaugcucugucauacaggguggagugcaguggcgcggucucaaccuucacccccggguucaagcaguucuccugccuuagccucccgaguagcugggauuacaggugcaugccaccacaccugucuaauuuuuguauuuuuagcagagaccgugauucgccauguuggccagacugguuucuaacuccuggccucaagugaucugccugucuuggccucccaaagugcugggauuauaggcgugagcugcugugcccggcuggccccucuuuuauucugcugcugcuuucagagcuugauuuccuuagguuauacuaaaaaaucugaacaccauggacaguaaccuauggcaacaguaacacaacuuaagcaaguuauuauuuuuaaaaccaaaaaaccaagacucucaaaggcauggggcgaauccagccuuuggguauauauugaagagcaggguuuggcugucaaguucugccuuuugcugguuuuuguaauaaagcuuucuuggagcccagucuuuuucauuugcauauuauauauuugugcacuaccguggcagaggugcuuuaguugugacagauuauauggccuucaaagccuaauauauuuacuguuucuuugcagaaaauguuugucagccccuuauauggaggauaauuauuuguucuuggggaagacuguacaaauccuuuuugagauagaugggauauaaauaaaauuggaauguucucaggaggaugagauuaauauaauugacuacauugauucauugcaagaaagaaauuggaguguuugguaauuucaggaaccuucuguaguuaaaacaagaucuuagaaauagagccaucuuugguccugaguaaguccuagaugauucuuuggaaacaguacauacacauaaggaacuuaagaucuggauuuuuuuuuguuauguuucacuaagggcuggucugccgaugaaguuuuaauuagccuuuguuaacaagccuuuacauuaaaauacucagccuucuguuagacgcagcacaggaguuucuucgggaaacaaaacaaacacacaaagauaaagauaaaagagggacugagagaaaauaagauuuggcuaaaggaccugcaagucagcagaugucuguagaaaagacagaagguauaacauugcugagauggccaguagccauguacaccugcaucgaccuuugaaggcaaagcuacaucucuuuuuuucugugugugagagcuaagaauagacaucagcauuaccuauguuaguacagugacaaaggaucaucagguuuguguucuguccuauuuugggcugcauuucuagcaauaccuauuguguagcauaaugaugauucuucucgugguaaugcuucauuaaauagagguauaaaaugaaguucuacauguuuugcucaugcuauuaccuucauaaucuauaacccuagauggaccuuccaguguauuguguguauucaagucgucuuugcaagauuuucccuuugcugagcggugacacauagcuccuccucucauccucaucucuauucuccaucgugcuggcuuuccaguuuaaaugccucauagcauaacaugcaggucagucuucaguggccccuuggaaccaauguuuugcaccaaaaggggguagcuuauccucacugucagaguacccauggagcaauuuagccuuuggauucuguaauaaaccuaugggauagcauuucauaaagacugagaauuuccuguguguguaaccaucuuugaugauaguuuucugcaggucacuggaggaagguagccacacuucacugugaggggauggugcccuaccugucaccuucaacuucugcuaucucacacuguuguuggauguuucagaccauuuugcacuugcuuugaaacuuagcuccuucacugaaucacguugcuccuucguugcugcugccuccagaucuccaaagguguccccuacccucuccuguaccagccagauaaucauuggucuccuacccugagaauggcuaugaguccacugcaaaaggaauuucucuaguuuuucaaaaucuugagucacauggugaagcucuucaggagcaacucugcuauguugaagagauugggacaugucaaguuaauaucugaugggccuccuuccuucaguacgcaccaucacuuccaacucuucguaggcuucuguaggucucauaugcucacuuacuuucuccucggguuuuucuacuuuuucaggagacauuuucacucauacugaugggaagaugacagcaguaaugccaauacacuuaaugugggcgcuagaaauaauccuuuugggaaaacaucugagauacaacuuagcugcagacuauauucucugaccuagauuuguauacaacugaaacaguucuguugguggacaccaucauagagagucuuugauuuggacagugaauauuggguaaaaaaauuauuguagcaaauaguuggaaaaugauaacagaggaugaagguuacuuguauuuguuuuugugguauuucuuuucguggcuauuucuucugcaguagacucugaguucauuggugacaggugucauuucucauguauucucuagcuccagucucuagcauagggucugaugagugcauggcauuggaaaaauagcugugaaaaauauugugaucugauaacagacugcagcaagauggucuaguuacagcaagaggcuuggggagggcuucggaugagaagggugaagaggguucaggugagcuuccccagugugcauuuuucugaacucuuuuacuccaagacaguaguucucaaacuuucaucuuaaggcccuguuacaauuguaauaauuauugugaaccucaaauaacuuucauuuaaggagguuauaucuauuguuuuuuauuguauuagaaauuaaggccgggcgugguggcucacgcaagacuccgucucaaaaaaaaaaaaaaauuaagagaauauuuaaaaaauauuuaauucauuaaaacaguccauuauauaucaacauacauuauuuuauacaaggugaccauaggguagagaggagcagacagaaaaagaaaaggugacuguauuuccccaauuaaaaaauuaguaggaagagucacauuauuuuacauuuuucaaaucucuuaugucuagcucaauagaagauuguggccagguacgguggcucacacccauaaucccagcacuuggggaggccgaggcggguggaucaccugaggucaagaguucgagaccagccuggccaacauggugaaaccccaucucuacuaaaaauacaaaaaaauuagccggguguggugacaugcaccuguagucccagcuacccgagaggcagagucaagagaauugcucaaacccaagaggcagagguugcagugagcugagauagugccauugcacuccagccugggcaaccagagugaaacucggucucaaaaaaaaaaaaaaaaaaaaaagauagcuggauuuuuauaucagcuucuacauuuaaucuguuauaaagucauauguccuauagcuucuggaaaacucuauacucaugagagugaaaaaggcaaauacuaauuaauguucugguauaauuuugaaaauaguuuugaugucacagacccucugacaaggucugcgugucuuccugugguccucggaaaacaccuugacaacugcuucgguaagauacauagcaaaagaugacuuaucuauugcacauagaugaugcagagaucuuagggcaagguaacuguguucuaucuuuauuuauuggccuucagguaacugcauuccugauauguuucugaaagaacgaaucaccuucagagacagugauucucaaacuggaagccauggaguucuuugggguacaucauguccuguguuuugucuuauaaaccaggcaaaauuuuacaaguggacagcaugugaacucaugucucugcaucucaaaauauagaaaauauuuuaaauuguaccuccaagauuuuucuucaauauuaauuugcuggccuauugcuuuuguuaucuucagguauuuauuaauggaaaagugauagaaaauuuaaaacaguuugaaaaauauuguggcaaaucuuuuuuuuauuuauuucucugucucucuuaagacaaggucucacuccauugcacagccugcagugcagugucacaaucacagcucacagcagccuccaccucccaggcucaggugauccuuccaccucagccuacugaguagcugggacuacgugugugcgccaccaugcccagcuaauuuuuuguaguuuuuguagagacgggauuucacuauauugcccaggcugaucucaaacuccuggcuucaagugaucuuccugccuccgccucucaaaguuacgggauuacuggcaugagcuacugugccuggccuuguggagaaucuuaauacaaaaaaauauaaauguuuuauauauuucuucuugagcuggggaaaaguuuuuuuuuuuuugcuaugcucguacuagguggaugggugguugguguccuauucuuuccauuuuguuuuuaguuuucuugauaaucuauaaguauaaauuacaccacuuuaagguaaaaguuaccuuuuuguuaauauaaacauuacauaugaaaaauaugggaagguauuacauagagaaaaugaaaaucauucauaauccuggcauucagagaaaacagcugucaaaacuguuuuguauauuuccuuccauuuuuucucuaugaaugcuccauaauugcauauaaaaaaaauuuuugugguacaaugaacauaguuuuaucccccuucuguuugacccauugugaaugcuuucccaugaugauagauguucuucaacaagaugauugaaaauuuaucuuauuuggccgggcgcgguggcuuaugccugugaucccagcacuuugggaggccaagguggguggaucaccugaggucagcaguucaagaccagccuggucaacauugugaaacccugucucuacuaaaaauacaaaaaauuagccaggcaugguggcagggaccuguagugccagcuauuggggaagcugaggcaggagaaucgcuugaaccugggagguagagguugcaaugagcugagaucgcgccacugcacuccagccugggcgacagagugaaacuccaucucaaaaaaaaaaaaaagaaaauguaucuuauuuuuauuguuuuuauuggcaggaugguuuucacagguagaggaaagcagauaaaucuaauaugaaggauguggguggguggaggcgggagaguaugacagcuccugaucuuguguuggucaguguggggcagggcacaguccacaguggguggccagaucgcugcuaaccugagagaguggcaccuugcacagacacccacugccccauuuucugccauucuucugcagcuucuugagauugaagacuuuauuaaacaucacagaauauuugaccuguuuucguuuauaaucaaugucugccauuccuagcugugacuuucaggaaagcucuguguuuuucucagagucuucaucuacaaggggaagaaauugaauuaacugcucucucucguuccuuccagcucagaaauguuuacuuuaugauaagcaauauuuaagaugaacuaaauucaaugauagugaauuuuugucaguuccagauuucucuuguauuagaauuuugucaaaucaagagcuccuuuauaagaaaccuguuggugaggcaugggaaucuuuucacaccaagguguuagacauaguggcauuuaaccuauagacuuuuuuucccucucccucaaugggguagcuuaaauaccuucauccagcagauggugcucuuggacagcaaauuuauuugaggcuguggguuuccaaaugagguaaaacaguuuaaacgguuugagucaccaggagaguuccuuuccauuuuuuauuuuuaucaugucaggauaucauuuacuuugaaauaacaaaucguucaaagccagaacacuaacugccuaaauuucacauccaaggcaaagaugucauccuagacagguuuugacgcagagagagagcuauuggcuuguaggauugugacuuucagguuuuaguucugugaaauaaggcuucuagguaaucacagcucauuuaucugcuagcauguuauggcugcucuuuagugaagcaggucagcuugcaugaccccaaaaguuaucauccagacaggggaggugauggacagcuuuauuggucacauugcauccagaauguuuccguuaguucuagaagcuguguuuucagagggguguugccagagcagcacagcugggauggugcaggaauuguuggaagagcaguuaaagcccaugugguuguugccccugagaauggugcaaguaggaagguuaggugggaucacugugggaaaauucagucugucucuggaauaaguuucuuuuuuuuuuugagacggagccucgcacugucgcccaggcuggagugcaguggcgugaucucagcucacugcaagcuccgccucccagguucaggccauucuccugucucagccucccgaauagcugggacuacaggagcccaccacaacgcccggcuaauuuuuuguauuuuuaguagagacgggguuucaccaugucagacaggcuggucucaaucuccugaccuugugaucugccugccucggccucccaaagugcugggauuacaggugugagccaccgugcccggccaucucuggaauaaguuucuaaggaauacaucugccccagagcagguugggcugccacuugagguaaggaaauacugaccuuggaauguucacguagagaccgucugaucuucugucagacauaguuuaaaaauuugggguggggccaggugcgguggcucacgccuguaaucccaguacuuugggaggcugagguggguggaucaccugagguugggaguucgagaccaaccuggccaaaguggagaaaccucgucucuacuaaaaaauauaaaauuagccgggcguggugacacaugccuguaaucccagcuacucaggaggcugaggcaggagaauuguuugaaccugggagguagagguuggcaugagccgagauggcgccauugcacuccagccugggcaacaagaucgaaacuccgucucaagaaaaaaaaaauuggguuggauaggaugugaguagaauuggccguuucucuuuucacucuucucuuuaccucucaacuguuaaacuucacaguugaaacauacuuaaauguuuaauaaccugguaaauugauaaaucaacaaauauguguggagaaucacucugagugaucgaugauugugagacgugucagcaaugguggguguuggccagugcaaggagcuuacugguuagcuugagagucaugaaugguuucccugagggauaaacaacacacacuauacaggcagaagccugguggauggcaugaauacuacacacaguaggaguguaaagaggugaagauuacugggcacuggcaaaguccacaagacuguacugagaauccagggcauuauggacauuaggcauggugagcaaugugagggaugaggaagcugagccuguuuugugaguucuggaugauuggcaugccuagaggggcagauuucugugggaaaguauuagggacacagcagugagaauucagugagaauuacuaaaggagaaagaacaugaaacucagaggugaaaagugagaguuuuagugcugaauuuggcuggugaacauaaagucauugacaauuucagcuggaaaaaacuuuggagaucaucugguauaauagucaacacauugauagauaaggaagcucagacugaauguuaggguuuauccuagaugacuccuacuuaguggcagagcugggagaccccccuuuccuauucugucucuacucuuucagacagucaccaggaaggaugguuagagcuugaacacuguguauacucuggagcucuucuugucuuggauuggugucuguugaggccucugcuggucagaagggcauuuccccugcaacccagccuugccugcagguuuacagaagggcuuugauaagguauaucuauuggaagcccaguuccugcuuugggccugcuguuuuccauuucacaaaaaggaauauaaagauaaucuagauuucaucuuuauuauaauuuuguaagauauaaaagccuguguuuuuuuucuggggugaauuuauaaauagaguagaaagauucaaguaauucuugucagaaaggaaccauucaucuacaacuucuccuagaaucuguuuuacagaugaucaaaaauauggggcaguguuucuguaccaaaauuuuuuuuaguguuuuccuuauuacagcaaaaaauguaaaacaacuuacauguuacaaaggagaaauacggauacaaauuguuaaagccaugaaguaauauguacaauaaaauguuaagaaaauguuuguaacacagugguaugugaggaaaccaggauaaccguguauagauauaucuccaagauuuuggaaugcccacucuggauuuccaguauugcuuacaaucucccucauaauucauucacuugcccaaggguagagagcagcaggucuggcugagaugagggaggucguggagcugcuucccacaccccagcauccuaguaugguuucuucaaaauaagucaccagcugucagugggcuuuuggggggucacuggugcagaguuagagucaugaaugccaggagucugauucuaaauauaugcuaguuacaacaaguuuuuaagagaaagaugucacuaaaaugauaaaaugguuuucucuucuuugcagauuuauauauuugauauuuuaaaguuuacuuuccaaauguccuauaaugaugaaguauaguuuaauauuuaggagaauuauuguuaguuuuccuuuuccauugaaggaauaaugugccuauguguaugauccagaauuuuauucugugaagaaugaagaaugaaaaugaggccacuggaaguaccuuaggcuguuuuucuuuaugaagaauaaaagggaaacucaguagcaccagcccucugccauguguuaugagaguguguuaaaucugacauugcuuuaagaaauagcagcuguagagaaaaugaagcaagguggaaaaaaccaacaacugggagaaacugaaggaaaaaucacagagugguauagaggaauugggaagaacagguauauucuuuauuuaaacugggauuuuccagguauuagugguuaagaaaaggcucaaguacagcccauacuuugcuaccauucaagaauuaagugguacucacuuuuccuuuuguuagaucacguuagugucauagacucuguuauuuuuuuucuuauuuuaauccacuagucagugggggaagcggggaucuguggauuuuacuaucgaagaaauauaucagucagacaauauucugcugccaguaauaaagaccucagaaucaguggcugaaacaaauugggcauuuaguuuucuuucauguaaaaauuugagguaaguagccuggggccaguguguugguuccaugaugucauuauagacccauacuccucccaauucuucugcuuucuuuaugaugagaucuuuuuuauuuuuauuuauuuuuuuugagacagagccucacucugucggccaggcucacugcaaccuccgucucccuggaucaaguaauucuccugccauagccuucccaguaacugggauuacaggugugugccaccacgcccagcuaauuuuuguauuuuuaguagagaugggguuucaccauguuggccaggcuggucucgaacugcugaccucagguaauccagccaacucggccucuaaagugcugggauuacagguguaagccagcgcacccggccuaugaugagaucuuuacccucauguuuuccugguagaugccugagccuaauaaucaugucugaaugucucauggaaggaagagggaggaagagugaagggcacaaagggcuugugccugcugagguaguccuucaaagcucuauucuggaagcucuacucagugaugaccgcugaccuuucguuggccagaaagaacccuguacugugaccauccuuagcugcaagagaagcuggaaaugcaguuuucauucagcuauauugcucuuucaauuaaaugagguccauuaguaaggaaggugaaacuagauccugaguacuuaggcagucucugccauaaaagcuuauuauaagacaugaugacuuugagaugcuguguuauacuguauuauauacaguuuaaauaguugaauuugucggcugggugcgguggucaugccuguaaucccagcacucugggagucugaggcggguggaucacaaggucaggagaucgagagcauccuggcuaacacggugaaaccccgucucuccuaaaaaaauacaaaaaauuagccgggcgugguggugggagccuguagucccagcuacucgggaggcugaggcaggagaauggugugaacccgggaggcggagcuugcagugagcugagauugcgccacugcacuccagccugggcgacagagugagacuccgucucaaaaaaaaaaaaaguugaauuugucaaggggcuuaauagucuagaaaauaugaauaaaguaguauagauuauucuuuuucuuuuuuuucuuuuuuuuuuuuuuugagguggagucucgcucugucacccaggcuggagugcaguggugcaaucucagcucacugcaagcuccgccuccuggguucacgccauucuccugccucagccucccgaguagcugggacuacaggcgcccgccaccaugcccagcuaauuuuuuguauuuuuaguagagaugggguuucaccauguuagccaggauggucucgaucuccugaccacguaauccacccgccucggccucccaaagugcugggauuauaggcgugagccacugugcccggccuuuuuuuuuuuuuuuuuacggagauggaguuuugcucuuguugcccaagcuagagugcaauggugcaaucucagcucacugcaaccucugccuccugaguucaagggauucuccugccucagacucuguaguagcugggauuauaggcacccaccaccuugccuggcuaauuuuuguauuuuuuuuuuuuuaguagagaugggguuucaccauguuggccaggcuggucuugaacuccugaccuuaggugaucugcuugccucggccucccaaagugcuagcauuauaggugugagccacugugccuggucguaaaguaguauagauuauuguguuuuaaauuuuucauauguaaagguaccuugaugguucugagcaugggauauggcuguuuuaguauauguugagauaauugaucuccuuuaaaggggggcuucauaugguuugggccccuuuaggauuuucuacaagagccaucuguagauauguaaaauaaaauuaauauuucuauuuagccuauuuuuuuuaaaaaacagaaugcauaucugugaguauauccugcacuuccucuaugccaguauuuuuaaaaacaucuucuugacagggagucuuuuaaaaaaaauagaaaauguaguuaccaaaguacugacuuuccuagauauugggagauagagggaaguuucucccucccugaugauauaaaaaguguguagucagaguugacuuacugguuuaucguuuggccacguggcuucagaaacaauagagccagcauggguuagaauuuucauucucacccuugaaccccggcccugugauuaugaacugugaggucuuggcaaguuaucugucuuugcugcaguccccucauuuauaaaacaguguugauaauaguugaugguaguguuuagcuggcaggacaaaaugaggugacauaaauaaaacaccucguacagggccugcucccugguauguacugaaucaguguuagcugcugcagguggcaguacuaaagcaaagcaagacagaagucuccaggccuuaacgagauaguuauucacuagcugauucugaccaagagaauugugaagaguucuguucugcgguugccauuuuaaguuuguccaauccgcagcccagugauuuauacuuuuugacaucugucagagccgugaagaauguuuguuuaggagucacugcuuaagaaaaugccucugucguuuuugagaaauauaccacuaucuucuugucaguaagauccugccguguguggugccaggacagaaguggccucaugggauaugacucaagagauagucuuuuuuuuuuuuuuuaagauagucuugcucugucaccuaggcuggggugcagugaugcaaucuuggcucacugcaaccuccgucuucuggguucaagcgguucuggugccccagucucccaaaaagcugggacuacaggcgugcgccaccaugcccaguuaauuguauuuuuaguagaggcaggguuuugccauguugcccaggcugauuucggaacuccugagcucaagcaaucugcucgccuuggccucccaaagugcugagauuacagcaugagccaccccaucuggccgauagucucuuugucaugauuuuaaaaaucaucuuguuggccaagaccacguccgccccgugagcacagacccuggcccucacugcucugcugccuguccacacccgcuaccagcucaccauagaugaugauauugcuacgcccgucgucgacaacggcuccggcauguggaaggcuggcuucgcaggugacgaugacccccggccgucuuccccuucaucguguggcaccccaagcaccagggcaugauggugggcaugggucggaaggacucccaugugggcgacgaggccuagagcaagagaggcauccugacccugaagugccucaucgagcauggcaucauuaccaacugggacaacauggagaagaucuggcaccacaccuucuaaagggagcugcaugugguucccgaggagcaucccaugcugcugaccgaggccccccugaaccccaaggccagccgcgagaagaugacccagaucauguuugagaccuucaucaccccagccauguacauggccauccagcccgugcugucccuguacuucuuuggcuguaccacugguaccgugauggacuccggugacggggucacccacagugugcccaucugcgagggauaugcccucccccacaccauccugcaucuggaccuggcuggccgggaccugacuaccucaugaagauccuuaccgagcguggcuacagcuucaccaccacggcugagugggauaucgugcgugacaucaaggagaagcugugcuauguugcucuggccuucgagcaggagauggccauggcggcuuccagcuccucccuggagaagagcuaugagcugacugacggccaggucaucaccaucggcaacgagcaguucugcugcccugaggcacucuuccagcuuuccuuccugggcauggaauccuguggcauccaugaaacuaccuugaacuccauuaugaagugugauguggacauccacaaagaccuuuacgccaacacauugcugucuggcggcaccaccauguacccuagcguugccaacaggaugcagaaggagaucaccgcccuggcgcccagcacgaugaagaucaagaucauugcuccuccugagcucaagcacucuguguggauuggcggcuccauccuggccucgcuguccaccuuccagcagauguggaucagcaagcaggaguaugaugaguccggcuccaucauccauccuucaaaugcuucuaggcggacugugacuuaguuguguuacacccuuucuugacaaaaccugacuugugcagaaaacaagaugagauuggcauggcuuuauuuuuuguuuuguuuuguuuuuguuuuuguuuuuguuuuggcuugacucaggauuuaaaaacuggaacggugaaggugacagcagucgguuggagugaacaucccccaaauuucugcaguguggcugaggacucuauuucuuguuuguacauuguucuuuuuuuuaauagucauuccaaauaucgugagaugcauuguuacaggaaguuguuugcccuccuaaaagccacccgacuugugucuaaggagaauggccuaguccuccuccgaguccacauaggggagguuucuuguaaauuagguaaugcaaauuuuuuuaaauuuuugccuuaauacuuuuuaaguuuguuuuauuuugaaugaucagccuucguggccccccucuuuugucccccagcuugagauguaugaaggcuuuuggucucccugggaguggguacaggcagccagggcuuaccuguacacugacuugagaccaguugaauaaaagugcacaacuuaaaaaaaucacugggugugguggcucacgccuguaaucccaacacuuugggaggcugaggcgggcggaucaccugaggucaggaguucaagaccagccuggccaacacggugaaagcucaucucuacaaaaaaaugggaggcggagguugcggugcgccaagaucaugccauugcacuccagccugggggacagagcaagacucugucucaaaaaaauaaauaaauaaaucagcuuguugaaaucuuaauauuugauuuauauauguacaauauauuuaaguuuuaaagcauaaugauuuugaauaucccaaacucaccaugcagucaacaacuacaacauuaacagcacugcucagggaccaaccacucuuuuuuaguccuuuccugcuaugccacccccaucacucugggguggccugaauuuuguguuugauuucuugccuuguaaaaaauaguuuucucaugcaugcacguauuuuaacacaauauguuuaguuuggcuuauuuuugaccuuauuaaaaauaguaucacuuuguguaguuuucugggucuuugauauuuuucaccuaacaguauuucccaguugauccauauuauuuuguaagcuauuguaauguucauucauuuucuuugcuguauaauauucuacuuugugaauuuacaacuuuuuuuuuauucugcugccagugaacauuuucuuucuuuuuuuuuaaaaauaaauauuguugcugugaacacaucccauacaugguaccugauguacauguguaaaaguuucucaaagguauuuacguaggaauggaaaugcuggcucauagaguauuuaacuuuaccagauacuguugaauugcuuuucuaagaguuuguaucacuuuauauuccuuuagcacuguauaucauuuuuguuuuuuuaagacagggucuugcccugucaaccaggcuggagugcagugguacgaucuuggcugacuguaaccucagauucuugggcucaagugaucgucccaccucagccuccugaguagcagggaccacaagcuugcaccaucauacccaacuaauuuuuguauuuuuugucgagaugggguuucgccauggugcccaggcuuaucccaaacuccuggacucaagugaucgccugccucagccuuccaaaguauuacgauuacaggcgugugcuacucugcccagcuuauaaucauuauuaagacagcuuuauugagcuauaauuuauacaauacaaaauucacccauuuuaaguguauacuucagugauuuucgugcagccaucaccagucuagucgcagaacauuuccaucagcuuuaaaagcuucuucaugcugauccagucuucacgcuuaauaucuuacuacuugaugucauucuugugccuguaaaauauguuaugugaauuugcaccucucugauuaaaaauggcuuagaauaucuuuucaugucuuuaucggccauucauauuccugucuuuaugaacuguccucuauuuuucuauuagaucuuuuggcuuuuucuuuauuuggaauucuuuauucuggauaccaaaacuaucccaguuauauuuguugaauuauuugcucuaguuguggcuauucuuuucacuauuuuguuugucuuauuuacaaugucuuuuaaugaacaaaugucuuaauuuuaauuuuaauagauuuuuacuauuuuauuuaguuuuuuuguauuucucauuguuccuggacugauuagauucugucuuauaauguugcauauucuauccucaguauugcuuaacuuaccuuucagacuuucaaucucauuguauuucuguacuguacuauguuaauguccuaaauauuauauucugguuaacuacuuuuuuugcuuguuaauacugguuaacuguuucucuuauuuaacucuuucacugaguuuuuaguuuaauaaugauauauuucuuuucuaggaguucaccucuccuucagguuggacuggacauuccaaauauuuuauuuuucuuugcuugucuuagcaauuccgucuuuuauuucuuuaaacauuucuuauuccuugacgacagaauaagacaacucaauauuagugguccugcuugaggggcuggucugaacaauuuguucauuauuugcgcuaucucucugcaguguuggcuuucuucccgguaugcacagugaucuuugcuuguaugcguagacuugauguuaauuuguggaauaauucuggaucuaaauguaugauucuuuucucccaagaggauuggaguuauuucugccuggaaccaggaaacuccauuaacuucacacuaucaguagucuagacucaaggugggagucucaagcucacugcagucuuuuauuugacuggacguuuuccccauuuuuucucuguccuuuuuguacucauauuugccuuuaucuuuuuauguggcacuuucacugcagaauuauuuuucuuucaaaacuugcuauaugaugguuguuguugagaauucuaaaacagaaagcagugcuguaaaaucguagguauuugguguauaaaaaugcaaaagggaaaauaguuuuguuuuaaaauaaagauuuaaggaguacauuuuuagaaagaagcagcaaaaaagcuaucaugucaaacauuaugauuaacuauaagcaaaauguacugcauacggaucuauucucauuguguaaagauccagggaaauccucagucuauauuaaaguguagaccagaacuuucaauuuaguuauuagaaggcacuguuuucuuuuauggagaaaagacuauacacuauggugugaaauggauugaauuuugaaaucuuuaaagaacuaaccaaauuuuauguuauuuuuucuccaugcguguuaccuuugaaacuucaagggcuuguuccagcuguaugaauuuguggcaguauuuuacauuagccuagcuuuaaguugccagcacaguaguggaguuugguggauggucuuuucuuuaaagacaaagucuucuaaugugggcuuggauaagaguccuaaaacgggaugauacaagucaaaugaggaaaggcauaaauuugucuguuguuuucccuuugacacagggucucacucgguuacccaggcuagagugcaguagcgccaucauugcucccugcagccgugaccuccugggcucaaaccauucccccacgucaacuuuccuaguagcugggacuacaggcgcuugccaccacaccuggccaguuuuuuuuuuuuuuuuuuuuucugguagagauagggucccacuguguuacccaggcugguuuuaaagucucagacucaagcaauccucccgccucggccucccaaaaugcugggauuacaggugugagccaccacgccuggccaaauuugucuuuuuaaaauucuuaaaaaugaguguuuuuuacuuaaaauuuuaaaguguuuuuacacuuaaaaauuaagacauguggcugggcaugguggcucgugccuauaaucucagcacuuuuggaggccgaggcaggaggaucacuugaggucaggagaccagccuggccaacauggugaaacccugucucuacuaaaacaaauaaaaauuagcugggugugguggcaugugccuguaaucccagcuacucaggagacugaggucaggagaaucgcuugaaccugggagguggagguugcagugagcagagaucgcgucacugcacugcagccugggugacagagugagacuccaucucaaaaaaauaaaaagcuucacauuaauggguuaaugagaaacaccaugucacaaugcugaaauauaaaaaugagaccaauuccaguauuuaugaggggauuguuuacaaagagcuaugauauacuggacagaugauacauuugcuguugaggagacuaacuguucuguuauaauuuccucuuuuuuuuuggagacaggucucacucugucacccaggcuggagugcagugccacaaucauggcucacugcagccuugaccucccaggcuaaggugcucuuucuaccucagccuccugaguagcuagggcuacaggcgggugccaccaugcccagcuaauuauuguguauuuuauagaaaugggguuuugcuauguuguccuggcuagucuugaacuccugggcucaagcuaucugccugccuuggccuccugaaaugcuaggauuacaggcacgagccacugaaccuggccuuuguucuaauuuucucuuuuucuuuuuuuugucuuuuuuuugagacagagucucacucugucgcccaggcuggagugcaguggugggaucuuggcucacuguaaccucugccucccagguuccagugauucuccugccucagccucccgaguagcugggacuacaggcgucugccaccacgccuggcuaauuuuuguauuuuuaguagaggcgggguuucaccauauuggccaggcuggucucaaacuucugaccuugugauccgcccccacuucggccucccaaagcauugggauuacaggcaugagccaccgcauccagcccucuguucuaauuuucaaauaaggaguccuguaaguuacugacugggcaccuuccuuucaucuguaaaaugaaaugauguuuugcuuuuguuuuccuagcauggggguuaucccaccucuuguuucuuuccaauucuaugugagaugguggugcaugccauguuguuagguagaagacauguccccagcucuacaguuagcaagcuuugagagaggcaauuuaaaugggugcuagcuaugucagcccuuggaaagaccaagagcacaucuaaauguaacuuggugauggcauuuuugugguggaagaaagacuguaguccugcccaucuguauauucuuuuugaugacuucguuaaguuacgggguagaccuggaaacuugagaaucuuuaacagguucuuucaguauuuucucagauucuuacagaaucuagguggcagaucuuuuuuuaauaauuggauuuucuaaugaagugguaguucccccugugaauucuugaauuucaaaaauuuuuauuggucauuauuggcccaguuuggaguuggcucuguggcacugaaacucaggagaaagaugggggcucauagcuuuguuuggaaaucagccacaugaggauaauauugaaggugcugagggugacagcaggaaaugggaaggauguuguugaggauggaauauagagugauaacugugaagauauggaaagacuuagcgagagagugacagguuagugguuuugaccuaauuuuggggaacaagguucauauagacuuuuccucuucuauuauauggaaaguaccauaaaaauaugauuaguaauaaucguguguaucaguuuaucaauuuuucuguagccaacucugcuuuuauguacaacaaaugagaaagcagccccuaaaauaugccagagugaagaacaucuucacguuuuguguguucaguuggaaguguuucaguaaucauccagggcugcuuccacagucuccguguugauauuguagcaguuucucagguuugugggcaagugacuauagcuauuccacuugguggacaaagcagaaugcaugaucaggccgucuuuggugcaguucacagaaucaucaccugugccuggcaaauggcuaaguucuagcagaccuucccugccauucugcugccucacagagacuucucuuaagaaguuacacaguuuuguucagggcugugcuagauccuacuuauccuggagcugguuaucaguuuucuuaauugcucaggcuuuguguuuugccauuuuacuuuguuuuucuuuggccauuugcauauugaucauggaacagagagauaaaacaugcucauagaguggauuccuguuagguuccuaccacuuguauagucucacuccaguuacuggacacauuuauggaguaacugauagagcuauuuaguguuggacaaauauaugauucauuuuaaagcaguaagcucacaaccacuaacuucauauuuauagccugucuccaaaacuccuccuuccuuuauucuuuuaaaauuacuguaauaaguauggacucuuuaaugccugcuacauuuuuugcagauuuggccacagauuuauuuucuuuuauccacauuucuuuuuuuuuuuuuuuuuuuuuugagacggagucuugcucugucaccuaggcuggaaugcaguggcaugcgaucauggcucacugcaaccucggcucacugcaaccuccgccuccuggguucacgugauucucuugucucagucucuugaguagcugggauuacaggcccacaccaccacgccuggcuaauuuuuuuuuguauuuuuaguagagauggaguuucaccauguugaccaggguagucuagaacugaccccaggugauccgucugccuugggcucccaaagugcugggauuacggacgugagcuacugcaccaggacugauccacauguuuuuaaaaguugguuaaugucacauaaaauugggauuuguggcuuaaaaaaaaucagaaaaucuggcagcauucccagugacugaguaauggcugucuccuuuagacaggauaguagguugucuccaaauacacaucacccccaauacccacguuuuuugacauauaccuggcugccuucacuaauugcuguuaccugccuggcucuuugggcaccugaguuuguaaguccugcuuuauuacucagcucuccacuuccugcuguguucuuguacucuuuguuuuuuguuuucuuuuuucugagacagagucucgcucuguugcccgggcuggaguauaguggugcagucuuggcuuacuguaacuuccaccgccaggguucaagugauucucgugccucagccucccgaguagcugggauuauaggcaugugccaccaugccuggcuaauuuuuauauuuuuauagagaugggguuucaccauauuggccaggcuggccuugaacuccugaccucaggugauccucccaucucugccucccaaagugcugggauuacaggcaugagccacugugcccggccugcugccaugcuguuuggaacaggaugcugacagcccucuuugaaguggaaugggcugugaauccgucgaggugccccucuaaaaagcuguggucugaacccucuccccaucuuugaaaaugaaaaauuuaagcaauuuuucaaaauauuuucacuuguguuuuguaauccuuucuuuacaacuguccuauaagguaggcauguguggauuuauguacuauugggaagccuuagggcuuucuccacuucugcuaggaauaauguauuuucuugaaaacaguuucagugaaagacuggacuuuuccugugguccuuucaagguagccacagucuucuuguggcccaauuugcagcacugaacccugggcguagcucugccaugaaaggcgauugagaaaccaucagauccuauaauuggugagugguggagccagcauuugguuggagaacuuuugauuccagugcagcauggugcuauucugauacucgguuacucuuucagauugaaauucuucauuccauuuuacuguuugcugggugagugcagcagugacacaguuuucaaaaguuuacuaauaaucuauuuuuugucuaaaaaaaucuuuuuuguaauauuugauggacaugccaucuuuuucuuuuugagacaucucacucuguugccuaggcuggagugcaguggcacaaucaugacucacugcaaccucaacucccuccucagccgccuccugaguagcugggaccuguggcaugugucaccauacccggcuauuuuuuaaaauuuuugguagagaugaggucucucucuuuauugcccaggaucgucucaaacuccugggcucaaguguucauccugccucagccuccuaaagugcugguauuacaggcauaaaccaucauuuuuacguacuuuuaaaaaagcuuuuucucuguuuuucaguacauuuuauaguuuuauaacguuggauugagucuucucuuuuccuaguuuuaauccuuuggacuaucuucauuuacaaauaucuuuuguuuuaaguuuuucuaauuuacacuauuuuauuuuuagugacauaaucaaauuaaauauguguauuuugacaauaaaugugaccauucucuagccaccccuucacacaccccggguucugaagugcaucucugauguggucacaguaauuuuuuguuuuacugacuuaaacauuugcacuacaguguuuagggaaccgccuaucauaaggcuuccuuuaauauguugucccacacagcacuguuuuacaugauguaaauguguuauacaaacaagcuuccguggucaaaugauuuuugggaaaugcagaguuaaacgaaguuacacagguuuccuuaugagugcuuuugggggugccugucagcacugugacugucuuaagagcuagaguuaaagaggacaaaguuuuucgaccuuggcaucugauaggacugauauuucuuuuuuuuugagauggagucucgcuuuguugcccaggcugaagugcaguggcaugaucucugcucaccacaaccucugccucccggguucaagugauucuccuaccucagccuccugaauagcugggauuacaggugugugccaccacacccggcuaauuuuuguauuuuuaguagagaugggguuucaccauguuggucagccuggucuugaacuccugaccucaggugauccgccugccucggccucccaaagugcugggauuacaggcgugugccacugcgcccagccuaggacccauauuucuaauguugcauuggaaauauuuugggaaaaauugagcuacuaugauuuucacauuauuucuuucuguagguggaaauggcucauuauuucucaagguuucuaacauggcauguugcuguguuguucccuucaguuuugcagagacugagugcaguuacuguggagagaguccaggauggccuaguugagacauugaagauuuaggaaugcauugauugauugacugauugagacagggucuugcucugucaugcaggcaggagugcaguggcgcaaucacuggcucacucuagccuugaccuucugggcucaauugauccucccaucucagccuuccauguagcagggauuacaggcgugaggcaccacaccuggcuaauuuuaaaauuuuuuguagagacggggucucacuguguugcccagggugaucuugaacuccuggccucaagugauucuccuuccuuggccucugaaaguauugggauuacaggcaugagccacugugccuggccuacgagugcuuuuaaacugcugucugauuccugauaggaggaagauacuaucacugauugaaagggaauaucccuaauaaaguucucaguuacaccugugugcaaaaaucgugguccaauugugaguuguuucagaaaacagaugcaggauacguaaaggaauggggcaggacaggcuccaacuggguaauuggcaugaaaggagaaaggggccggggcacguagacucccaggcuuaggacuccaguuaguccauuggaagucaggugaguuaugaauauugcucaugugccugcugaacaugugugggagaguuuuguucgagggagacagaauccaggaggagacuuuugucugugaacuugggcuggugugcagccuuucugcugaaaccugauggaauuaaguuuuaaacaguucggcagauucuaacuugucauuguggggcuuguguguagcugggguuuggagacugcuuuuacacuaaaucauuccugucaccugcucucaagugaagcagucugcaguguaagccuugcugguauuuguguagaguggcacugccucuggugggaagaaugcagcagcuucacguguuugcugcuccugaaccucagaucuuuguugacaaugaugcugagagaagaggaugauauguuguguuuugaaaggaucaggacuagaagcauaaaccuuuaaaagggaagguccaggagucagauagauuuagguuaaucauuaccaucuacuucuagcuaggaguguuaauuuuuucauuuguucauuugggaauaacauuaccuauuuuauaggauuguuuagaauaaauguaagauacaaguguguauaguguaaugagguaguauauuguauaacacuucacuuuaaugauaacuaggugcauuuuuggucuaaguauaugagacagaccugguacuguucagaagagccuuuguggagccuguuuuuggagucagauagcuaguuuaauaguagagaacaaaaauuggagaaagaauuuugaaacaauaagauuuaucucuguugguuauucuuaauauuugcacaacugcuuaauugaaauuauaugacuuuuuauuuuagcaaaauaaauuacuuuuuagcaaccuugccuugcugagaagaaacugcugcaaauauguuauuugcccauuaacggggagaaauucaguagugaauuuaaacacauuuuauuaaauaaucacuucucacaugcuugacuuguuuuuugggaggcuuuccaguaagauuugcuagagaauaguggugauauuuauuauaucaguucuaauaauuaaauuuuauuuuauuaaaguuuauuuucauuagcuuauuuagugcuccgagcaacucuaggaggguacaagaacccuuguguuuccaugaagaaagacuugacgcucagaaaagcuccgugauuuuccccucagugaccugcagagcugggguuauaaucuaggucuuuuuguccagcacuauuugaucucuacccucuuccccucauaccaugggucuaggaugucaagggauucaacccugguuauuuuuaaaagauagugucagucagaaauaaaacuuagaugucuccauauguaggaauuuuagagaaauaguuugugucuaaauuugcaagcucauucaguuuaaaaaugguuccuauaauauggugcucauuuauuacuucagauucauugcuucacuaaugacuuuuaaauaggacucuauuauuagagugauuggacugaagucugauuggacuagaguuaagagauugcaucgcuauaaauagaaugagauaaaauauuuuacauaaugugauugaacuucuaugaggucugaaaaguuggaaccuaggaucuucucuuuuuuuguuuuuuuuuugagacggagucuugcucugucgcccaggcuggagugcaguggcacgaucucggcucacugcaaacaccucccggggccguucuccugccucagccucccgaguggcugggacuacagacgcccgccaccaggccuggcuaauuuuuuguauuuuuaguagagacaggguuucaccguguuagccaggauggucucgaucuccugaccucaugauccacccgccucggccucccaaagugcugggauuacaggcgugagucuccgcgcccggccggaucuucucuaaacggauacuuugaccaguuuccaaauaacaagcuucucagcguguggccuaaguuguagauagaguggcuacuuaagagaauuugggaauuaaauuauguccuuuggcauguucaguuauguuaccugagucagaguuucauuagcugcuucaucaauaguuuuuuaaccccaaagcuuuagacaguaagauuaacacacugauuagaaaaucauuuaaagaccaaaaugaaaacagaacaacucuaaaagcuuuuaguguguucaggaaauguuagaagugguuguaugugaagccauugguauaguuauuggagaggacaauuuugguagacauagaugaauuuaauacccucaauuuuuuauuuuuaaaauagacauggggucuugccauguuucccaggcuggucuugagcuccugggcucaagugaucugcuuuccucagccucccaaagugcugggauuacaggcgugagccacugcaccuggccaaugcgcuucucuaauagugcauuagcacgaaaagguuggaauggcuuuaaaggcauuucaguuuccccaugauuacacaggaacaugccuagucucugauauuuagaauuugauaaaaauauaugguaaaaaugcauaguuuguaaaaauuucuaagcaguugugaacuguagucaauucaugagugauuggccgggugugguggcucacgcuuguaaucucagcacuuugggaggccgaggugggcaggucacuugaggccaggaguucgagaccagccuaggcaacauggcgaaacuccugucucuacucaaaauacgaaacauuaggugggugcgguggccuacgccuguagguccagcuguguggaaggcugaggcauaagaauugcucgaaccugggagguagagguugcggugagcugagauugcaccacugcacuccagccugggcgacagagugagacugucucaggggaaaaaaaaaaaaugauuguuaaguucuaaucaaaccagaaucuuuuccuaucaccuuaacucuuauaguagugacucuaaccuucccucgcucugccaucaccauccauauuguuauacuguuauaaaacuacauuauuccagcaguuuuaccaaaguugggauaaguauuuuuaauaggcauuauguguuuaaauuuuuccauuaacauaagagguaaauauuuauuugaagcaucaguagaagcacagugaucaguggauacugccaagaguuuuuccaauaauuagaguggaacuuuaaggaaacaauguauuacaugcuaagauugaauggauagggaugggagagagauagcagaagauauauuuugcuguugguuucuugaugugauaugugauggugaauauuaccucuaaacuaaugugcaaaaaaaucccaagaaaacccaaaucucaaaaccccaaaaacaaaaaggugugccaaggagggagagcacaugccggaucaucuacuuugaaucaguaauuuuuugcugacagccaaguugggagugggucuguaacuuucauuuccauuuggcaucaggaagcuauuugguauaaauuucuaccagauaguuguauggaaccacauuaugcugguaguaaucuuugaccaauaauaauggacauauguauguggcucuugaauaagaguuguuuuauuuuucaguuuucaguuaguuagaauauacaauguaauaauuuugguggauagugguuugauuaguaaaugcuaucuuucaugguuuaguaagauuugauuucucucucuuuuuuucucucucauuccaggguguggaugaauggaacauagcucgccucaauacagucuuggaugugguugaagaagaguguggcauuucuauugaggguguaaauaccccauaucucuauuuuggcauguggaagaccacguuugcauggcacaccgaagacauggaccucuauagcauuaauuaucuccacuuuggagagcccaagucuuggcaaguuacuuguuuaauauucauuuacuuuggaguuuugaaauuugggcaucaggcacauauugaagaggauuuuguucuuugauuugguggauucagauuuaugugagcuguaaggaaguuuuugacuguaauaguuaauugucuucuauucugucugggauugugcuuggaaaccauaaaccccaugguaacucguacagucaugcacuguauaacaauguuuagaucaaugauggaccacagauacaacggucauccugaguuuauaaugcaauugaaaaauucuuuuuccauguuuagauauguuuagcuaaaugaauacuuuguagcuaaauacuuuguguuaaaauugccuacaauauuuaguucaguacagguuuguagccuagaagcaauaagcuaugccauauagccuaggucuguaguagauccacuaucuagauuuguguaaguccacuccaugauguucacacaauggcgaaauugccuaacaacauauuucucagaaacuaucacuguuauuaagugaugcaugacuguauauguaaaguugccuguaguccauuuugugaaccaugaauugauaaauauuuuaggcuucaagaauuuauugggcaucuuuacuuugagcauuuguuggaugguauguaggagguaguuaggagugaagagcugacuuccuggguguaguuucaaaccaucuucaugaucuucugguucauccuccucuaauuauuuuuauuuuauuuuauuuuuuuuugagaugaagucuugcucugucgcccaagcuggagugcaguggcgcgaucuuggcucacugcaaccuccgcuuccuggguucaagcaauucugcugccuuagccacccaaguaucugggauuagaggcccagcuaauuuuuuguauuuuaguagagacaggguuucaccauguugcccaggcuggucuugaacuccugagcucaggcagucugcccaccuuggccucucaaagugguaggauuacaggcaugagccaccacacccagccaauguauuuuuuauuuuuuauuucuauuuauuuauuuuuucgagacagggucucacucuguugcccaggcuggagugcaguggugcgaucucggcucacugcaaccuccaccuccuagguucaagcgauucuccugccucagccucccgaguagcugggaugacaggcgugugccaccacgccuggcuaauuuuuguauuuuuaguagagaugggguuucaccauguuggccaggcuggucucgaacucuugaccucaggugagccacccuccuuggccucccaaagugcugaaauuacaggcgugagccaccacgccuggccaaaugaaacuuuuuaauagguggucuaggacucauacaggcuccagugacaagagaaugugaucggauuauucauuacucagauguuuauuuguuauuacuuuuuguagagauggagucuuaguguguuguccaggccggugcugaccuccugggcucaagugauccugcugccucaaccucccaaagugcugggauuacaggugugagccacugcacccagcacucagguguuauuugugggccugguuugagcacaugcuuaaggacagggaucucuguuguguuuguacagcauuacuguaaaguuuguuggaaugucaucuuuuaguuuuuucagaacuuagcuuggagagacuaggagaaauauuuucaacaaugguuaggcuccuggacaguuucucagcugcuuuguuaucuugaugcucuuucugacauucacuuaaaguguggauaaaauugaaugaaaugggugaauucaacauguuaauaaaaucuaguauguaggcaacuacauacuaugucuugcuuaagaaaucugaaaaguuaguagcaaaacuuuucuggggauuuguuaaggaauuaauaaaugaggaugccugggacguuaauuugaguuuucaguauuaggaaaguuuaaaugaagugucugcuuucuaauuaagaaagauggcugucuugucuucuccugggaacagguugauguugucuccuaaugaucacuucaggaagaauauucuggucagggcuaagauggauucuggugucuugugucuuugggaaagagcaucacuaaucaugagugagaauaauuaugcccauuuucaaaguauuucuuucuugcagcuuguauaugugcaguaguuaauuacucuauuaguuauuaaguauacagccuccaucagacgcauuaagaguagauuuauacugucacuauuauccuuaaccuuggccauuguuuauaaugauaaaauaauaaaauguaguagugaguuguaacacugauucuacauacuauuuccuaagauaacuacuguaggaagagaguguuauaaaugccccuacagauauuuucuaguagauguaugaaauauuacauuuccucagcauaaauaauuuugagguaaacuuugucauuauuaaaauucauuuuagcaauccuuauaauauauuugaggugagcuuugaaagauguuagaagcaacacaaauucauggaaguauuuggaggcaggcgguuuggcagagcuuaggacacgagggcccaguaaucagggcuguagucuuuauuaugcacuagugcauguggcuuugggcaaauaacucugcuugucuggacuccaguuccuucacucccccaagucacaagguuagccagaaugaccuccagucauucugauucugugacucaugaucagagucacaggaauauuuuuauugaguugacaaaacgagaggaugaagggcugcaagguucuguaugcacaugugggugcgugugcaccagcguccucuucugccuguccucuccuuguugagcuguaucuccccuucaguaugggaugguugccuuuacuuuucucuaguggguggccucuccugugcuugacauaucugucacuauauuguuuucucuucugucucugaccuuauagguuggcauuucaagucuacuccuuccucuugaauucuaccuccagguaccaggcucuggaugggauuauugcaaagacugccuacgauucccuccuuacuuacgggcccaugcugcucucaucuguccauguuucacuuaggguuugcuuaaagacucucuggacuaugugcugccccuacuuuagacauuguuuuggcaucuuacaacugguuguggccaccccuccugccaucucccucauuuucccaccuccuuucuccccgaccauccuccagcuugccugugugugccuugaaguuaagguccaugguuuuguuuuuuuuguguguguuuuuuuuucaccuuugaaucaucagcacuuaacacacagggccuggcuauaggagcgaugcccuguaaagaauuguuguauugaauuagaagaguguuaaauuauuuuagauccaucucuuuaagggcaggcauggaaacuuuuaauaaaaaagauucuuuucuagcccaggugcgguugcucaugccuauaaucccagcacuuugggaggccaagguaggcggaucacuugagcccaggaguucaagaccagccugggcaacauggcaaaacuguuucuacaaaaaaaaaaaauaagaaaauuagccggucauaguggcucacgccuguagccccagcugaucggaaggcugaggugagaggaugaccugagcccggggaggucaaggcugcagugauccgagguggugccacugcauuccagccuggacaacggagggagacacugucucaaagaauaaaaaaauaaauaaaaauaaaagccuaaaagguaacuauuaagaauacuaaguuuccugaguugcuauacauaggagacauacauuucuagcuaccguguguggcagguuugcggaguaaguguucaugaacacagguuuguacugaagagacuucaaagcagcugaugauuuauuugaacauuucugguugaagguuuagggggaaaaguauccuuagaguaagcagauagaaaacugcuuugacagucagugguaaaguauuauuuucuuggaaugaauauugacuuuggagccagaaguccuguuuuaaaaccccaaucugucacuuacugggaaugacuuagggcaaaucacuacacuccuuucaucaugaguuucuuucacugccaaauggaggcaugauuuauucucugucuacuuaagggauaucuaggaggguccagguauauacuguguauaaaugcuuuguaaacuguaaaguauuauacaaauacucauaauuacuauuauuuuaauaaccaugaaaauaauuuuuuuuuagucauaguaguuacuuaaagucugaacuuggccauaauguauguauuuauaauagaauaggaguuucagugauuaaaaaaaaaugugauucucccuuccaagccucuugugugagugcuuaacugcuagaggauauagaauucagaugguaucuugagucuuucuuucccagacuggguacaaacaaaaugaauaagaaacuuucgacugggugcgguggcucacgccuguaaucccagcacuuugggaggccgaggcgggcggaucaccugaggucaggagcucgagaccagccucaacaugaagaaaccccgucucuacuaaaaauacaaaauuagccggguguggugguacaugccuguaaucccagcuacucgggagacugaggaaggagaauugcuugaaucugggaggcggagguugaggugagcugagaucgcgccauugcacuccagccugggcaacaagagcgaaacuccgucucaaaaaaaaaaaaaaaaaaaacaaaaaaaaaacuaacuuucaaauuuacucuguagagaacaagggagauaagguguaagaggauguguuuuaagcugugaaaaggucuaaaaucaggaaagguuuuccugaagguuuuuagaaaauuaagaauggguuguagcauuuuggacauuguuaaauuucauucaguaaacugagauuuuguuaaaauacuguguagcaguuaagaaguauccaauuauucaggauagauacacauuaguucaaugcuuucucauuagaacuuuugaucaguguuguguaguacuuaccagcacagguuuuugugucagucuugaguuuugcaaaacucuuuacucuuuacugagcaugugaccuugggcaauuauuaaauaaccuccaugccucaauuuucucuccuaaaauacucagaugguuuuggcacccaccuuguaaggcaauuguguggauuaaauaacaugcuauguacaaaguacauaucacagcuggagauguaacacagugcucaauagauguuaacguuucauacauucauuuagcaaauauauguuguauguauacauggcaugaaguguuuuaaacaugaacuucauaaauuuguauuaauaaguguucuugguuauaaaugacagccaggcgcugaggcucaugccuguaaucccagcacuuugggaggcugaggcgggcagaucacgaggucaggaguucgagacuagccuggccaacauagugaaaccgcaucuguacuaaaaauacaaaaauuagcugggcaugguggugcaugacuguagucccagcuacucgggaggcugaggcaggagaaucacuugaacccaggaggcagagguuguggugagccgagauugcgucacugcacuccagccuggggaacacagugagacuccgucucaaaaaaaaaaaaaaaaaaaaaaaaaaaggaacccaauuuaaguauaacggauuuuucccaguguuuguaguugggauaaaccagaggcauggcucagucuaggaaaucagaugcucccauuggaugucugucucagccuuucccuuuauuucucccucccuccacucucuucuauucaccuuaccccuaucucuuccuguccuuucuccucuccauuccuucuuucucccuuuggucuagaagagagaagcugcuuacuuacaacuaauuacuugauuauuguugaauuauauaauucaagucuuacuuuuuaaaagaaugagcaaguuauauggugccaaauugaucuaagcuuguuuaauguacaucuccauuaaaaugugagcucugggaguuggggagccccacuauucauucauucauucguucauucauuuauuaugugguuuaaauuuucuuuuuuauagagauggggucucgcuggguugcccaggcuggccaugaacuccuggguucaagugguccuauugugucugccucccaaagugcugggauuauaggcgugagucaccauuccuggccccaccagucuuuuaacuagcaugccucuagugccuggcacagcauuuggcaugagccuggcacuugguagguacucaguaaacauuugcucagugaacagucuuacugaaggaacucuuuauuugaagaucaaaaaaaaaaaaaucuaagaacauuagggauuaggcagcuugauaguauuuagugauccauugaauuagcagcccaugguaauaacucauacuuguuaauuuuucuauuuaguaacuuuagacccaguaauauguucuaauuucaaauguuaagacuuacuggaugguguaaagcugcauuauuuugcuauuuugucuagaaaaaaugcacuuagaauuaaccaugguucauuuugguuuuaauugcuuuuucuagagaaauuugcccuuuacauaagaaaauacuuuuagaaauacucuuaaguugaaguaauaaaauuaaccgcauagguuauugauuaguuuuaggcauaucucucucugugugcguguguguguguguguguguguguguguguguguguguguguauuuuuuuuugagacagagucucacucuguuucccgggcugaaugcgguguugcgaugauggcuaacugcagccacaaccuccugggcucaagugauccucccacuucagccucccagguagcugggacuacaggugugugccacuaugccaggcuaauuuuuguauuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccguguuagccaggauggucucgaucuccugaccucaugauccauccgccucggccucccauaauuuuuguauuuuuguagagaugggaucuuccuauguugagccuuccuaggcugguuuuacacuccagggcucaaucaauccuccugccuuggccccccgaaguccugggauuauaggcaugagccaccaugccuggccauuguauguuucaaagauaguauuguuacuuugggaggccaaggcagaaggauugcucaagcccagggguucgaaaccaaccugguuaacauagggacacccuguaucuaccaaaaacaaaacaaacaaaaacaaaccccaaaacagaaaagauaauauugcuaauaaaauuuaaaaaguguuggaaauauaccaaaaaguaugguauuagcuuuguacauagcugcuagcuauauuuguaagaagaagagaauacagugcuaacugguaguaaaauauuuauugaucaaguggaucacauaccacucuagcacacacccacuugcuugcagccccaaaacauugaucucuguggaccacugcucagcacagaauucccuaaaggaaccauccaggauaucuaguguuugugaguuggaaagucucacucuuuuuuccugaaguguugagauuuuacuaauuaauugauugguaacuggauuguuaccgaucaaguuuaacguugguacuuugaugaugaaauuaugaacuggaacuaauccuaauaaugucagucaacgugcaaagcaaauaguuuuccagaguagccagcuguacuuuuuuuuuuuuuuuuuaagacagggucucgcucuguugcucagauuggagugcaguggugcaaucuuggcucacugcaaccucugccucccgggcucaagcgauccucccaccucagccuccugaguagcuaggacuacaggugcauguuaacacaucuggcuaaguuuuuuuuuuuuuuuuuuuuuuuuagagaugggguuuugcuauguugcccaggcuggccuggaacuccugagcuaaggcagucuacccacgcagucagucauagcucauuguagccucaaacuccuaagcucaagcacucuuccugccuuggcuucccaaaguccuggauuacagguuugagccacuaugccuggcaguaaccugcuauauugaugguagauuuaaaggaaugaauugaagaaacagaagacucagggcaaaaucuuacccauugugagaaucccuuuucuaccugcuuuugcuuauuuuguuauuagcaauguuccaaauuugcauauuaaugaauuacugcucaguaagggcguguaaauuccccuuaggaugcuugcugaaucuuuuuugcuacucuuuuaguuacaccaccaccaccaccacgaccaccaccaccuacaacauugacaucccuucaaaugaaaagaaauuguuaaauccauaacucuagggaaaaaccagaauguuuacccaacuuucuuuauuguguacuucauggaaagcaagcauuaaugcuguucaccucgcaaauuacuguguuagggcugggcaugguugggaggccuaggugggcggaucauuugagaccaggaguucaagaccaucuuggccaacauagcaaaacccucugucuacuaaauaugaaaaguuagccggguguggugacgugcgccuguaaucccagcuacucaagaggcuguagcaugagaaucgcuucaccugggagguggagguuucagugagccaacaucgugucacugcacuccagccugggugacagagugauuuugucuccccccccggcaaaaaaaaaaaauuacuauguuaguaguuaacaaguuauuuuacccagcuuuaucauuuuuuugguaucucuuuuuuuuuuuguuuucacacacuacuuaaugucauuguuuagauuggaguugguagaaaaugcaugcaauuuaauauuuguuaugcaaaaauuguuauuugcccauaguauauaggaaaguggcuuuuuucaugauugcauuucuaaagcuaggauuacaaauagauuuauaaauguuccguuguuacugcacauguguucauuuuuuauaagcuugcuuuuuaguuaguaggguuugaacaagguuguaaaguguguugucuuuggugacuccauuucauuuagugaaguccuuugauguuugccaggaaccauacuaaucacuguuagaaaucaucucugguggccggguacggugguucaugccuauaaucccagcacuuugggaggccgaggcaggcagaucacgaggucaagagaucaagaccauccuggccaacguggugaaacccugucucugcuaaaacacaaaaauuaguucgacguaguggcccacgccuguagucccagcuacucgggaggcugaggcaggagaaucacuugaaccaggaagguggagguuacagugagcugauaucacgccacugcacuccagccuggcgacagagcgggacucugucucaaaaaaaaaaaaaaaaaaaaaaaagaaaucgucucugguaacacagacgacagaugucucaaguagguggauuuuuuuuuuuuuugccccauuuuaaaacugaggacuggcugggcgcgguggcucacgccuguaauccagcacuuugggaggcccaggcgggcagaucgcgagauccggagaucgaaaccauccuggguaacauggugaaaccccgucucuacuaagaauaauaaaaaaaauuuagccgggcgugguugcaggcgccuguaguccuagcuacucgggagguggggcaagagaauggcgugaaccugagaugcggagcuuguagcaagccgagaucgugccacugcacuccagccugggcgacacagcgagacuccgucucaaaaaaaaaaaaaaaaagacucagaauuauuuagagucuuaaagguuuaucuaguuauuaauaagucuugcaguugggauucagacuauuaacugauuuuuccuauagcuuuaaggagaaaagaaaagaguaaagaugaaggaguaggcaagaagaaagccucccuguguuucuuuuuacaccaucaacuuucuuuuaauuagauuuuaugcagaacuaaaagagaaacgugcuccucauuuuggggggccagacuguggcauaagaaagauuuucagagggcuguaauguggcuagauucuaaucuugugauaauugacaggugauggggaugggggggcguuuggagguguagguaggagaaaugucugaaccaacaccguuuguuugccaccuaagguucuuucuuuagauguguuacuuggaaacauucuugaagucagaaagaaaaccccacauuugaaggauugaguuaugucuugacggaggguuuuguuucucucuagggaauaguuggugauuuuuaauuagacuauacuuagauucugaccccuuuggcaaaguacauugacagaagcuagucaguccuugucaggaguuaaguguacuuuaucugucuaaccuaucagauaaauaacuacuggguacuaggcuuaauaccugggugaugaaauuaucccuacaaccaacccccaugacaugaguuuaccuguauaacaaaccuucacauaugccugcaauccuaaaauaaaaguaaacaaacaaaaaaagauuugcuaggacugugagaagagacauagagucugagcccagcuucugaaggcuguaacacaguccucuuuagucuugcaguaguacagagcaaauaguuuuuacauuaaaguuaguguguuuuuccauguguuacuuggaauguauuuuaauucauguuaaaaugaucucaacauuguguuucucuagauugagaauacuuuuuugagauugucugggcuccuugcuuaaaaucuuaugaagguugauuaacuuaccccaacuaacuccuuuuuuguaaaagugucaaaaaugaaaaacugaggauauuuaagauggaauauaucuauauauaauauuacaguuauuaaaaauguauguuugcuuaaguuauuguaaaagcauuuccagcaagugauugauaacuuuuacccaaggcacaggcaguagguggaaauaaaucccugcacuggacuugaaacuaacacaucuauaauuuguaaguuuuuuuggucacuacuugaaccaacauuggucuuuuuucuugugauuuauauagcucuaauggucaguuuuacuacuuuauuauguucuguucucauagaacucuucauuaauuuguguauuuuggucuugucucucccaugagauauucaacuuccugagagcagugguacauguauccuauuuuuguguguugaccagguaucacaacuuguaugucauagauaugugcaguuucaugcuucuuucagcuguuguuaaucuaacauacuuuuagcuucuuagggauaaauauuacaaagucagccuauagaauaguacagucaugcauccugugugaugccuugauuagaacuagucugauauauaggaaauuuuagaauuauagaaaacugcuuauuagaaauguucagccacucuaccauauuuugauugucagugauaaucacagauuuauauuuguugcauaagagaaaucuacagacaacauaccucaaacuuaauauagccaauugucaugaaucuauccccuccucucuuccucccagugacuuauuauuugugugggcuucauagaggauuuacuuauuugaggaaucaugcauaaaguuucuugaacucaugcauaaaguuacuuuacaauauauauuucuuucuuucuuuuuuuuuuuucucgagauggagucuugcucuguugcccaggcugcagugcaauggugugaucucggcuguaacugcugccucccagguccaagcgauucuccugccucagccuuccgaguagcugggacuacaggcaugugccaccaugccuggcuaauuuuuguauuuuuaguagagaugggguuuugccgcguuggccaggcuggucuugaacuccugaccucaggugauucaccugcuuuggccucccaaagugcugggauuacaggugugagccaacgcgccugaccuacaauauguauuucugagaggacauagcagucaauuguaugaucucuaauauaauuuucuaaucagagacagaaaacuuauuuaacaauuuuccuuuaagugugguuaaaaaacugagugguuuuugggaagauauuauacuugagaaaggacuugaauuaguuggguugccuuuguugucuucaugucugauaaguuaucuuacugugccuaccuaaugaagauuaacauuacuuaugaaauguuugauuuuaacagaaacauuugaccauuuacuguuuauuuuuauuuuaauauuucaggcuuuguguauuuuuuucaguuugcauguuacuuguaguuugguugcuuugaauaaagugcacuuuugaaagccucuuaauucucaaggagauuuccaacuguaaagaagcuguacagguaguuuucccuuaaaggcuaaacuucaggcugggugugguggcucacagcuguaaucccagcacuuuaggagguugagguugguggaucaccggaggucaggaguucgagaccagccuggccaacauggugaaaccccaucucuacuaaaaauacaaaaacacauuagccagguguggaggcacgugccuguaaucccagcuacucaggaggcugaggugggagaauugcuugaucccgggaggaggaggaugcagugagccgagaucacgccacuguacuccagcaugggugacagagcgagacuuugucucaaaacaaacaaacaaacaaacaaacaaacaaacaaaaaacaaaaaaaaauucaaucauaggaaaucuugaaaaugcuucaguacuuuguuggaguucauugugguggaacuuuauaagccaauuuuuauggaccccuuuaagccacuuuaucuuauucauggaugguguaauuaucauuuauuuauuuguuuucauugauacauaauaguuauaccuauuuugggguacacauuuauauaauauauaaagaucaaaucaggguaacugggauaucuguuaccuuaaauauuuaaagaggugacaacguauacagaaaagaauagaaacaaaauaaaaacaaaaaaacccugugcuuuaacucccccccaccccauguuuugauuuuuuguuuucuuaauuuacauguuuuaauauugccugcuuuuuaguagguugcuguaguuauuguuuuugagauguuuuucuuuggggcuucauacuggaguuauguguggauuccaucugacuuuccuuguguagcuaugaaggaauaccugaggcaggguaauuuauaaagaaaaaagauuuauuuggcucacaauucugauguuuagaaaaguucuggauuaggcuucugcaucuggugagggucacauguugcuuccauucaugguggaaguugaagggaagccagcauguacagagaucacaugguaagagagagaaggggcugggcaccauggcucacggcuguaaucccagcacuuugggaggcggaggugggcggaucacgaggucaggagaucgagaccauccuggcuaacacggugaaaccuugucucuacuaaaaauacaaaaaauuagccaggcgugguggcgggcgccuguaguuccagcuacucagaggcugaggcaggagaauggcgugaaccugggaggcagagcuugcagugagccgagaucuugccacugccuccagccugggcgacacagcgagacuccaucucaaaaaaaaaaaaaaaaaaagagagagagaaggaagggagggccaggcucuuuuuaacagccagcucaugggaacuaauggagugagaacucacccauuaccgugaagauggcaccaagcuauucaugagugauccacccccaugauggaaacaccucccauuaggccccaccuccaacauugaggaucagcuuucaacgugagguuuagaggggucaaauaucaaaccauaucaauaccacuauuacaguaauagaguauucugaauuuguucauguacuuaauuuuaguggguuuugcaucuuuaaauguuuucuucuugcauguuaguggguuuuuuccccucccugcuucguauugaagaauucccuuuaagauuucuuguaagaugggucuggugauggcaaauucucucagcuuucauuuaucugggaaggacuuuaucacuccuuuauguuugaaggacagcuuugcugguuucaguauucuuggaugacaauccccauuuuucagcacuuugaaaaugccaucucacuacuucuuggccuauaugauuucauugagagaucuguugccaggccaguuagauagaguuccuuuauaugucauugcuucuuuucucuuccuguuuuuaagauccuuucuuuaucuuugaccuuugagaaauuuauuauaugccuugggguaaucuuauuugggucauaucuguuuggugaucucuaacuuuucuauaccuggugugaucucggcucacaguaaccucugccucccaguuucaagcaauucugcugccucagcccuccauagcugggauuacaggcaugugccaacaugcccagcuaauuuuuuuuuuuaaauuuauuuuauuuauuuaucuuuuucuaguuuuggaaaguuuucuguuguuauuucuuugaguaagcuuucuacuccuugcucuugcucaguucccccuugaacagaaguaauucuuagauuuggucuuuagugguaauuuucuauaucuuguuggcaaucuuuuuuuuuaauuuauuuuuuuucuccugugucuauguaugugccugucuucaagcuuacuguuucuuuccucugcuugaucaauucugcuguugagagccucugauuaauuuuuuaguucagcaaauguauuucuuagucccaagauuucuguuugauuuuuuaaaaauuauuucaaucucuuuguuaaauuucuuucuuuuuuuuuuuuuuuugugagauagagucuugcucuauugcccaagcuggagugcagugacgcgaucucggcucacugcaagcucugccucccggguucaagcaauucuccugcuucagccucccgaguagcugggacugcaggugcccgccaccacaccuggcuaauuuuuuguauuuuuaguagagacgggguuucaccguguuugccaggauggucucgaucuccugaccucgugauccgaccgccuuggccucccaaaguuuugggauuacaagcgugagccaaagugccccgucuuuguuaaauuucuuugauaaauucuugaacuccuuuucuguguuaucuuggagauuacugguuuccuugaaagugcuaucuugaauuccugaucagagagcuuacauauagcuauguuauuagggccagucagucacagguuucuugcuuuguccauuugagaaggucaugguucccuguuugcuauuguuucuuguggauguaugucuaugacuuugcguuauuguaggcuuaguuauuuaucucagucuucucucuucuuuuuucuuucuuuuugagacagagucuuggucuaucaccugggcuggaguucaguggcgugaucucagcucacuguaaccuccgccucccaguuucaagcaauucugcugccucagcccuccguagcugggauuacaggcaugugccaccaugccuagcuaauuuuuuuuuaauuuauuuuauuuauuuuuuuuuuugugcgacggagucucgcucugucgcccaggcuggagugcaguggcgcaaucucugcucacugcaagcucugcuucccggguucacgccauucuccugccucagccucccgaguagcugggacuacaggcgcccgccaccaccaugccuggcuaauuuuuuguauuuuuaguagagacaggguuuccccguguuagccaggauggucucgaucuccugaccuugugauccgcccgccucggccucccagagugcugggauucaccgugccuggccacccagcuaauuuuuguauuuuuaguuagagacaggguuucaccauguugaacaggcuggucucggacuccugaccucaggugauccaccugccuuggccucccaacgugcugggacuacaggcaugagccacugcacccauccuuuuuuuuuuuugguuacuauuaaauaugucuacuuagagauucuuauaauuuaccuuggauuuauuuaccaaggauauucuugacccuucuuucuuucuuuucuuuucuuuuucugcuagguuacuguuuccuuuuugguuccagauggugccuucagcccagguuuuccuuagcucuaguaaaggaucagagugcccccuguccugaaugggguauuuuccaaagggugugagagggcuagcuagggguucauucccaggagaccugugggacagaccuccuacaguguagcacugcugagcugccacucugauuuggcaucuccguuggcugaauugcugaguuuccagggcugggaaugguauuccugccaucgcucuuugugucuggcugucuugagggauauuucuuucuucagguacucccagugcuuccuacagauugaagaagggacaguguccuccuaggaaacccacaauggugggaaagcugguuguccacccugaucucuauucuaguguagaaaccgugagugggggguuuauuuucugcacacuugacuucaggcagaucaaaggaaggggugcugaggauauagaagucucuuauucucuuacuauuugcuuggaaguuuuuuacuucucugggaucugacuccuccucauauuugaguucuaggaaauugcuggugaugacuuggugcuguauauauauauacauauauauauauauauauagaaaaauguauguaaaaauguauauauguguauauaaaaauauauguuuguguguguguguguguguguguguguguauauauauauauauauauuuuuuuuuuuuuuuggaagauggaaucuugcucugucaccaggcuggagugcaguggugugaucucagcucacugcaaccuccgccugccggguucaagcaauuccccugccucaaccucccaaguagcugggauuacaggcacacaccuacacacccagcuaauuuuuuguauuuuaguagagacgggguuucaccauguuggcuaagauggucuugaucuccugaccucgugauccgcccaccucggccucugaaagugcugggauuacaggcgugagccgcugcgcccggccagugcugcauauuuguuuuugguuuucugugaagguugugggaggagugaauccagcuugcuucuauagcaccauuuugguaucagaaaccacaauugauauuugaauaaaugaucauuuggaaagaguaauguucucagaagauuccuauauaagguaagauuauuuuuuguugggaaaaguuugcuucagaaaauuuuugauaugggcagacagcuuuauaugggcauguuuuucauuuaucgucaacuucuuguguucuuacauuuuagaaucuucucgaaauggcaucuuucccuguuuuauuaaugcuugaugcuguuacaaaacauugcaucuauguuugguaauuuaugauuuuauauguuuuuccaauuucuucauuacuuacugagcacacaccugugucagguauugagcuaggugucaauaauaccaugaacaugugaacuugacagaauggcuucuacuuaugaaacuuacuaacaguugacacacaaagcuuuuagccccuccccugcacuuccccacugucuuuuauugcaguagcagaacgcuugugggcaaaauuucaguggaauuaaaaucuuacauggaauccaaaucuuacacagaacccuuauguaucaaccagaaagaauguuuucugugauaggucccuacuuuggaaaagcuuuaacacagagauuuucaaaacuuucuauacaugaaaguuucugcagaaucucaauauuuaaagcagaaaacauaaggcagagcugauauggaugaaauguguggugagaagcuuucucgcaccaaacccucccuggaggcaccuuguagagcugaggcccuaugaagacaccagauaaaaagccccccgagagaaagaacucagcucgagcuuugccucucccuuacgccacugguggcccauuuccugacagaacguuuaggugaacuagagacacucuagcaaccauacgugcaggcaguccuacgugaggaaacuugaggaaaauauccucacgugaagagaguuuccguagguaacauagcauucaucccaggaaacccugggaacuuugaggugugccauaaaaagcaguuugaaaaucgguuaacuggaucaccgauuugagccaccccucaguauccaugaacuguugguuccagguuccauucacaauaccaaaaccuguggcugcucacgucccugauauaaagugcgugguaguuacccaugcacauccuccccuauacuuuacaucauuucuagauuacuuguaagcccuaauacaauguuaaugcuauguaaauaguuguuaucccgaauuguuuagggaauacugaccagagaaacaguuuguacauguucaguacagacacgaccguuuccccuccacguauuuuugaucugugauugguugacuccauggaugugggacucucgguguggagggcugacuguacuagaaaagucgcuuuacuacugcauguauuauauguugaguauuuuggagaggucaggaaagcuuuuuaaaaguuguucagaguugauaucaacuaauuuagaauaccuuuuuucucacgaaaaauaguguguaaaacacuaaauuauuuucuacuuagaaaauauucaguagacuagguaauauaaaauauauuauuucuugaaagucaaguuuugugccauugucuuacuagauuuuauaacaaugauguuagguaaugguaacuuacuaauuuuucugaucgcucggggaauuaauuuacauguauaugguuaucgaauuguauuugaaauuccagauuaaaaagaacugcccaacuuuccaaagcuuaguuauucccuucuuguaaggauuuuuucucacuguggcuuccacaguuaugacugccugcacauaugguugcuaggguuucugguuuucaucugaauguuaugucaggaaaugggccaugaauggcauuaagggugcggcugagcucuagcugaguuccuuuucucaggggcuuuuaaucucagguucuguagggccucauuucaggcaccucauucuccaggccguacucuuagaugccuagcuuacaaggcaagaggacuggcauuuaagugacaccucuuuacaaacauguuuauuguuacuguuuuagcuuagauuacuuggggaguucacucugagauugugugccagggcuuucuuguauagugcuccaggaauaauacugcucacagugggggaggcagaacugggcagaaggggaaggugaacuccagcagaguccuggcagauccuaagggcagugcuggagcugacauugcccuucagaauugccccaaauucaggcaagauggccaagccuuuauacucaagccuggaccaucccuugcaugugggccgccauucccucccucuucaagggguauguucuugggggagggaaccugaacucaugaaggcagcaagggccuugccaggagugggacuuggcagccugccugcagcauccccuauagccaugcuuucuguuccucacguucaucuguuuuuaagaacugaaaauuaaguaugcaauguucuacuuuccacaguuaacuaacaagacuucauaauuuaaaacuuaaugcuuaaucuuuaauaaaugcacaaguauuaaaacuuguuagcaccauaaguaaugugaaaauguaacauagucgcaucuauaaaauccauagugguucaaucuuuuugacaauugguuaugaguaugcuuugauuaaaaaguguauuauaaauuaacuacuucaggaauuuugaguuuugugaaauauacuuuacuuuuugauucauaaaguguuuuuguaacaagaacucccuugcauccccccugaaaaaaacaaccacuucagguagugguuugcuggucuuguucuuuguaucugcgguuuauuuaaaaugccauugucuuuugcuuguucauuguaagggggguuuuucccuuggaggacagaugggcccugucacuucuuuccuuuugacaucuucauagugauuguuggggaaacaguguuggaaaauggguuuggagaguagaucuuguacuuuggaguuaagauaggucugggguuaggugccagcucugucaucacuuugcuugagugaagagaugccuguaaggaagcuuuggcuuccucauuaguuaaauggagguaguaguagaacuuguauuauaacaucuuagcauaagcucugguguguuaucagugcucaauaaaugauggcugugaugagcuguaaucauauuauuggucaguucuucuuuuucacuguguuuuugaacacuuuagugaagguagagggcaagucaggcauacaagcuuaugcgaggaauggggccgggggaucauuuugggguuguuaucuguuaaaaaauuguccuugagguacugggcuuucuucuucacaggggaugauugugagcaaaacagcaacaacaagcagaaacauaaauaagggaggaaaugacuacuucacacggccuuaguuaggcgcagggaguauagggcaggcuuguuuuaggacugaccugccugagcaugacgugggccuggaaggaauucuccccucugugguccuggaugucacaaggugaguggaagcugggacaucuguaggugcugcagccccuguuggugacagugacagagggaccuauggcagcugccugugacagcccugugacagacgucugggcagugggacaacagaaaccauuuguuccuaaacacacagccccagggcucccaaaaaacaauagggaauuuugagggagugaucugagaaguaggaguuagucuuugagaaguacugguaaacaaguaaguggacugagcauauuuugaaagaaguacgaagagggcaguuccuagagaaaacuugaacuagagaaaguagauuuucauaaguauagauuuacuuacuauuauugugaaauguuggccuaaucucauucaguucaagguaguguuuguuucacaacugcagggcuauaucuguuuauguuuaauuuuugaguaaaucaccugaagauauguuuaaaggaauuuuguuuuccuuggccuucaaaauaaaucuuaaaaaaaauuuauaaaagacuucaguuuuaaaugcaacauaauccuguaaauaucuaauuaguguguucauaguucauuagugacucaguuuuuuaguguuagcaguacuugagcaauaugcagaauagcucaagaaaaacccuacugucccaaagcuuaaaugaauaauuauuaauuuuaacaaaccaguauguacuugaggauauacaaugguaggcauuuuauuugaugguuuucaaaguauacaaaaaaggugcaaaguacauucuuauccucaaagaauuuggaauuagcuacauaacugagcaauugugucccauaauuuagggccuggcuguggagcaggcacucuacaagguagaugaaaauggauaguuuauguuaaaaugucuggguggugguaggcuuuuucuaccucauagaacucaagaccuaucaagacaaaaaugaugugugcacauugagcagcaucuugcuuugggaaguaguauauaauacuacauaauauacaauugaagggcucugggaggaagaaaagggaugagauggcugaaauuuauaauggucaaagaaggcuucaaagugguggaaucugggugggguuugagaggugaauugaaacacggagagggguauuuugaggggaggagugagguugacaccuaugugagugauagaauaauucuuaguccagccuauagggaguggaauguucauauuuaagaagguuggaguuaaauuguggaggucuugaaagccaggcagugagguaugaagguuuuuaaacuguaauagugacaauagucuagcugaaggcugauaaagguugaaauuggagugauacugcugggagauagacacaagguuuugaggugguagagugguuaggacuuguuauuggcggagaagaugagaaauaaagagguauugauuugggguggagaguucuguaaaugucuauuagguccacuugguccagagcugaguuuaaguccugaauauccuuguuaauuuucugucucguuuaucugucuaauauuaauagugggguguuaaagucucccacuauuauuguguggaagucuaagucucuuuguaggucucuaagaacuugccuuaugaauccaggugcuccuguauugggugcauauauauuuaggaguucgcucuucuuguugcauugaucccuuuaccauuauguaaugccuucuuugucuuuuuuggucuuuguugguuuaaagucuguuuuaccagagacuaggauggcaaucccuggcuuuucuuuugcuuuccauuugcuugguaaaauauuccuccaucccuuuauuuugagccugugugggucuuugcacgugagaugagucuccugaauacagcacaggcaaaguagguuuaguauaauucuuaaggguccuaugauuuuuagaaugguaaaugaacauuggauguaauuuaaagucaccagccauauucgccuuuaacaauagaguucuaccuguccuuugaagcuuuuuauuuuuucuuuaagacagaguuucgcucuuguggcccaggcuggagugcaauggugcaaucucgucucauugcaaccuccgccuccuggguucaagcaauuguccugccucagccuucugaguaguugggauuacaggcgcgcaccacuccaccucuuggguucaagugauuccccugcccagacucccgauuagcugagauuauaggcaugcaccaccaugccuggcuaauuuuuguauuuuuaguagagacgggguuucaccauguuggccaggcuggucuugaacuccugaccucaggugauccacccgccucggccugggauuacaggugugcugggauuacaggagugagcuaccaugcccgucccuuugaagcuuugaagccaggcauugacuccucuaucugugaaaguccuagauggcaucaucuucuaguagguauaaggagguuuccuccacauugaaaaucuguuguuuaauguagccaccuucauuaaugaucuuagcuagauuuucauaauuugcugcaaugucuauuaauacaucagcagcacuugcuguuucaccuuguacuucucucuuauggauacaauggcuuuccugaaacgucauggugcuagaguccagcuuuuauucugcagcuucuucaccucucucagucuucauagaauugaagagaauugaagccuugcucuggauuaggauuugguuuaaggaaauguugcugguuugaucuuauguccagacaugccaacauucuccauaucagcaauguuuuuuguuuucuuaucaucauuguguucauuguuguagcacuuuuaauuuccuucaguaacuuuuucuuugcauuccuaaguuucagcuuaucuuagcuuucaaaaugcccuccuuacuaagcuaaaucauuucuagcuuuugauuuaaaaugagaggcauggagcucuucuuuuucuugaacacuuagaggcgagagagagagcgagagagagagagagugagagagagcgagagagagagagagagagagagagagagaggaucagcuagccgacggagcagucagaacacacacauuuauuauguucacgcucuuaugugggcaugguuuguggugcccccaaacaauagcaguggcaacaucaaaggucacugaugacacaucaccauaacagauauaauaaugaaaaagauugaaaugugagaauuaccaaaaugugacacacacauucaaagcgagcacaugcuguuggaaaaaugccacagauaggcuugguuagcacugcauugccauagaccuucaguuuguaaaaaugcagcaucuuuaaagcacaacaaagugcaauaaaaugagguauguccauaguacuauguuaaacaacaauuaguaaacacuuggauguuaucagagcagcaggauuuaaaacuucuuaaaagccccggguuuuuuuaaagggcuuuuuaccuccuaucauuugcucucauucagggcauucuguuucagcuauugucugacagugacuuuuacugauuuucaaaacuuguuuagauaaagacuauuagcauauuuuaauaaaguacaaacauguugcuguuuaacuuuauuacucauuuuucauuuuauaacggaauuagaugacuuuuuuuguggcagcugcuacaauucauggagcuaaauuuuuagggcaguucuucugggaaagugguuuauguggaauuucggagccccaagucugcccaaucuaucuugagcacauguugucugucacagccuguggacuucguaggcaacauagcucuggguaagacccaggaggaaugaagagaaggcaaggaugaagcauggggagaccaugcuauaaugaaaauguggacuggcacaguggccugugguggccuguaaucccagcacuuugggaggcagaggugggaggaucacuugagcccaggaguuugagaccagcuugggcaacauagugaaacccucaucucuacaguuaaaaaaaaaaaaaaaaaaguugcuagggaguccugggagacauuuaggucuugggaguuugacugaaguagacguuugauugaggaugcaguugcugguccugagcacaccagacugacccuaaagucaggaaaugagguuugcugacauagccuuccuucccauuuucugcuuucgugauuuuuucaucuucccguuuccuuccucuucuccaggacuuccaucuuggaggagcaggaauaugguuuaucauuugagagugauauaagucagcaaauacagaauaucuguucuucuggugcuguauuccgggagaaagccauagacccuuccucuuagggagcugagauaggauaguagggaggcaggaagguagaaauacacauguauucugagugccaggguggacaccugcaugugagauuguugauacaacaagagagggagugggaguucuccugggcgggucuugagcugagauuugaaagaggaguggguguuuuguuguaucuuauuccuguuuaggacaggaagacuaauuuuguccuggugccugguagguagaacuaugaaguaaucuuagaaauguaaguggguaaugauacuuauuucagauguaagauaaguaucccagaguugaggcauuagaguucaucucuaguggcgauaacuuuggguguuuugagaagucagaggucuucccuucucuuuuauccucuucuuauucacacuaacugccauaugauaguagaugugccugagcacuugauguugcugagauccaugugucagaaucuaggcuucauucugauaggucuuagcaauaucuguauguauuucuacccccgcuacuuacauggaaaaugccuugaguucuuccugcagugcuuuauauguggcaggugcucagcaccuaucuccugaauugaauuagauuguuuuaaagugauucuuacuagcagcacaucuauuauaaaggaaaauuuugggacaguaacccaaaugacucaaccaccuggugauuugaguauccugcguuugcucgggccugugauggugcaguagagaaagagaacauagggccugaucaucaggcugcuggagaguugaguuuuggauauuccgauggguugcaaaaagguacugugcuuuccuggguucuuucaaauuguaaucagccuuuuaugugccugucugacccuugauguuaggauuguuugaacugauacuuuuugaacauuuucucaaguuuacuggauguggggggcagcaagucaggcucaccucauugccuuguagccaucauuuacccuugaucuuagccaaaaggccgagaagugauuuagccaucuuuuaauaaugagcuccuaaauaugacucaguugcugcauuccguguuguucugugagguagaugaggucugacaguguauaaugagcuccuaaauaugacucagucgaucuguuccguguuguucugugagguagacuaggucugaccguggugaaguggcuugugcaaugucucuuagauggugcuuuccaguucuuguuuaacgugcguuccccucuaccgaggaagcugguugcuggaaaacacaugaaaauauaugcaccuugcuguuuuguugucuuuucuuucuuucucucucuucucauggcaugcuuugaaacagauuagaguuguguuuggcuucaaauugcugcaguugcccaucaaaguagugccgugguguaggguuagcaggggugcuguugcagagaagucagugagucuaguguucaaaugcaaugugacugagugccccugaagccaggugcucaccuucuuacaggcaagggcugucugucagccuacacacauagacugcagguuugaaagugcuaugugaagcuuuuguuuagcauucugacuugggccauugugguauuaccggaaaaaaaaaucugaaggaaaaacauaaaaaagcuucgcauacacaaaucuaucauccgacaucagggagguuguggggagucaggaccaagcagagguucuuagauaugguaauuagaaaucaccccauucuuucguucauucauuauaauguacuacccugucagaaucagcuagggagcuuuuuucaggguaugcuggguacuucaucccugagggauguauguuucugcuguccuucauucucccaggugccaguuauugcugguaauuagagguguuagugauucugccucuguaaugguauggaaacaggaaaaaggcuuagaaagugcuaagcaagauuuuuuuugagauggagucuugcucugucacccaggcuggagugcaguggcgccaucucagcucacugcaagcuccaccuccuggcuucacgccauucuucugcgucagccucccaaguagcugagacuacaggcgcccgccaccacacccggauaauuuuuuguauuuuuaguagaaaugggguuucaccuuguuagccaggguggucucggucuccugaccucaugaucugcccgccucgaccucccaaagugcugggauuacaggcgugagccaccacaccuggccuaacaagauuauuuuuaagggcccuuccagcccugcaacuuguauuuagagaacagaauuguucuuugauccccuagggcuuuauugacagagugagauaauugauuaaaagaauaguaguaucuuuugagcaagauuuugggguugucaagaugguacauggaggcauauugcuucuugacugcugagugggguagugcucugauuuuauuguucauggcaagaacaaugauuuggcucuugguugaauuucuaaaacauuaaaauuagucuuuccuaguuccuuuguuauguggaaacauuaaaaacagaaaaaucugauggugacauuccaguuuuauuagcauuauuacuuaucuucagacuguccuuugucagacccucgggcaggguuuugggcucauucagggaacuuucaaaguuauuuguauaggaaacauuacauagcuuugucauuauuuaaauacuguguaacaaagcauagcauugauaacagaagagagaagcauguaaaauauuucacagggauaagcauggagaugaguggguucacuuugagcaagauaaugacuaaggcagggaaggagagugaccucugcuugaaggcauuuuugcccaguugugcuucacuggauauuaccacaguauggcuuucaguuugaggauuuaguucuacuugggaaauauuacaugucuuccguguacggggcugugauuggaaggaaguuuucauccuuugauuauuucugaagcuauuaaacuauagcaauaguugguuaaccauaagaauuuuauuaauaauuaguuaugauuuuaaaaugaacuugauauuuauagaauuugaaaagaaauugagacacugucuuccaucuaaaagaagaaaaguagaacuaauuaaaucauuuggcuaagauaggaauagcugcaccugggaaauacuuguagaaaauaauaggccaguaagccuaccuaggaggagaggaaugaggagauugaauugguaugauucagauccuaggaguaaacugaggaucagaguaggaguagagccaucuugccuuacuuuuuccuccuuucugcagauaaggauagcuaaauuuucugugagcauaugguugaacuuuagauugaggagcuuuaacuuuaccaauuuuucagaaaaaugaaucugcauauauaaauaucuccauauccuaccuuuuuguuggcaggcauauucauauuacauguauguguguguguguauguaugugugugaugaggaaggcugacccucuuguuuggaagggacauacccccacacccacacccacacccacacccacacccacaccccuuuucuggguauauuugugauguaagccaggaauuaagaacugguaagaaguggccauaaauauacauugggugauagucauuuaguuaugcuaaaauuuugucuucccauuucgguuggaacaauuucauuagcagugccuuaagcaacaggauauaugauugaauuuucuuuuagugaauugcauaguuauauuggauccaauuaaguuuugcauauguuaucaguagcauuaaaugaaaccaagugugguguuaaguaaaauuaguuaaguuacuuuaguaagaaguaacuuguacuaaguauauauugagcuaguaaguacagcaaauagaggucuucaaaaguauaguuuauauguaaaacauggaaugauuauucaaauuuauuguuaauauccucauuaaauuuccucauuaaaaugccuuuacaauuuaguauuuguauaggauauuaugagauuguuguuuuaaaauuucuuagcaaguccauaguaaaaauaacuauggaacuagaaaugaguauuucuguucuuuaagggugaaaauuuuuugcuguaaucaagauuuugaaagucacauaauuaugaaauaaauaaaacuuuuuuuaaggcugauaaucuuuugcuuauuaaagucuguuugaaaauuacgguguucuuaguaagauuugguggaaauauaaauguugguguaauaauuuuguguucuguucugcuugucaauaaaaauauuuuaaaauuuagaaagagagcaacccagauuuucuuaaaaacaaaagccaaaaucaaccaaccacaaaacgaaaaacauacaaccaaaacaacccuagagugcuggggugcuaugagagcuggcacagagggucucuaggcugugacuagcugucuuguugcugagcaguuuaccugccuugggccuuuguucccuaauuuguaaaaugugguuggcaugaugaguugugacauugaaauugguaauuuauaggcauauuuuuuuucuguucauugucuaaggaauaugacucugugauuggcuuucuaaucucuacucaguucaucuaaguggaguuugguguugaauuucuuuuaugugacauuauuuaggaauagauguccuuaggcuacuagcugaaaaauuauaaaccuaaaauuuuuacuuauguuuaaaauuuuagguaugcuauaccuccggagcauggaaaacgacuugaaagacuagcucaagguaaaacuugcuuuuuaaauuuguuuucuguguuuuauauguuucuguguuuuguagguucuuuguuuuugagguacuuuuuacaauauagaccguuacucuguugguuuuauucuauucaaguuauugacuuuuacauguuuuuuuaauugaacaauuuuaaauuuuuucaccuuaguuugugaauauuauuuuuucccuauugcauaaucgucaugguuauuuuaguugacuguuuaguauuucaucaagugauugcccuuaaucuguuuugguaguuucuaaaaaaauuguuuuuaauguaaugcauucaacgucauugugccaauaauuuuuuuuuaaauuaaguuacauucuuccagacgguauuguugcugcaucuugggguaugguuuuuucaugacuacuuuuucuguugaucugcuguuucccccaaggguuaugucacugccgacgcccaguucuucuguggcccacugggacuggaggugugcccuuagggaagugugaaggugaauggcucugaguaacaauacacaugagauuuugggccuucuuggacuggcaaaauuaaacuuacuuuacugcagguugcauuuuuauuuuucauggccugcugcuucuucuuuagggccagaauaaagaacuuuucuggaccucuauugaugauccugugccugcuuuuguguguguagacaaugccaaugcaagcagccaccuuccuccuuccuccuuuuuuuuaaagauaagccaggcggccuugcccucaucuacuuacguaugggaagcagagucacauucacccccugccauccuuaucuucuguuuugcuagccacccuuccagaaagaagauguaggcugguagugacuuauuuccagggaaaaguggaguuccauuugagugacaacugaggagcaaggccuucugccuuuauccaggauugaguccucagugagcagugcucuuuuaguccagugcagaucuaaguuucauugguguguuagguuugccuucuauuaggaaaagaauuuuguuccugccuuauaugugcuuucaauuaauaaugaaauggggacacugagaaaccucauugcuugacuugacaguuuuuaacagaaacuguuaauggcaccuaaagguuacuuuucccuaaauuacagaagaguauuagaaggaacaguuauaguauuacauuuuaagaagcauuauuauaauuuugucaggcuaauaacuauaaagugucuuuuuaaaaauguaauacauaauaguaauaauagcgauugauguaauuguaaucuugaacuuuguuagggacuguuuucaugaauaaguuuuggauaauagauuagaguagagcuuauaagaugauuacuguaacacuuaacuacguaggaagugaacuuuguguuaagacuauauucucaacugucuucuucucuguaauaaaauuuuuccaccauuuucuauuaaucuugcuaccagagaacuuuuaaaaugaagccgauguaaaccuuacaauauugagucacagacuaaaauuucugauauaaacuucuaaugcuuugacguaaacugucugaaaaugacauuccagaaaaugguuaccguuuguuuaaucaguaagagguuaaugaacuugaaggaugaacaagaacuugaaaucaguugccuguuuauucaaaacucuuuugcagcaauauuuugaggaauaaagcagggaaaagacccugcaagauagugaaggauuuguaucugaugaccagaugccagccaaaauaauugaauucugcuaaauaauuaaaaugauaaaauaaugcagugcgaaugauggagcauuuuagaaugucuagcugauagcaacacuugauucauaaaaugaaaaguaggcucagauauuuuccauuaucuugucugcgcaucauaauuaucacacuugccuuuuaugcaugaaugcuuucaucuuugguuucuauugaaaucuugauugacuguggcaccuacaaauauuuuauccaaaagacauuaggccugcaucuaauaaagccaggaguuugauuucgcccuucagcugcuuucuuauuuauacagguuuuccccauauuauauagacauaaauguaauaaaaaucucaagugaauuguuacaauuuuuauacuuguuauauucgucuguaaugccauugcauucuuucuaauuuuugguuugauacaauuggauugcaaauauggaggagaagagaguuauaauguuaaaucaugaaugacaguuuggaagauuuucaguuuuuaaaaugucuaaaucucaccuauuuuagaaaaaagauaauauugcuguuauauuaaguuagguaaauugagaaaguguacagauuuuugugaaaaguaguauuucauauuucauuuguccuuuauugggaauaaaaugcuauuauuuuaaaaaacugaaaaggauuuacuuugaaaauuuugguuacucguccaaaauaugugauuuaggacuuugugcagccaguuuugaaagugugaacaauuaggaggaaacuuauuucaaaggacaguguaguggaagugagucaauucuuuuagauccuuauauuuacuugaaacaaauguugguuuuguuaccuuauuaaaaaagcaguauuuagcaaaagggaauagaagaaacauugcuaccaaggguuaguuuaguucaugcuuuuaagcauuugugugugugugugugugugugugugugugugugcgcgugugcacgugcacgcacauuguggaauuuuuuuaauggcuaguaaucuugauuuuaauccuguggaguaagaggucauagcccgauuugcagagaucccugugccaggggguagauaaaggucaaugggugggaugcagacaggcauucaguggacucuuugaaauuauauucaaaguugggcauauacguagauuucugggaacgccaucaucaaauccccugagaucguuugguccgaaaaggauuaugagccacugcugucaagagaauagaagagcagcaauaaauaaaucauuuuaauuuuaugaacagauucuaaauuaaccugcucucauaccucucucuuggaaauuagggaaauguacuuuuauuagcucucaaaaugguaaauauuauucccuuaagcauucacuuagcugauagucugaaauauuauauugaaaugucuaguuuugaaaggcuuauaaauaaaauaccucugauuauaaauaaucaauuuuaaaguacccuguaagccauaaaaaaugcaaaagaccagugauauauccucugccuucaugccuaacucaugccuuaggcauggagaucaauguguggugcgucaggguauguuuauuuucgucuaucagcuggauuucacuaagagugaagaaacgguugguaaacuuaauuucuuaacaauuugaugucagugauaucacugucuguauuuaaauguaauuggauauuuuauauccagccauguuccuagugggauuuuagacaucgggcaauaauacaugaaauacacccaaauaacauaauucauuugugagugaaagacuuuuaguucccuucucuuaaccgagaauggagaggaagaauucaggaaaugaaugucaacuaguagggaggaauuauggggaagugaagauuucuuugauuugagggugccaauggggcugggcagaggcagagccagaagaauccugguuaguuuaacucugaccaguuugaucccaauguucuuggcuuggggaguccuuggugacuugugcguagauuauccauggauauuucaagggggugggaagugagagcugaaauuaaguggucucaggaaugcaguaaaaaaaaccccaugcguguaaugacacacacaccaguuaaacuggguggaaauuuuaaaucucgguuuucugcuaauuaucuugaaauggaaaaaacuugcccauuacacaacgcgcaccaugucuaggagauuaaaacaagccacuuguuuaggagaagcgccauucuccauuccaggaucaguaugaaguucuccuggcacuccuccuggagcgcucugcugguagagauguugauggauuaugggacguuagggucaagugaggccugcgaaaggauaauuuucuauccauuccugaguaaccacuccgugaacguuagcaagcaccaagaggccaaauguaauaugugccucucaugucaaccucucaaguagagcuguggguaaauguuacuagguuucucugcauacaauguaggucauugguucuuuucauaaauaagcuugccaagaaauuucauguguaaaucaaauacaguacaucuguuucugaaagcauuuuucacugaaccaauuuucuauaccuuuuucuuguauucuuuuccuuagcuuuuguuuauaugguugcuauauuuuucaagccucauaccagucauauaaaaccacgauaaaacuucaucaaagcauacuugggcaaauuucaauuaucaaguaaaauuguaaagaaaaauuuuuuacuaguuuggaaauagaucuacauguuugauuuucuuuccuuccucccuccuuuguuucuugucuuucucuccccuuuccuaaaaaguuaauggcuaucauuaucuucaccaaauuaguguuuguauacccauaaaaaugucacuaagcuuugaucuuaaacucuuuucucaaggcugaaauuuuuggugauuuaauacuauagcguguguuuguauuugaaucauaaaagauugggauuuaaaaauaauuucuuagcaauagcuaauauauuauaaacuauaaaccaguugacaguauagagaacuucucauuugaaggaaggaacacaccuguuccauauuuuuagacacauccacucuauuucaaaaauaguuucaaaagauuuaaugauuuuuuugagucaguuuuauucagguaaaaucuacaguaaaauucacuuauuuuaagaauagagcucauugaguuuugacaaauguuuacagugguguaauuaauaaaccacaugauaagccacuguuaucaacauguaacacauuuccaauaccccaaaaaaguucccucacaccucuuuguacuuaaccacucuccccuucccugucacccacuaaucugguuucugucccuaucguuuuaccuuuucuaaagugucauauaaguggaaucauacuauguguagacuuguuuuuugcuuuuuucacuuagaauaaugcuuuucacacaugcucacuuuuacauuguaugugaaacauccuuuggauggguauagcacgugauccuugagagagcuuaugagauccuacacacuucucuguguugcaaaacucucagcagcacuuugguguucuuaggaaagguuauuguggauugcuuuuaggguuuuagggcucuguuggggucucuggaauacaagcuuuuuauuauccuagccuuccaucccucuaacuuauuauuuggauuggaagaaugauuccaaagaccaucuuugcuugcuugauccuguauaauaucuuaaaaaagacaaaaaaaaaaaaaaggcaguugacuuuaguauggcaaggaauugacuguguuuuauagacuauggagugagagugaguaugaaccauguagcccugcagguauuuugagguaaaauucauuuuaaggcacauacuuuguacauaagaugcguuguuuaugaaguguuuuucaggacuauguaaaauauaauucugauagcauauuguaaauauaaauucugaaccaaugugaaauucuuaauauacugcaaauuaccuuccuucagugguuuuccaauuuagguuaacuuaugaccagucaccacauuguucagguccugauuacaaaucuauauugaaagaaaauggaauagacucuucuuucuucacugauuuuaauuuaaaacuuaauucaucaguguugcagaaaguuacagauuugagaaguuugauggauccauuugaauuguuuauaaaaacguucccauggauugugcauuuggggacugccccuuggugcccuucucuguguguaggacuuaggacaucuuguuguguggacauggccauuauauuagugucuuacuuucccuccacucaccaguguuuuauuuuguguuuauguauuaugaauauuaaccauaagcagagggcugcauuauuaagagacauuguaaagaauuaacauuucucauguuuuauugaacuuccuuccuuccuaucuuuuuuuuuuuuuuggagucucucucguugcccaggcuggaguacaguggugcaaucucaguucacugcaacccuugccuccuggguucaagugaaucucaugccuuagccuccugagcagcuaggacuacaggcacgcaccaccaugcccgccuaauuuuuuuuuuucuuuuuuccuuuuuuuuuuuuugaggagucuuacucugucauccaggcuggaguacaguggcacgaucuuggcucacugcaaccucuaccucccggguucaagcaauucuccugccucaguguccugaguagcugggaccacaggugugcgucaccaugccucgcuaauuuuuuuguauuuguaguagagacgggguuuuaccauguuggccaggcuggucucgaacuccugaccuuguggaccacccgccucagccucccaaaguguugggauuacaggcgugaaccaccgcacuuggccuguauuuuuuaguagaacccggguuuugcuguguuaggcuugucccaaacuccuggccucaagugauccaccugccuuggcuucccaaaguggugggauuacaggcgugagucaccguaccuggccaaauuggucacguucuugaguuaucugcauagagagauccacagaguuagaugucacauuuccagcaguuuccccccucauucuggugguggaggagucagacagcaucuacgccucauccugucacacauaugcauugcaugugccuuccuggugccuucucucuuccuuuuguguucucccuccaugauucucugucuuuuccuuguuucuuguuuuuccaaucccuucagcauggcugccuucccucugagugaggaagguguggagcaguacaucagacauguucauuuucuuccagcuugcaucacugaguuaaugagagucugccucagacagaacugcagguuugaagucagcgauggagaaaacugacucugucuuggcguauaauauacuguugaaugaaaggguuguuguauguuuaacuuccucauuuaaaagccuccucaaaacacuucucccauucaggcuguucaggcagguucucagacaguugaugggugauggcugggaaguucauucaggagauuaguagcaauuaguuucagauuaaucagaaaagaaacagaaaggugggggaacuacucugucugcuguaugccgaggauugggaugagugcuucaggaaugcauacuuaucuuuccuuuuuuuccccuguauuuuuagcuauagauccagcaucccacguauuuaucuuuccuaacuucccuaaauauuuucuccauuuaucagauaauagauugaauccacauuuguuucaaauugaaauuuauuccuaaaguugaguaauuuuacagguuacaaaaacaacuuaugguaaaucuguuuguaaagaagaucaaccuuuggugauguauccuuuaauuuuuaagaauucuaacucugacucugaguuuuaguacaagggcuuuuuggcagaagagguccauacuugcauaagucaaacaguaagaacacuagaacuuacacauuaaaaaaccuauuugauauuuucucuuaaucgacacagugccacuuacauuuauuguuucuuuuuagguuuuuucccaagcagcucccaagggugugaugcauuucuucgccacaagaugacauugauuucuccaucaguauugaagaaauaugguauucccuuugacaagguauguuaguauucaucuuacacaaauuaauuuuguuuguguaggauuuguauuuaagaaguaauguaucuuuaacuuccaguagaauuuuuaggauguggguagagaaauucaaauuuauguuuuauagcauaucaauuauuuaucuaaauccuaauuagaaauuaauuuuauuucaaauauauuuacuagagauuucauguugcuauaguucacuuauaauuguacugaaaauaaaauguagcacauucuauaaaauaagaggaagcacuucuauauuaaaaucuuuuuuaugaguaacauaauuuauguauaugugaucuauuuucuaaaaauuucagagcaauuauuagcaauggguugcuuagaaucaaugauuaugguagcacuauguugcuuguaaacacauuuagacauaauacaaucgagauuucauuauggauaaaauugccugaugauuuaauaaucugauauugcuucugcgaguuuucugaagauuagguucuauaaaacucaguagaugcuggaucccacauucuuugugucugugggugguuauugggucagaauuauugcagagcucaaacauuuuuaugugaagcagcugauaugaaaaaagguuuugaccagauaaauaaaaucucccucucagucucaggaggauuaaguacuuagcugcuugcagaaacauuaaaaaauagcucuuccuucuucuguguuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuuguauuuuuaguagagacgggguuucaccguuuuagccgggauggccucgaucucccgaccucgugauccgcccgccucggccucccaaagugcugggauuacaggcgugagccaccgcgcccggcccuucuguguuuuuuauuugacuuuucuucucauaauccuugcugcuuuccaucuuggaagcuuuuugcuugugacuaaaucuuuacauuuucuucacuuuagguucuuacuguggccuucuuuuugugugugugugugugugugugugugugugugugugugugggagggugggggggauuuguucaaaguagaaguuuuucaagugccaggguucauucuucagcuugaggugauucccugcucccucauaaacugucuaugcagcagucacgcacaagauaugcuugcuuuugugaaugugcccucaucacugguuuacucgcacguuuuuaccaugaaaaaaucgugccuccgagaugugcaccgugggggcugccugcggguguagggaggcacuauggaugggcugcagaacugcuggguacagagggcacaggcugugccacucagaggggcugcuguggcuguggggcuuugucccaucugcagacaccucugggcaccaggcuuuugugagucucagacacaucaucauccagugcuucuuuuaaguaguuggcaucagcuucauuagguacuuuuacuuaaguuggacuguuacaagguagacgugaaggaaugcaacaguauccccaagacacaaaauccuucucuguuccuuuggggcugguguuagguguuggugguagcuuaaggcugauacgugaagagaaguuaugugaggcagcagggcugugggauuggcucccuuuccccaggagggaggccucuggagcuuggagcucuuuucuagaggugccuggcacccucuuucuaggcugcagcucucuaccaguacuacaugguagaucgcuggaggcauugggcucucaucugguguuuuguggauggcuucuguggaaaguggcgagaugaauuuaaguccugaaauggugaaacaccagugacuuugaggguugauuggcaguggcacuuccucauauuuaauacugucacuuccccuuuccaccucaacacagggccugucaugacacuguauuccucaagaaccacauuuaccuggugaugauagcguaacauaugauagggcagcacaaugguagcacaggcugcaggauuaaaccuccugaguucauuccugauucagucgcauaaucuuuccgagcuuuaguuucuucgacuguaaaaugggauaaaaauagugacuacuuaauaggguuacugugacgagaaagauaaucuauagacagaguuuugaauaguauauguugcauaguaacguacucuuccucuucaacucagcccucuuccuguagguaauaaugucucaguuggaauacauuuuuuccuucuuucauuguauuugccauauucauacauauguaugaaaacauaaguguaauaaacagcugaugucugcauuuagauuauauccacucucuucucuagcuucuuuuaugguaugagauugggacugaccuguuuuuggaaaugacaggggccuaaaauucagaguugcauucuguguaacaggugcucuuuuuuuuuuuuaaaucauggcaugagcuggauuuucuagguaggguagagaagguuuguagguaggauuccauggagcgggaaaaguaguuuucuuguuccaguggcagcaguccucccucuccucucaccuuuaugugggagcagggugaguuuuguuucauuacguaggauaagaaagaagcaccuagauaauuaauuagauucagugagaccaggaaaggagagaguugggcuauguucucacguggcucagauaauggagcuugaaccgugcugggcacugguaagccugucucugcugccaggugacaacugagcucauugcagcagaacaucuucugggguuucuuuggcacgggacagugguguuaugaguuacauuucagaauuguugggaaaaauaauacuuuccccaucuccaauaccauuuuagcauccauaacauggcaaagcuaaucaguggugaaagguaucagaagagugauuauuacugaggugggaguaggggaugggcaggggauggucuagguuagggaugagggagcgcucuugggugaugaaauaauaggggcauggacaauuauccauagcaccauuauuccuagugcccaaauuggaaaugaccaaaugucuguuggcugaugaauaaauaagcaagugugauauauuuuauguaauggaagauuauucagccauaaaaggaagugaaguacuggcacaugcuacaaccugggugaacuuugaaaaguuuaugcuaaguggaagaauucaguaacaaaagaucauacuuuauaugauucuauuaauauuaaauauccauuauaacaaaucuguagagacagaagauaaaucagggguuuucuuagggcugggaugaaugaggggcuuggggaugacagcuaaagggugaggggguuucuuuuugaggugauaaaauguucuaaaauuaauugugauaguugcauaacuuugugauauacuaaaaaccaacaaauuguacacuuuaaaugagugaauuuuaugguaugugaauuacauuucaauaaaguuguuacugaaaauaaaauacuuuaaaaaacacuauauguauauacagauauuuguccaaagaaacaaaauacuacaaauguagcuauuacuguuucagucucuucucccucccagagauaaguaauuuucugagguugauauauuuaauaaauauauuucuuccuuagauuuuuaucauaaaaaaagaaaauaggggcaugggauauacagguauaugcauuugucaaaacagaucaaacuguacauuuauuaucugagcauuuuauuauauguacauuauaucucaaagaaaauauaaguuguauuagggucaguaggauaauuaaaaaugugguuuuacaacuuuuauuaucagagcuagcagagaauacaggcucugaaugugaacauacagcauuugcuaaauacuuuggcaauaugugucaaggagaaacauugcuucaguggccaaauccuaugaguauuuuuauauuacuuugcagcaacugaaagaauuuaaagauauaaggggucuauccuauugggugcugcuggguuagaaacauuuuaagaucagauaauccaaaacaaauauauuauauuauuccauuugaaggagugagcaauaaguuuuauaauuuuuguaucggauagauacuuuuuuaaaaaagaaacaacacuacauuuuucuucacuuuuucuguagaccaugggauauuuuguguugcuuuggugauuguaaaaaaaaagucuuuaaucuaaaaaauagaaacaggguaaauacauuuaaaauucuuuuuuaaaggcucaggcuuauuuaugcgaguuauuuuaauuauacuuaaaaaugcacucacucuaacauacauauauuugaauaauucuuuuaacagaaguuuuacugugaaauggacugugcuuaauugaauguuuucuaggugcuaggaaaaaauaauuugaugaauaucaccaacucuuuaccaacaagaauucaugauauagccugccaagcauguauuaucaaaguuucuguagcuguagcuuuaacaaugucaguuauuauaugauuuuuauauguaacuccaguaaugcaaguuauuaaaauauaagaauauauagcuugauagcuaauaugaacaaauuuacuugaauaaccugaagauaccuucaauuaaaauguaauagcuuugaguauggauuguuugauuuaauucaagugccagcaagccacauccuauuuaggaaagucuuuuaaacguuuccugaaaaagcacuauuaaaggauuaaguaaugaaucugguggaacucuuuuugguagugcucugauaucaagacuuuuuuucuuuguuuuuuaaugggaaauauauuuuaauuguauucauaauuuaggaagucuuauuuuuacaaaauauuauauguuuccuaccuugcagauaacccaggaggcuggagaauucaugaucacuuucccauauggcuaccaugcugguuuuaaucaugguuucaacugugcagaaucuacaaauuuugcuacugucagauggauugacuauggaaaaguugccaaauugguaagcuaugccucaaaaauaaagcaaaaauuaaauguguauucugguuauuuuaguaggaacccuacgauccugugcagcauuuauuuauucuuccucacuggcgccaugugccucucaccacagcaauucacuucaggcucgauacauuuauuuuacauagccaauauuaccaauuuuagcugaauuugucuguuuugagauuaauguggagcaauuuacccugauagguaauuugaugcgacguguguuugcuuuuuaucuugaggccuccaguugguguuuugcaagauuuuccaguggcaucauguggcuccauguuagguagacucagaucucucccuguuugcgaucaguuuguggcuuagaaaacagcacuuuacagaagggagugucugauaaaauuguagcaagagauggagggagguugguaggaggaaaugauuaaaacugcccuuagugcagaaaugaaauucuugaaaguaaucauguagaacacauuuuaacaggaaauacauauucauguuaaauuugguauaaaauuuugcaucuccugcccaguguauuuaauuuagcucacauaguggguauuuucuuucacaggcaauaacuucuauuaaauuuaauuacuuucccccugugguguuaaauagaagacaucuucaaagugauggugguuucuauuagguuugcuuccuuuccuguggcuuuuaagggaaaggugcaggcuggcagagggcagcuucuaaauaaaacuguguguuuuacagaggauguaaaguugacguagauuuagcagaaaaugauaaauaaagcguauguggucuuauuuuggccauugcauggcucaacugaauaucauucauucuacacugauaaaacuuacauguggagccaucaggugaacguagacagaaguauauuuaggggagacaacucuuaguuuaauuuaccuguguauuuagaaaauugcauaauauauuaaaagauaaauaaaauauagcccuuuggcagcccaggagucauucgaauacauucuugacauaaaggaaagccccugguauuagaagacuuuuucuguucuaaguaauuucuguuuaugcugaguaauucagaaaggaacagaacuguacuacuacuucacauuguacauccuguguauucuaagaacucaguguguguacuuuggccaaccacugcauugcuuuuguggaaauguaaugcuugcaucugccuugaagcagugucuuggccacgagguuauaacaaggucuguuauuuuauaguuugcaccuuuacuuacagauauaagucagcuauuacagcuguucagagucaccacaaauauugauucuuguuuaauacaggucucagaaguagccuaugauauuggccagaauaggacauuccagccuuggggagaagcuaaacuaccauguacauuggaguugcauuuccacauuuccauguggaaguagaguggguguggaguggaaggaagagaggcugguagugcuccucucugaaaucccagcugacagagcccaucacaguugugggaaugugaaguguugcacugugguggaggaggcuggaucugacaaccaaguuuucuucucuggcuagccauguaacauuaggaaagucauuuauucuucauauauaaauuagaaauaccucucuacccuauggguuagagaaaagaacuuagguaugugacuaucuguuuauucaguuuaguaagggcuaugacuguuuuguuugguucuggguacaaaauauucagugcuacaaugcaguuuuggccagcuaauuaaaaauugcucuaacugaauguauuugagauuuuuucaguguuauggccaccccuuacuuccuuuggccaggugaugucaucugagaauauauuaguugucucuugcugcuguagcaaauuaccacaaacuuuguguuuagaacaauagccauuuauuaucucaugguucuguagguaauaggccuagcauuggucucaccaguuaaaugucaagauguuugcaggauugcauuucuuacugagacucuggggaagaauucauuuccuugcuccuuuggguuguuggcugaauucacuuccucacaguuguaagacuaaacguucauauuuguugcugacugugaaccagaggcuggacuuuucuccuagaagccucucucuaguccuccuguguaguuccugcauuucagagcaggcaauccgcaaaaucccacgugucaugcaagauagcgcauucaaagaucucugggauuaggaugaggacaucuuuguugggggugcaggaggggaagcaucugccuacuacuacaggggguaccaauuuaucauugacauauuuagaaucugcuuugggcuggggcaguagcucaugccuauaacuagcacuuugggaggcugaggcaggaggauugcuagaggccaggaauucaagacuagucuuagcaacagagugagaucuugucucuacaaaaaauaaaaacaaaaauuaagaaaaaagaauauuuugaguuauguaaccaauuuuaguuauuuugcauaaaaacaggaaaauaacuuuauaaagagauaguuucgaauguuucacuaaaauaucaugugcuuucuuaauuuauaccaucaauacuaauauuuucaugucuauucuuggauaauaaauuaccuuacauuauaguaagcugaguuagcauuuuuuuuacccagauuuugguaucuuuaaucaguuauuugacacauauuuuugaucuccaagucugauucuuuagguaaccuuaugaauuuacuguguugcauguauauguaguuucuaaucccuggcaaauuugugcacugggcauacauuuauguguuuuccuggaaacugauguguagugaauugcacuaaaaagacuuuuagcauugaggaugcccauauuugucuuaauucuuugucuucaucaguuuguucuaaaugguaacuauaaaaaagucauuguucauaagugauuaugaacaauacuuuuauaauuacuaugaaaauaugagcacuuuuucauaaugaggcauugguggugaugccaccugcuuuaccugucacaugggguuuauugaauguguauaaguaucugauaaauuauuuguuguacagcauuaaauaagcaaaauagugcagaguguggggucugcauacauuauaugugcauauauguaaucacaaacacuaugaaauauauauauauauauaaaaauauaauuuuguguaauacaaaccaguauuuuuaauuaggugacucagaaaagagcuguuagagaaggcaauuuguuuuuuaauuaaaaaaaaaaaguagguuuugaaaagauaaccucauguuccccaguagggaccuuuugaucauaagucaacaggcuuugucauuagggaccuuuucagaugucucagauggcugguagaagggggagaaguucuacuuauggagacuaggcuuaucugcugugugccaggcaucauguauguuucuaugaauucaucacucgugagucauuguucuaugagaacaggggugagaguagaguugacacugggagggguucaaggucugcuuccuuugcuguuggcuacuugacuucuucuggugucccuggagcaggacuggagagggggcuccuguggcuuucaucggaaucuguuacugaccuauugauaugugauaguuguucaauaaaucuuccuggcucuuaagauuuggguacauuugauuagaaauuucauuauuuguguaaagcucagauacacuuccaaauuuuagcaaauuccuggauguuugauauucucagcugaauuauuguauuuaggagaggugucugucccugugcguaaauucucuguuuuuucaguccuucaguccagauggucuuuuuucacaguauccauccaaacugccucaucucucaaacagacuuuuuuuguguguguauggauuguguagaagaucuggggaaaauaggcagaggagagagugaagggacauuuaccuuuuaguuuugguagcugcuuaguuugaccaucccuguuucuaauauucucugauaauggcccaggccuuaccauucuccucucauuucugucuuugcuuguguuuucccucaaugaggaucauucugcucucuugucuuaacuugcaaaauauagcauagccaaauccuguaagaugcuccagaacaaaagggccuugcauuuagcaggaacaacugaccuaagaaggcaguuguguaauuuucccccauuucucuaaucaaagacaagaucauuacugaaaaaaauugagagugauguuucagguagucacauguucauuugcugcugaugggcagaggucagauuuggugagugcccagugaguuccuccugugcuacauguguguacaaagaagaaaaacauauauauugucuucaaggagcuuucagaaagaacagaggggcuuuuaauaaaacuccacuugcaaaguuguaguauuaauggaacguaacaucuaguucuuuguuuuaggaaucuuuguagcuuugaauguuggcauaacagagugaaaugcaauuauuuuuucuugauagagauuuaaaaauacuucaacagcucguuuagcaguugaaauaagacauuugugcauauuugagcugacuguuuucuguuucuggagcauucuuuccuucugugguggaaugaaguccgugauuacucugugcagcugcugccgugacacucacaggucugcuuccuggccagguuggaucaaagcgccggccggcagguuguauuucauuuuuccguuugcugggaugaagugcaguuguuugauguuagguuugauggauuuguuugccacugcauucauuagcuucacaucaaaaaacugacaggcuguuaaaugaaacuuuggcuuagauuuucagcuugacuguuuggagacauuugugaagauauuuuguguuuguguuucagcagccucaagcacuaugauugucucgaagggaagaaaaguuauuuacuguacugauuuucuugaguaaaaaagaaucauugucuuggggacagucauaucucguuuauaccgucugaagcaguguauuuauuacagugugugcagugaaagagacuuacugugucagaauaaauauuaucuuauuggaaggaaagguaauaguuggugacacaaaaaugauaucuuuuauuuuaauuuuaagugaucauauuaacaugauaugucagaaaguugaaaaacuguacugcagagcugggaauguucucuuauaaacuccaggaguacuaccuuacuaucuaauuuuaagacauuuugauacuugaauccucaaauguuugaacaaguuuaaaaagagaugauagaauuuuaaaacugauuucccuuuaaucuggcagggguuucaacuauuaaauugucuagcauguaagugccaugauguggguucauucuauuuuauauuucaauucucuaaaauuaaguuagauauuucuuaaaucugguagcauccuuccagaaaaucuuuaaucuugggcagucuuuauuaaaacaaucagggaucauuuuuguggugagucucuagguuauauuuuaauaugcuuuugaucacaaaauacuaguauagugauauuucucuguuccugugacaugugaaggaaagaaaauguagacugcuuugaguauuguucauuuuaacaguucuuggcauuucaauuuuaagugucugacaugacauauauaauaugaacuuagugaguauggggauuuuauguucugcauuuuuuuuuuuuuuaccucuacuuuuugcuguuucugauuccuagguucugaugguacaguguaacagagcugaugaguaguuuugcugcgcucuuuuauuuuuuugcuuuacuuuuaagagcaucuauagguucacagcaaaauucagaggaaaguauagagauuccccauauuccccuucuccccacaugugcauagccccccacauuaucaauauccuuaaccagagaggugcauuuguuacaaauaaagaaccuacaaugaugcaucauuaucccccaauguccauaguuuuuuuuaaacuuuuauuuuuuaaggaaacccaggcaaccagaccaaaguccguaguuuacauuagggcucacucuggguguuguacauucaguggguuugaacaaauauacaaugacaggcaucugacauuguaguaucauacagagugguuucacugcccuaugaguccucugugccuuuuccauggggguguguguguguguguguguguguguguuuaacuugcuagcucaugagaaaccucuaccucuggagagaguguucacacaucuggaagaaguauuaagagauaugaagaacauagucacauuauguccucuuuuuauacugaaaaaauauugaguugugggauucaggauaucugaaacuucaagaagucugagacuucagguaugaugguaucaaaccaguugguuaguauauauugcugaagucuggagcuagggagccugauuucauuuguuguuaacuugcauuugcugcauuaugggauuugaaaggaagugauaagccucaugaugcugauguuuaguucuuaaccugaaaucaaggcauuaucugcuuuugagucuauaguuugucaguaccuuaaaagaaaguaaauuugccuuuugaauaacuucuauacucuauugagaauuaguuuguuuuuaauucagucuaguuucuuguaguuaaauacaauaguaauaauauuugacauugucuccaauaugucagaucgagcucugggcacuagacacaucuuauuuuucuugaucagugaugaugcacauucagagauaauugcuuucuguccuauacuggcccccuuuuuacaaugugucauuuucagggugguccuauaucuuacguugaauuggagggaguuugggaugaagaagaaaauagggcagugaggcccggcuuagauguagguuugcccccaauguccuguacccuucuggacucauuuuucuagguguaauggcuuaaauaagcgccagccacgugugugauuugugggaucacucucaagauucuugaagauucagaauggucuugucccaugaaagcuguagcugaugucaccaccaaguggcuuuggacucuaucucacaauugguugaguuuggauuccuaaagucaguggagccaggggcaugguggcauacgccugucaucccagcacuuugggagggugaggugggaggacugcuugagcccaggaguucaagguuacagugagccgugaucacaccacugcacuccagccugggcaacaaugcaagaccugucucaaaacacaaagagaagccaauggacauguuauuuuggauucgucuucucugucgauaaaccuacaugugaauuccuuuuuagucuguagugcaaccgucguuaacucugaggcuuugacuuugcucuuugauuaaggcgguaggggugagagcaaagguuuucuaccuucucuuucauuuuaucaaguguguguggggaaguucugaggcaucugucuggauaaaaggacuuguguauagagaaugaggucaaaguuaagggccaccuaucucaauguauguuuguaugauuaucaggggccaaauuuuaguguagcacuuuugaagcuuuaggauucuuuuuuuuuuuaaugccuuaguuuggacuuuuccauauuuuuucaguguuuauaauaguaaacacauaggaaaaauuuuuacuaaaggcucuauucuagacauggugacugcagaagaaggcaaaaguugguaguguguuuucuggcucaugauuacccagaagagaaagcagugggcagaacaugaggugacguuugagagaagcaggcuggccaaccccuggagggaaggagggacuggugggagagucagcagggcccugggcaccccccagaguuugccauagucagaugcccuggcuucccacagcuucucauccaugcaggcuuuccugcacuuccaccccugcagguucugcugaggugacacacagugguuuaucucaaaagggcucuuaccucacauaagggauugucagauaugugcuccuaggguugguguagcagcucagcaaccucaugaggucucaugcaguuccuguccuucagauucacugucucugggcaggcuugucuugauagcugugcuuacuucagacaucuugcugccaagggcaggaagcgagacagugugagaacuaggcucaucuacccccauuugcgaggaaaaucuuuccuugaaacacacuugaaaacauccuuuuauguccuguggccaacuguuagaaaggcuggaaagguaacuggcgaguaacugguguuuuuagggaaaggggcucugccuguggagaagaaagaaaaagauggaagaaagaaggaaaaagauucauugacagaaucugccacaauaugugcuucugauaccucauuucgugacacauauuuacuuuuagcaccuauuauuuggugggcccugugcuguggcuaaaaaacuaaguaagacauguaguuucuguauaguggcgcuuacagacuucagucuauguucucagcucuguggaacauuauaaguauggaccccuggccccaccaaaaucaguaggauuagaauaucugaggauaagggacaaacauuugcauuucugaaaucuuccugugacucugguggaugcuguggguugagagccauggguuuuuagggaguuaaauuaggccuuuguuguuuggguugggguucuucugcaucuucuauuuuuuuccaccaguaugaauuuugaguuccaaaacauuaacuuaauaucuauuuauaaauuggagauguguaauguuuuguacauauaucauuuacagucucuuuucuccaagaauuaauagguguugugaacacauauagaauugugcccacauauuucaugaucaaguaaacaugcccaguaguacuuuuaaggggaggaagggagaguguuggaaaagaaauagaguagauguuaaagauaggaaugcacuguauauaccucuuucugaagagcuuaguaaauguccugauggcugucaggagugcacguaaaaaacccaacauaaucaccugggacuguguuggaauugucguucuguguggaauaguugugugaccuggggcaaaugacauguuucugugaggcuuaguuuuccuaccuguaaagagggcguucacuugugccucacagguugugaggaugcggguggugaugggagaacucgccuggcaccaugucccucuccccaaguacauauuuaggaagugacucauugugggucauuuuuaugucagggaacucccugaauauuaauuugggggaagacugguggaguucaggccugaggugcugagaaacagugucuguggggacaguguuugcaggguaagugucaacagcaggcugggcagauggauauuagauaguuuuacugacuucucacucgcauucagguguacuuuuuugcuaaaaugaaggcaguaugaaaagaagugccaauaacuaacaguggguuuuuguggaccagauugcugagagaaggaauuugaaggagcuguugcuuauaucuucagaaacacaguguagcucuugugccccuuguugaauuugaaaggccguguuuuguaaucccuuggaaaaaacaccauccuggaugguagagauuacugcuaagcuuugacuguauuucccacaucaguuucauauacuucagguuuuuugauucgauuaaaaaaacccaauuaguuucuauuaacuguuuaaaauuuucguaaaagguauuuuuguaaggccugauaaucauuuucauugauuuuuggcagcauauucccaguucuuaggaaugcauauucaggguuguccuuugauuuugaguguuaauuuuuuaaaaagaugacuguuuuguugauuauugaaauagcaugaaaacuuguuucuuugaagguaaauaaaauugaaacaguuuucaaacuuauauaaugauuucuuuucuuuuuuuaaaucauauuaguaaagauaauaagaaaaugcccaguccccaggagaauguaguugguagagugggcacuguguucucuuggcaggaauaugauuggaguaagcauccugaagagaaggugggcagugugcaucagucuugguaaacaucuucuugcgcuuuuaccauuuucucacacucuuaggaaaugagcagaaauguaggcaaaaggugauuguuguagugccaguuuuaucagugaaaauagaauuguaacuaaaauguccaaugauauaggaaucauugaauaaccaauuguguccauacacuguaauuuuuaaaaauuuuacagaaaagcauuggaaaggaaaucacuauggcuaauaauauuacuacccaaauauccauuguugaaauuuguaaaaauaaaaauauuuaauggcacccuuucuaguuuauuaaagguaaaaaacuguuaacaguucauuguauaucucuuaaaauaucagcauauaucuguaucuuuucgaaaaucuacacaauguuauucaagauccuauagauuauuuugccaugucuuuaauauaucauucuguucaauauaucuuucauuagccgggcgcgguggcucacgucuguaaucccagcacuuugagaggcugaggugggcagaucacuugagaucaggaguucaggaccagccuggcugacauggagaaaccucaugucugcgaaaaauacaaaaauuagcuggcauggugguggguacauguaaucccagcuacuugggaggcugaggcaggagaauugcuugaauuugggaggcagagguuguggugagcugacauugugccacugcacuccagccugggcaacagagugagacuccaucucaaaaaaaagaaaaaaaaaucuguaucuaugucuaucuauauauuuauaccuauaucuauauaugucuuucauuuacagcaaguaaaacauuucuggguuauagauacuuacuacaagaaaauuguuguagcguaucccaaaagaaugugacaggugguuugcaguggauuuuuuuuuuuuuuuugaggggcaucacagaaccacaguaguacauaagaguucauugcacagaucuuguuaacaaaucagaauguugaaaaugaacaccuuagcucauggcucuguuugcauucccugggugcagagcagaugguaggugggcuugugcuuggugcacggguccagucuugucuuuguugaugggcuguguccacaccugucaccucggcuuauuccacuacaguuaauacuggaagagauuuauaaugccuuugcaguuucuguuuuacugaaugacagcauuuauaacugggucuguauauuugaaggaauguauuuuuaagaaaaacuuuaauaaauuccuuuaguaaugccuuucucuggcaucauaaaggaguauuccagugaauuuggaagauacgagaggaaaaaguaacuaaacggcguuagucaacaguuuuguggcaaugggaaauuaaacugggaauaacacaaaagaaaaaaaaaccuagcuugguuucuaaguacgagccuaggcaaggagggcuacauuaaacaaaaaacaaacaaacaaaaaaauccucagcacaacaaaaugcuaacugcaauaaccauaaaggauacuauagauuuaaaacauuauuguccauuguugcagagagcagauggugcuuaaaauauccuuuaauuugaugugcuucuuaaaagagcaaacagccaaagaguauauaucaucuauauuaaaaaauuaaaugcaagcuuuucuauuuuugaggaugccauaguauauauaguuaacgaggaacaaauguaacaucaguaugccaacagggauacacauuggaggccgucuuggcaggagauugagggauagaugagggaaaagacuaugaagaaacacuucuaaacccugauuagcccuuguaugaaacucuucucgguuguauaauuuccccucaaacugacucuaccaaguguugauuguccugaaaugucuagauugccuuacaacuacagccauuaguuugggggaacauacuuagguauauggucauaauuuucagaaaacaugguuuccuccuuuagucuuugacauuuguuuagaauaucagagagguucuucugaauuugggugcuguauacacuuaugaccuucagaauuaaugcugaauccuaagcccuaaaaugauucuuuugagaaagcaugaccaagacuucguaacagauaacugccguucucagauuuguagguggguuuaacuauagcaggguaucuuaaauggcauuucuauaguguaggguccuugugaucaauuuauguugcuuuuugauccaguuacuauacagacauguuugcugguguuauugagauggaaggugucuggggcaaagcuaaaucagccugugacuucauucagccccucagacugaaaaaugugcugagcacagauucuccuucaauuccuauuacccuuuauuuuauguucacauugaggauccugccaguuagaguggccucuguguaaacgaagaaaaugauuuggaguucagauccauauuucugaaaguauccaggcuuugaguuguggagaaucuggagcccagauucaaaugacugaguaagugacgcauagcuacuuaccgagaaaauugggaagaugcaacacacucuguuuucaaagaaacauuuugagguuggaaaguauacagacauagaauuucaaagggcacaugucaaguuuaguuguagauuaacaugaugcuguguguguugauuucaugaugagagagcacuuuucccuuguuuuuuuucuccguuugcuuucuggaacugauggacaugauugcagauggugucagauuuguuuucuuagaaguaauuauuauuaagcauugaaguaaaugguacuucucguuuguggaaacuccacaggguaaaccucuccaggcaacacuauggaaggaauucucagcaucgugguauaccguuccuaaguaccuguuguugucucaauagagucuaugggcgaauugggagauuagugacuccaagucuucugccucaaugguuuugucucugaggcaaagggcugguacacugaccagagccucccaccucagccucccuaguagcugggacuacaggugcucccaccucagccuccugaguugcuaggacaacuacaggcacaugccgccaugacuggcuaauuuuuacauuuuuuguagagaugaagucuugcuuuuuugcccgggcuggucucgaacuccugggcucaagugauccucucguuucagccuccccaagugcuggaauuauaggugucagccacugugccaggcagguuugguuuuuaaaaauuucucuuuggguuacuaaaaguguuuggcauuacaugauuuuuguaguuauuugugcacaguuguagacucaagugaauuuuaaaaugaaauugccuuuaaauauuaguauggcaaaaaugaaaacagcauugcauaguauuguuuauuuauaugggugacguagauagguauuuuauuucaugggaacaaucuaagauuuaugauauggaucaaggauucuagaaacuauucucguaaccaguuuuaaacaaggucauuuauaacaccucugcccaauuuuacuauugugaaaauaugcuuacaagcauuaaaggauugacucaauagauuuuuagaaaaaucucugcuauacagcuguuaaaaacagcaggguguauguauugaugugauaaugaucuucaaaauauauuguuaugugacaaagaguaguuaaggaauacuucuuuagcaugaagcuguauuuuuaaaaagcaaucuuaaaaauauguaaauugaaugaaaaauaaaugaaagauaaacaugguuaaugcuauggccagaggaaugaacuugagauacagacaggcaaacccucaucuuuuaugcggucuacuucugugagguugacauucauuuauuuauuuuuuuugcaagucuauuuucauguauuauuuaaaauucaguaaaauuauuguuaaaguuuucaguaguaucuguacauguagagcucuggaccaaugucuaaaugcaucuuauagacacauagcagagauguuuuaaaauuuguuuccuccagaauauuuaacuuguagccaaaacuuuaggggaagaggguaguauaaauaugugucuuuacucauaggacuuuuucagcauuuaaagcauuacucuauaauuaauaauugauaucuaauuaagggacauuucacguugauucuaaaauggaaguaaacagcacuaauacaauuacuaacucaaaaugcuguugaaagaaguaaaguggaauucuguguugaaacuauauucagauaaaauggcguucuuuauuccuuguuguaaaaacagccugaaauuuuguauuggcuuuggcuauguauuuguuuaacauuuucauacaauuaaaagucacuauuagacuguaaauuguaucauggacuaugguacuuaaauauuaacauauuaaauuuucuacucaaagauucauagacaguguggaaaauucaccagcagaggacagugucgcuucauacauuuuuuuuccugcaaaguccuuuguaaggaauggauuuuccuuauaaccuugaccuagagucuuagaagauauuuauugguuacacauuuguaaucgguauguuuuauauugaagagaagaugauaaaaauggauguaacuuaauguaguaagggcuauuuauacuauuguuuauauucccuuuacauuaguuguuucuuaaaugaagugcccauuuuauguguaggaaguuugugcauuuaaccuaaaauaccaucaaguugaagugcugucuuuugugaaaugagguuauaauuuucuuccaaaucuauugcaaacuguuaauguguuuaaucucuacauguuacuuaguguagcugcugugcgaaguggguacagacaggcacacacaguacaaaaaugaaauagaauguauugggagggccuuacaagcugacaaguagcagugugugcaggucccccaccacucauucuuucacugagagaaugaggcuugaguggggcacaggugggaacgggcguccacggaaggaccccaccuggcccaacaugcuccauuuagccacggagaaucagggcagaacacaucccugugggaccaggugugacaagaucuucuuggggggaggauguagucuuuguagcacugacuuagcaaagaggccucuuuuugcuaaguuucugaggugggggguggggagguaccuagcuuaauuggggacauuaaguagauuuuagugguaaagagaggacauuuagucugccuggguuugaauccuagcauugucauuuacagguaauaucaucuugggcaauucaucuauaaauugggauaauaauaccaaauuggaacaauaaugauagguuaguuguaaugauuaaaucaaauaaugagaguaaacuccuggaguagugacugacacauggcauguaauaaacauuuuucuuucuacgagguauugauauuuauuaaccucuuaaaagcaauuuggacucccuuugucucuuauuguccugugacaguuaccaugagugcauucucccauuuuuguuuaccagaucugccccaggaacuuuuuaaaaaauugauuucuuucuuuugaaaauaaaacaaauaugugaaacauacugaaaaugcuaaaaccuacaugagaguauuagaaaguaaagaauguaauucuauaaucagcuacauauggauaggcagagagaggggucugcuucuuguccagcuguagcucugugcuaguggaagcauguccuggaguucacgauguggccaagagaacagauguaguuaggcaauggaggugggacagagagcugcaaagugcugcacuugccccucuuacuggacccaaaaggcucucaaguguaacaccuuucuguagugcuguagaucauuaaucugggugugugaugaccaucugaucuagcacauccaguggcauugugcauauugggauaggaauuugauuuugugaacucaagcuauucagcagggcccaugaaaaaucaccagaaggguaggugggucuuugccacugucugauguuucaaagauuucuuguauuaaaugcuguguccaaaauuauagaauacucuccaguuuguauuuauguaaaaaaaaaauaaaaauaagcuuucacucguauuuuuaacauggcagacuuuguaaaaacauuuaaugaaacaaguaaauauauacacuuauuuugaagucuuuaguauuuuagaguauauuugacagcaaaagagggugaggaaaaacaaauuuggauuucugucccgcuaaaaaauucuuaaaaaaauauuuaauguuaaauauauuagaagaaaauauaggggaguauuuauuugauccuugaguggagcaagacuuuugaagcggcacaucauugguggacaccaugaaagaagauuucacguauaucuuugaaaauugcaagcugaauagaaaaguauaugauagguaguggguuaauauccuuaauaaggugcauguccaaguaaucccuggaugucacuuaauagcaaguucgugagaaggaaaauaugguaaaauugaaauauuuugaagcugaauauaaaauguacuugaauauuuuaaaauaaaaccauguuuuaaggaaauuugauacaucugguaugcugcaugguuuuuaccuucagaugccaugagguuaugaguuacucuuuuuugccauuaggggucguuuuugggcaaguuugagaagcagcacuacauuaauauauaaagaaauucccauuuguaauucauuaaucuuuaaauggcuaaacuucauugaguccuuacuuugugucaggcauaaggcugaacuuacauuaacuuguuuaauuuuuacaacuguccuauagaauagauaauguuauuacccccaucuuauuagagaaaauuaaagcacugagaggcacaauugugggucccuccacaccaaaauuagaaaaacugggcaaaagacaggcaguucacuaaagcagaaauauagucagcaaauaacuacaaaacguaaauauaaucucauuaguagucauagaaaugcaaagagguuagugccauuucucaccucucagauuggugcagaagacaaauggaaauacucagugcaguuuuaaacuaugcaaauuaguacaccccagagcaugccaaggcaccagccuuagaaaugugugcccugugacccugcauccacaccugggaauuuguccuauggaaauaaucaguaguugcccaagaauguauuuauuuggauagucuucacaguguugauugugaaacugaaaaaauugauagcaaguaaauguugaacgcugcgggauaguugaauagaugaugguacauccagucaugauaugcuaauuagcauuaaaaaugauguggagguacguuuauugauauguguagauagauguuuguaauacacggucauggauuaaagaaagguuauagaauaggaucuuuucuuaguuugaaugcuuacuuguauuacaaauuauagaaagauguuuauuaaauuuuagcgucaucuuugcaggguuuuaauuugcuuaucuuuauuuuaaaauauuucuauagcaaccaguuaucacaugugcagugaaaaaaauaacagauuauuuuuuuaaaagggcuggcuuaaauuacuuaauuuacuuaaaauuauguauagcucuauuaauaaaaaacuuuuaugccaucacuuagaggaugagggaaaaaaaccuccaacuuuuaauauggaaguaaaaagacaagaagguagaaaaugaucagcgaugaggaaucugaaagauuagaguuuccauaauuugcuagauuugaggcuuuggauaaauuaccuguuucuagcuucaaacaggaguauaaauaucaauaauucuucagugugcguaauugcaucugauauuuguaaugaugacugugggcugucaagcuaguuaaugauuuugaugaauuacauaucccgauuaagaaaauaagcuaguacauuagugaauuuuagaaugaauaguguuaaauaguugaaauucaugccuguccuucaugauacauuucacuuccuaccucugcuagauaagucagaccuguuuaacaauguuagcacuuguauaaaauguucauauuuaguucaaaagggagaaauuugacuaaucuccuugaucucuaaaauaaguuauuauaucuaaaaacuuaauuaaauuauuguggucaugaagcuuuuguugacguauugcaaaggacauguuugugaacgugugugacccagcugaauguuucuggcucugcauaagaacaugggaggaggcuggugcuggggcucggggagguggcagggacugggcacuguugccugaggggguaaacaccccauguccuuuggauccugguucuggcuucuuaggucaugaggcccuucugcaggguugcuccccuacuuuugcccaggacuuggggcaguuugugagguuugugaggaagguggaaacccagugccaaaacuagaugguagccagaccaucugugaagguuucucccaggagguuggcacagaacgggaagauggcaggugaccuuaggaaagagguuuucucaaggugcaggcagagccagggaggggccuucauggugccuugcuguuucuggccagccuuauuuccugcccaccugccccuuccuccuuuccugccauucuaugcuucucugcauucuccuuuagcagcaaguugagcugcuccuccccagacuaacgaauacuugauaccaugcagcucagcuuugcugucacuucuugcagucaggacccuuaaccucuccccugugugauaaaguacugucuccuaggguuauucugaagacugcuggagaagauguacacaccaugcuggcauuccuugacaugcuucacauaggcgcuguucucugaggcaggguuccaggaagcucauaguccuggcauucauuguagaaugaaugaauacaaaugccucugccaaacacaguggauaaaaacagaaaugaucauuaauguaugugaauggaguagauugaaaguaaagaaaacccauguacaaauuguucauuguucuaucugaaggguaauaaauauacugggagagagagaauuuauauauuugcagcuuuaacuaauuuugguuuugcuauaguccaaaggcauuucugcuuagaaauguuuguaagguuguuucuuuccccaguaacuggauucuaaugaggauagcagguauuagugucugcugaacugaugguugcucccggagauguguugguauucccuauguguuaccauguguguuuuuuaauccuuuuuuuaacuacuuuugauaaagaaauaaggaaaagaauauuuuuuuucacuauuucuauuguugauauuucaagaauugugauauucuuggaguuuuucguaugguaccuuuucuauauuguuccaaaucagugggcauuuucaguauguugaggaauuuaacaaaaaauaaaaaauaaaaagcaaagaaaauacuggucguaucaguccucccuggaaucaguggaagugaaaacuaugacauacuugagacauaaccuugguuaaguaacgaugguuuuaguucuguguuugcagcuaaacaaauaaagcacuaguacuuauucugggauaaggaauuguccauuuucuuucuagauaauauaacuugauuauauuuuucaaaaaauuagcuacccagggauaugaaaugaaaaauaaaaaacccuuucauuaaaauguuuccuaguauuaaaauuuaaaugcaagcaaguugauuuaaaacaaguaauuagguaaucuugaaggauauggugaaacaaacccauuuguugugauguagugcaacauuuaaagaaucuaaugcacugucuuaggcucuaguuugcaaaaugggcuuuuaucauguguuuccuucuuuagcucauaccuugcgccagcuggugaagaauacguuucauguacagugcgcuucuccauugggauuugugagaggcaggcaaagggcuguuaccuauaccucuucucugaagggugggucaguggacuucacuuguccuccugcccuguugguggguguggcagagcccaaggggagucauuucagugacagccaaccuggcugccuuuccuuccuucuuaucaggaaagcuagcacaugggaaaaauuggacaguuucuacucuauuaugauaauccauauaagcagaaucacaaaauucccagaugacaauucaaacaguuacuauaaaaaguaauaagguguauuugacauccuuugaggccacacuaaugucagaguuucugauaguuuaugcgguuuuaauggacacauauuacuguuaauguagauggaagggauaguaugagaguugagagcagggaaugagcuaacagucaggguuuaagcacuccuuuaggagcaacugcacuuucugcguuucuuuuucaauucuguuccaucauccuuguuugcaguugaaagccugagacuguuauuuguuuacaacauaguacauuuuguauuuucccuuuuuuuugagacggaguuuugcgcuuauuguccaggcuggagugcaauggcguaaucucggcucaccgcaaccucugcuucccagguucaagcgauucuccugccucagccucccgaguagcugggauuacagccaugcgccaccauguucaguuaauauuguauuuuuuguagagacaggguuucuccguguuggucaggcuggucuugaacucccgaccucaggugaucugccugccucugacucccaaagugcugggauuacaggcugggcuuacaggcaugagccacugugccuggcccauauuuucccauuuuaauaaagcauugucuaagacaguaacagaugaguacaucauuuccuggcuacuuguaauaccguuaugauaugccacaugcuuuugguaagaucagugcuuauaaugaggggugcagagguauuggaccaauucaugagugccuuuugacauuaaaaaacauuagcauuguuuguauuuauuauuaugucugcuaugguuugaguauuggugucccuccacaauuagugaugaaacuuaaaccccaauacacuaguauuaagcaguggggccuguaguaaaugauuaggcauugagggcuccacgcccaugaaugggauuuguguucuaacaaaagggcuugaggaagcaaauucgccuuccccauuccuucuaucucuucugccaugugaggauacagaaacaaggcaccaucuuugaagcagagcaugggcccucgccagacaccaaaucugcuggcaccuuggucuuggacuuacuugccagccucuaaaacugugaacaguaaauuucuauuauuugugaauuaucuguaauuugcuuuguuaaagcugcccaaauguacuaagacagagucuuuuugauuuugcugucuaccuaucuuucucuauuuuaagaauuaaguguuggacuuauaaaaaggggcacaauuugaaauucucgaguuagucuuacugaaauuaacaugauaaaacguucuaaaucauagaauuuucuguggggugcuuuuuuaguuuggaaaaauuuuaaacuuccuuuacuacuucaaagauacuuuauuaauuugcuagaaugcagcucacccuauauugucuuauugguaaaaauaugcaagaagcacgugaucucuuucuacuguuuagguuuuacaaaacagguguucaugcaucuaccuaagagaguuuguuuuaggugcuucagauuuccugugagggguuuaggggguugcauaguaaagcauuagguaacaaaagaaaaugaccuuccucugaagcaaucauuuuugcuguauugucuucucacuacuacugugaugaacacuuggagaugccugccacuuugagguucgggguuacauuccauuuuaauucaaaagagauaaaaugauuguuacugucuagucauuaagaagucauuuuccuaauuguauuugacacauauuaugcuauucuacuggcaaaauuugauuauuuuuaacccuuaagagagauaacaaaaauacgggaaauaauccacuugacugucucaagaauaaagagacugcuuuuguuuuucuuuccucgaaugcuacaacaauuuguauauuccuuggaccuuauuggagccuuagucuugguggcuaugcccuguauccaagguauagccuucgaagaacaaggaaagggcuaguuuuacacuuccagcuuccuuuggaagcugccuguuaauagugaugacguuaucaagugucagguugcaguuugccaucauggaaggaccuaugcuggggcaugagaagcucgcaaagacuccuuuccagcacuugaauuaaugacaggcugggcuuuuaucacugacagaugcuguaaaauaguacaagguaaucaggguuauaggauggggggaauuuaauuccaacauggcaugaauuuggacagcuuugugagagacaucauauuugaccuggugaagauuggaugguguuuuggaaguauauauuuggaaggagagagucagcaaccugaguaaagaugggggcuagaugugguaagguguuuuugacagucacuucugagugauuugagguguaguguguuuagaaggguggguggagcugggcuaugaagugucuugaaaguuuuacagaguuauccggaccuuuuuuauucugagugauggggagccuaugagcauuuuaaagaagagguucaauauaaacuucugaaggacagugguaaaaauauaauguguuugcaauuuuaaugagaguuuuuuuuuuuuugaaacagggucuugcuuuaucacaagggcucaaaugauccuccugccacagccuuccgagcagcugggacuucuuaauuuguuuuuuuauagagacaggccucacuguguugcccuggcuggucucaagugauccuccugcauuggccucccaaagugcugggauuauaggagugagccacugugccuggcugauauuuuucuuuauuggcuaauucguuugaccagaugaaauucuuuuucuuuauccagcaaauauauauuaagcuuuaguuacaggcaagauaauuuauaugugugaauaaaauaugaauaaagccaguucuaacuuacaaagagauuuuagcaggauguuuuauuuuauuucuguuuuaagcauugaauguugcauacuuacuaagaggauuaugucuucuaaaauggaccuucuuguuuuuagaaauuuugaucaccuuugaauagguucuauuuuggcuaagcaacuuucaaagcaacagcacuguauuuuucugugcuugguggauggacaaauguuuguagauuagaguagaaacaucccaguuucauuaauuuuucucucugguuuuggggaaaugauacaaaguugaaugagggaaucugccuauucauauuccacccacgaagauuguugaggucauucuguuuuuuuuguuguuguuguucaagaguuaaaauaucguuuauauagguaugaauuauuuucauuggcaggagugaauuggagaaugugggaaguuaggcaugaauugcagggcugugggagagaugcucaggaaggaaaauggcuguugggcagccccugccucccuuacucagucuucuggucuuaauaugagcaccauauagguauccauauucucaguuucaggcaugccuuccucugaucuacaccaccugucucucaagcucuuuuucuccacuacccaaacuguagcaugcacuuggaccccaguaggguuuaaaauccauugauccuacuuuucaugguugcucacucaccucaacuucuuacuucccccuuucacugguuucuauugcaugauccaucauuguaaagauaccuuugguuucacaccuugccuuucuuucacuuuguuauacucaucuggcaaaaauccccaucuuguucaacuuagcuauuucucuugcuugucccuguguaucugaccauggcuggagauaagcaugcagccaucccauuuccuaucccuaaauucuaggacuccaaugaguuguucacgaugcccagcaguccagccauguugccgaguucguuggcucucccucucuccuccugucuccauccucauucuuugcugauugucuugcuucucaucucauugagaaaauagagaacuucugcagacugcacacagcacauuuuccuaccuaucagucccggugcccauacacuugaacucccauucuuuuaccugauugaauuguuuaugggucuaagugaggccacuugugcacuugaccccagccccucuugcaacuugaagaccauuguccaggcaucucaauucuucauucacugcaucaucacguuuuccuucuccacuagaucagucucaucagcauacaagcuguuauuucucccauuugaaaaauaucuucucuuuuuaaaaaauauaaacuuuuauuuuagguucagaggguagaugugcagguuuguuacauugguauauugugugaugcugagguuugggguacaauugaucucaucacccaggcagugaacauaguacccaaaagguagcuuuuuuuagccuuugccguacucccucucucauucugguaguccccagugucuacaguucccaucuuugugucaauguguauccaauguuuagcuucuacuuacaagugagaacaugugguauuugguuuuuuguucuuagguuaauuuucuuaggauaacggccuccaccugcaucuguguugcugcaaaggacaugauuuuauucuuuuuauggcugcauaguauuccaugacguguauguaccauauuuucuucauccagucuacuguggaugggcacuuagguuuaguccauguuuuugcuauugugaauagcacugugaugaauauagagugcaugugucuuuuugguagaaucauuucuuuucuuuuggguauauacccaucaauaggauugcugggucaguugguaggucuguuuuaaguucuuagagaaaucuccaaacagcuuuccauagugguugaauuaauuuacaucccuaccagcaguguauguguucccccuucucuacagccucacuagcauguauuauuuuuugacuuuuuaguaauaauaggaauucugacugguuugagaugguagcucauugugguuuugauuugcauuucucuaaugauuagugauguuuagcauuuuuucauaucuuuguuggccgcuuguauguaugucuucuuuugagaaggcucuguucauguccuuugcucacuuuuuuuuuuugagacagagucucacucuguugcccagacuggagcgcaguggcacagucuuagcucacugcaaccucugcugccuggguucaagcgauucuccugccucagccuuccgaguagcugggauuacaggcaacggccaccaugccuggcuaauuuuuguaguuuuuaguagagaugggguuucaccaucuuggccagacuggucuugaacucuugaccuugugauccaccugccuuggccucccaaagugcugggauuacaggugugagccaccacgcccagccuacucacuuuucauugggguuguuuuuugcuuguuguuuuaaguuucuuacagauucugaauuuucuuuuuccuucuuucuuucuuucuuucuuucuuuucuuucuuucuuucuuucuuucugucucucucucucucuuucuuucuuucuuucauugagauuuuggauauuagaccuuugucagauguauagugugcaaauauuaucucccauuauguaaggugucuguuuacuuuguugauaguuccuuuugcugugcagaagcuugaaaaaaaaaucuuaaucccucuuuccaucuuaccugcuaucccuuuucuuuguuuuucuauuuaacaauacuuugaaagaagaauugccuauauuucaucuuucaauuucaucugucugucugucugucuaucuaucuaucuaucuaucuaucuaucuaucuaucuaucuaucuaggauggaguuucacucuuguugcccaggcuggagugcaauggcgcgaucuuggcucccugcaaucuccgccucccggguucaagugauucucuugcuucagccuccggaguagcugggacuacaggcgugcaccaccaugccuggcuaauuuuguauuuuuaguagagaugggguuuaaccauguuggccagacuggucuugaacuccuggccucaggugauccaccugccuuggccccccaaagugcuaggauuauaggugugagccacugcaccuggccauauuuauuuuucuauucucucuuuaaauaccauagccuuuuaccuacuccaugcuaucagaacugcuuuugucaaagucaguggucauucauuguggaauugccugacaaguucuuccugccugcuacaaaggcaaaaucuguucacuaagucuguggcauugcaguaaagaaagaguuuaauugaugugaggccagcccaugcagaagaacuggaguugucacuccaaagccuuggagguuaggguuuuuauggacaauuuggugggcagggggcuagggaaugggugcuggugauuguuuggggaugaaaucauagggguguggaaagcaguccucaugugcugaguccacucaggaucaguugugccaugacucaugagucccauggggucagucugaaaaacaguucaaaaaagaaaauaaaaaaacagucuuagguuuuauaauagugauguuaucuguagaagcaauugggaagguucaagaccagccuggccaacaugguaagaccccaucucuacuaaacuacaaaaaaauuagcugggcuugguggugggcaccuguaaucccagcuacucaggagacugaggcaggagaaucacuugaaccggggaggugcagguugcagugagccgagaucguuccacugcacuccagccucagcaacagaacaagaaaaaaaaaauuaauuaaucaauauaaagaaauagaaacuuguauaucauccugacaaaauagguuauuggagguggaggggugaaagcggaauucuuuugaggaaauuaccagggagagugaaugaaaucagggaacagauuaauuuguacauuaucuugugaaagggucugaaggugugcuuacauucuuggucuugcacagagggaaagaaaaacauuuguucugcuuggugggucuggaucuuaggcagguaaaggaacuacuucaccuucuuugaaagggacuggggccaggaggaagucagagaggccuugagguuucuuccccugcaguaugucaaaauggcauguuuugagguaucaguuuucugagccccaacaccaaauuauauuauuuaaaaauucucaucuuacaugaccuccuggcagcacuugauaaaguuguuccuuuauuauuuuuuuaaaucggcuuuucuccuugcuuucugagaugguacacauuucuuguuuccgucugccuuacauggucuucccuucucggucaguuuuguugguuccuuuuucuuugauaccuucgagagcuuuagggcuuaguccucagguuucauuuucuugucuacacgaauuaccuuaugaucaaauucagucuugcaacuuuaaauauuaucuguaugcugauuacuaaugacuacuaaaauuuguaucuuuagccuggacuuuuccuuggaacccacaaacuccugccaugaaaucaaggcugauuacuucacacguccgcuuggauguugaugggcuucacaaacguuaacaagcccagaaagugcugucaaaagacuucuccaccucauuuaguggcaacucuguuucuccaguugcucaggccaaacacucugggagucaucacugcucacucgcuuucuguuuaaucacacacccaaucaauucuguuggcucuagaaucucugggaugcccacugcucaccacacucaccacuauuacucugguccaaccacuauaagucauuggccuggcuaugccaguggguuucacagucuuacuauuucucucuauucuuuauucggcagccagcaugacagcuuuaaaaccauuugucagauuguguauacuucugcucagaaucuccccuuccuagcuucccaucucgcuuccauuaaaauuuaauaugcuuaccauggugagcaaaugcuacgugaucacucccugccccaaccccuaccccccaucuuugacuucgaguuuuaccuccaugacccuugcccacucuguaccaacacaguaaggcacauuaaugcccuaggucccccagguuccaugauccuuuucccagaauaccccuccccaaucugcauggcucggucccucccuucucugaaguauuguucaaaugucaucuucucacugauaucauuucucaauuugaauuggaacccucuucacaaucccaagcucugugaaggggauuuugccuuauucacaccuguaugcccagugccuagcaccauaacuuguacauaguacacguucagcaaauauuugcugcaugaaugaaugaauguaugaugacagaaugaagcaugcagacuuuuaacuuacacaguuuagcccaaucuuagcugcugcugcuauguuuuugugaauuucuaucuaauuccuaucuuaauuuuuuguuuuaugcaauguuauaacacugaacauuucuaauuucuuuuaccuuugcccuuaugcagggcaugugcauaguacuaucaugguuauagucauaaggaaagccacccuguugcaagauuuccuaucacagguuucugauuacauuuacuguuuuuuucccccccauuaaaagaaguagaauuccuggaaauaguuggguaacaucuucagcaaucuuccaggcugugcauguuggcucacgccuguaaucccagcccuuugggaggcugagguuggaggauugcuugaguccagaaguuugagaucagucugggcaacacagggagagcccaucucuaccaaaaauacaaaaauuaguugaaugugguggcccgugccuguagucucaucuaccugggagacugaggugggagaaucaccugagccugggagauugagguugcagugaaccaugauugcaccacuguacuccagccuggguggcggagccagacccugucucaaaacagagaaauaaacagccuuccaacauauccucaagcaguuaacugacaaaugucacuaaguuucuuucacugucacuaauaauugaacuucagccagaaauucaggaagagaugcuuaucucucccucucugacucaagccacuuaaacugugcguuagcuacagaaauggaugcacauuagauuuguuuccaaagugauguuuccaaauuaacuuaaaaggcagugucacagggugaugucucaauaaauccucucauuucuuguuuugucauaugcuuuagauucuccucagguaugaauuuucuccccucuaaaucuauuuuauggguauuuauuugguaaagccuguuugauuuaauguuuuuacucuuuacggguuuguaaagcacugccuccuccccacuucaccugggggccgagauuaugguuauacaauagcucguuuguuacauaugcaaagcauuggaaucagacagauuuuuuuuuuuuuaaucuuaaaaaaauucugcaaagaauguugcacuguugcugcaugugacccucuuuucuggcuauugugacuaauaauugcacaaguaugguuuguaguugcaguuuccguuuaaauguuuuuuuuuccuuugagauacuucauuuauacugacuuuuuuucugaguggcuaucuuaugagcgcagcuugaauuuuaagauuaauaugaaugugcaucacuagugaauuguauucuuggauuuauuugaaugagugaaugacugaaugauuacaaugacagaaugaaggugcaaacuuuuacuuuccaugaauuccaagaauuguauucuuauuugccgagggaucaucaagagacagaacauagaauacccauacauuacaggcaaguucuucagagucuugugggguuugacaucugaacuaauggcuuguaauuaaugaccaaaaaauaagucauuaauauaauuccaucaaauggcucuuuaucuuguuuuguauguauguguguugucauuauuguuuguuugauuguuucaaaugcuuccugugucaaugacugcagaauccagucuucucuuuuugggggcagagaaccaagggggaccacugugucuucagcacauuggauuucaucuuuaucuguaagagaaaaaagcaggaaucugagaagagaccgaugcuuauggcugcugcagccuuucagguggggcaugggauucuucuuucccuccucagauauuuagaaauuucuugguaaguuuuuugaacaguucucagcaugucuuccucaggugccuuaggcgagacaauguuuacuucuuauaaagcucagauaugguaauccagaauccuuuuucuaauagcugcuggcuuuuucuuuuuuuaaaaaaaguuagcugugguuuuauauuuuaauacagaauaagaacauacuggagagagaaagugguuacugguugcaugugcuuuuuuguuuguuuaauccaucgugacagaugguguggacuaguuuaauauacugaacaguguuugugcuuguuaguugcaguuugugccuccaaguccacuuugcccuagucucuuaccugucugcccaggguugcagaucuguaugggccgccaccacaggcccccuuucccucuggcuucugguagagcccaggcaggaaauuacaagaggaggagagugagggcccagggcugcagcgcucuguuggacuugccucacaccauccucuguugcucuguccuuaguuuggggaauuacacucuucucuaguccuuuuaggacuagauuauugacaccucaguuguuagcuggccuggggcaccacucugucuauccucugguuuuucuguaccuugcccacgccaauucagucccuuaauuagaucuucucugauuauuccaacguugaauguuacacuuguguucugcugggguaccgaugcauaaugugucauccugggaaacuccuguggauuuugucugaggaguuuuuauuaaacacaaaaacuuaaaauguuuaaaguuauuuucccuguauauucuuuuuuuugguuucugcauuccacuuugcuauuaacaugaaaauaagacaggcuguccacuauauauuuuuuucaaugaauauuuggggugguggagcauuuuguuggucagaguacagccuuuaguucuaauaauaauguguucugacagugguuauuuuaaaacacguuuugguagaaguguugauguuuuguauuagugaaucuuaggcuuccuacuucugaaguucugaaaugaaccagguguauaagaaugaacauucaacgaaacaugcauccuuuuuaaaauuuagcuuucuaguacagaccaugcauuuuuccucuuugaacucuuucauggaugccaagcagugccucacuggaaguccuuaucaucgugcguaaacauccagggcugucacuguuggcgauacagcucaugugagagcuguggcagagcuucagacggaauaauuaugaacagcauuguaggagguaguuacuaugggaaaauauaauaauggaggucaaauaaaggagacacaagcuuucaucaguugggcgucuucauuuucuuuuggcgaagagaagcucaguucucuuuguaaauuaaaagcuuuuuuucuuuccuucccuuucccuuuccccuuccuccuuuccccuuuuccucuucccccuucccccucuccuccccucuuuucaaauaaggacauauucucaccaucuugcucaugcugcuuucaaucuccuggcaucaagcaguccucccaccuuggccucccgaaguucugguacaagugggagccaccaugccugggcagacccucaguucuaaaaccgucuuggcuuguuuaccaucagcccuucaccguuucagaaagaugcuguucggagaacuguaagggaauuuuccaauuaguucuguuuuucuuucuuuuuuucauuagcccucucagcugacaugugaguuacauaaacuuuuuaauugagauucauguguucaaaaucauguuuuaauuuuguuuuugguuuugugguagcuugauaugaugugguacuaccucuugugaaguuuaaaguuuguauuuuaugaaagggcauugggacgugaaaaaauucuguuuuuuaucuugagccgcagcuuagcuugggauauuaggauuagcagucacuggaguggaacguuuccaguggcuuccguaaaguacccuggauuccucuucccuggauuacuagagagcggcuuccgagcauagccgcugcgaacuguaaaagcuuguggucagugaacucaguuaagaaagugcuggcgauggugaaagucaagccccuuuagauggugguucuuucguggaccgggugccuucucuuugugagcagauuacccaguuuggcgucaaggggcuguuaggcauuccuucuuccaggaaaacauuuccugaggcuguaggacucaacugugagaggcaguugugaaggaggaaaaauaauguaagaauuaacugagguaauauaaggcguuugugaauagaaacaaguggagaagcaguuguagagagauaauuuguaaaaaaaaaaaaaaggaccaaaauaaaaaugaaugaaagggacacaugaggugaaaaguggaaucuuuguucugugagagcugguuuucauuuuuuugcucugaaaauauuuuguggccauauucaguuucuuuuugcauaauuaaaauuauaugauuggcuuauagcagcaagcaguuacagaauaaaaaugauuauuuccuccucagugagaauccgcucuuucuagucuuaaccucagacucuuauuucugccucauucuucacucuagcacgaguaaggaaggccgggugcuaagaacacauggugggaaaacaaacaaaugccuccaggcacugcuuaucacagcuaugguuuagagaaacggacauucagaaauccagcaacauugggguguguuuaguaguuuacagauuguuaaaagaaacucuugauguuuucauugaucugugaggcuccauauuauggggacuuauggcuuguaguucagcaguggaaaucuggcaauucuugacugcauuacuguccuuuaauuguugcuuauuuucuuauucauaaacaugucgaagcuauugguagaugcaauuaaauguauacauguucauuuaucuuaauuauuauuuauuagauggagggaaaauauauugauugggugacuauagcuuuuugguaaagccagcacagauuuuaaucauuguuaacagaagaaaauuaaccccuuagauucuauccuuucaaaaaaaauuuucuaucuaucuaucuaucuaucuaucuaucuaucuaucuaucuaucuaucuguuuuuugagacagagucucucuuuguugcccuggcuguagugcaguggcauggucuuggcucacugcaaccuccucuucccaggcucaagugauucuuaugccucagccuccugaguaguugggauuacaggcgcaugccaccaagccuagcuaauuuuuguguuuuuaguagagaugguguuuugccguguuggccaggcuagucucgaacuucgggccucaagucauccgccugccuuggcuucccaaagugcugggauuauaggugugagcuacugcgcccagccucuuuuuucuaacauuuauuccauauaguaacuguagcuucuauauuuuauaaugcuucugaucauguugaccuguggugauaauggaauugauaauaagugauguuaauuagaauaugagauguguaggacuugcuccccaaaagaagacccuuuccuuugaggagaucaucccucaucuacguagaggcuuccagggaccacacgaaacugcuggucucaguucugcucuugggagaaaucacaauaugccacuuuguuuuuucaucuacguaucaacccuccacacaagugaacaugucucucaguucccacccuguuagccuuguaagaagauuaaguucuuagacuuuuagcauugugucucaccaauuuccuugccccuucccacuucccauucuucucaaggcauucuaaucacuauuuugaucuggcuguuccacugaaacugcuguaaucauugaccuauacauuucccaaaacaaccaaccagucuguucucauuucauuugaacuuuugguaucauccuaccacuuuguccuucuugagaacauucuuaucuuggcucccacaccuuuacacuguuggaaagaguugcuguacucaccaucucuauuuucucaccacuuauuccuuuuuuagcccacuccaguugggcuaucaaacagcuuuuaucaaggucgucucuaggccaaaaccaggagucaguucuucauccucauguuacucaaccccucacccucuccauccuugcaacacauucuucucauaacacuauacucaccuuguuuucuuccagcuuuccagccguuauuucacagccuccuuuaccaggccuuccaguguuagagagccaaagagcucuguccugaacucgccccucuuucuuuaccuucuuuauguggucguuugucuuccuuauaccagaauguaagucucuugccagcaggcuuuaagucugucuuguuugugcauguaucucuuguccagaacagggcugagauauaguaggugcugcuugccugguuagacccuuugucauuccccuuauuacucggaucuguguauccuacuuccucgugguuucaccaagauuguagaggguaguucuauuaucacuucaaauguuacgucgguauccuggacuauaguauaucaccuauguccucuuuuuuuuuuuuaauaauaauggcaucaccuguuuguggcggaugaaagcuguggucuuugcuuuguuauugucgugcccguuauuuuuuaucgccuaugauuagucacuuugcuugcugcauucuuacccacucguuuuuguucaagccuucacuuuuuaacuaccuuggagguugauggcuaccccuuggcucugucuuccucuuuagugucagauuauucugcuaaugcagaacucugagguuucccuauggaaguagugugagcagggaaucccagcugccggcugcauguuugggacccucuacagcuuaucuguagccuguuuucuuguuuauggccccagcacuacccacacccuugugcuuuaguaaaaccaaguuaccuugcaccucguaccugugcugcuucaucuuccugcuuuccuuaugcuguugccaggaauaucuucuuuauccaaacacuacacuucaaggcuaucccaacugcuuccucuuuugugaagauuuaucuccucacccucagcuagaaguaaucucucucuacagugaaauucuuaguuaucuuuaccuuaauuuuagggcuuagaccuuucuuucuuguauuugcuuaugucuaauaucuguuauaggucauugaagacacauguuuagcuauagccuuuuguucaauaaaucuugaaggaaugaaagagacuugaagucauuuaaagaaacugagugcccuuuuacuauuuacucaacuauccugggugucauuccucuuuuaauuguguuuauucuuccauuuccaaauuaauaucagcuaacauuugagaguaaugcuuuacuuuucacaaagcaguguacacuuuauccuguuugacuuuuucuuuuuuuuuuuuuuuuuuuggcaacaauucaguaaggaaggacaguguauguaaaugauaaaauaagguagaaauuguggugcagaggcugguugguuagguaagugcuacucuuccccagucacuggucuguccuaauggguagacucuuuuuagcagcccaguuuuauugaggaggaaacugaaacucaugaauugucugguugaggucacucugcuggagucccagucaggauugcaauccggguguauuugaccccaacuucuugguaugugcaagcagaaaggauacuuuugugggugccaaaauagaauauuaaaaaguucaucuucccuguuuugaaaaaaguuugaaggcuucuuucaaauguuuucucuaguuuuugaggaucaaaauagacgauuucuacaacccucugccaauucuuucuuuuauggcucauaagaagucucauuacuaaaaugucauuaauuuuauugaucccuuaaggauguuacucacuguugaugaguccugagggucuuugggauauuagucucauuuuaacucuuacugguguaauuggaugaaugugaugcauuugauuuaauugguuuuaguuuggcagaggagaaagacacacuccuuggugcuaugcuaagugucucuaucgccuaagauucccugcagaaauuaaauuauuagcagucagcaguucucaagaucuacuagaggucagauucagccacugaugggaacuacuccaggguggccacagguagguuuuuuggauauguauguugaauuuucacauucucagaauaacgcugccccauucugacacuauuucacugacuugucaacaugaguuguuucuguaaguuucucuagaaucuuuuuauagaacuccacuuauuuuguaaugagcaccuaauacagugaauauguggaaaauaaagcacgcguugaauuuaguggcaguuauuuaaaaaugucuuuugaaaaaaucugcauaccuuauacauaauauacaaaauauauaacauauguaucauaaauauguacauauauaauaugaauauauguguuauauauaacaacaguauguuauauauguuaucuauaacauguuauauauucauauguauauaauaaaacauguuauaauauauaacauauucauauguaauaugaauacauacuacauauaauaguacaauuaauauauaauauauuaauuauuaacauaucauaugauuauacuauuauuauaauauaauaauuauauuauuauguaucauauauaugauauucauguaucauucuuucauaccuuuucagcaaugaauguucuuuuguuguaaaagaguaacacccccuaaucuauuaguuccuuucaauuuagugcacaugagaaauaccuggggaauuugcaaaaaugcaggggcuuggucccacuccuuugcaucugcaguuugcaguaagcaccucagagaauucugauguaugggauccucugaguacaugcugaaauaugcaacugcauucuuaugcuucuuugccugugacugaugucuucuuuuaccaggauucaucaggagaacccuggcauuuacacagaguugccuaacuuguugccuccauaggcacuuggaacccucucucuucucaccccccccacacaaacacacuuuaugucuugaauucccucaguaacaagggcagcaugcauugcuggauacuccccuuguuuuucuaucuggagccccccagugugaaacuaccaucgccugacuuaucagcuaaaggaguguauacugaacaauauaauuuuaguaauaaauaaauugguuaacagugauacacaauaaauaaacuugcuagaguuaauuuuuuuuaggucacaguaauuugcuuauuaccucuucauuuagauaacaaggacauuuuauguacuuaaagaauggccaucaacuaaacacgcaugcaugaaaauuagucauuaguuuuguugggucuguggaugucaguaagcaauagucauauauauauauauuuuuuuuucauaagaaagggucuuguucuuucacccaggcuggagaacaguggugcaaucuuggcucacuguagccuccaucacccaagcucaaucaguccuuccaccucagccuccugaguagcugggacuacaggcaugugccaccacacccagcuaauuuuuguaguuuuuguagaguugggguuucaccauguugccuaggcuggucuugaacugcuggacucaagugauccacccgccuuagucucccaaaguguugggauuacaggcaugagccaccauccucagccagcaauagucauauacauuuggcagucuuauaugagaaaaauauuuacuguggagcuauauauaaaaacuauaucaaccuauuagagaauuguaauuaauugucuaaagguagcuguccaguugaaaagauauccuaagcaauaauauggucagugcccuggcugugcccugcaggguaaagagaggagugaggacagaaaaagugucagugauucaucagagaagugagcucauuugggccgugacuauugugagucacuuguuaucugcagaguacaaaugcuaugagaggccuugguguuugggguggggccagagggagaugauuagaaugucaucaggcauguacuucaugaaagagaaaguggcauuuggugcuggauuccaacagguguguagcuccacaugagcuguggucauguuccccuucagaacagaguggaagccggagugcagagggaggacuguguguagcauuccagugaccaagccgacucuccuguuucugcggcacagggauuauuaguuucaauuaggguuuggaucauauucuuagggccuugaaauggacuuugaggaagaaucuguaauccauaagcuuaguaaugcccccucccaccuuguugugggcccuugagaaaacuuuuguugaaaaaccauacauuugggucauagggagacugaaguuuagagagaugcuacaguguauacaauugaagcaaucauagcaguagcaguagcagcagccacuauucaaaccuuuucuaauuuaguccuuacagcuguuauuuggggaaggaggaaacugaggcaaagagguuaagugucucccccuggugcacagccaaagcagcagagccaaacugcaacccguguguggccauuucuacuccuucauugguucugaccccugggaugauuuugucucauaaaggacauuugaccacguuuaggggcauuuuuuugauugcaugaugggggaggugccaauggcaucagcggccucugccaaggguacugcaaaacaucguacaauacacagggcagccuccacuacaaaggauuauauggccccaaaauaucaaucauguagagauugaggaacucugcacuacugcacuuuguaaccaucuuucaugcauuaaguuuuccucuuugguguagagcuaauuuaagaaaaagcuguuuaucuuauugcugcuuuuuagguuguacaagcaaguguagggaguucauuuguacuucaucaguggugaaauaccaucucaaagaauuuuaauuccguaagaaguauguauugcauguaucagauaauacuauauuuaaaugacacaaaauagacuauagcauaaauugaaucagcuuuucuauuggacauucuggaauuuuucuaugggaacaauagguauaggauguuaacuuucaaaagccuuuaguagaaucugacagguaauuacaucuucagguucuaagccccuugguuuuuuaaauucugaaggugacauauuaugccuaagggaaagauaaauaccagcauuacuugccuaucugagauagauuuuagcuaucuacuacaugcacugcuuggugagggggcauaaccaucagugguugaaauaaaacagcauuaggaaagcaguggcuuggaccacauucagggucaacuuuccuuuuggaaaauagugauucugaugaugaacaguauucuuccccugggaaucuggcucugcaaaauuacuuucaggcugaauuugacauacaauuuaaaaaagaaugcuguguaauaauuaacuuuaaaaggacaaauaaaagccauuccaguaaaguuuaacuuguugguaauuugauaaguauuuacuuauguauaguucuaauacacauguaagacaguguguaaaucacaaauggaguaaguauuuuaguuaagaacauggagguuuggcaaugaaagauacugugagggcaaagauuuugguauggcuguuuuuagaguaaaugguuuuuuuugaauugcauuuuuuuccaggucuuccugauuuuuuauuuuuauuuauuuauuuuuuuuugagauggagucucacuuugucacccaggcugaagugcagcggugugaucuuggcucaugacaaucuccaccugcuggguucaagugauucuccugccauagccuccuguguagcuggaauuauaggugugccccaccaagccuggcuaauuuuuguacuuuuuguagagaugggguuucaccauguuggccaggcuggucuucuugaacuccugaucucaagugauccgccugccucagccucccaaagugcugggauuacaggugugagccauugcgccuggcccaggucuuccugauuguaaaaaaaaucacuguaaaaauuaaaguuggggcugggcgcggggucucacgccgguaauccuaucacuuugggaggcggaggcaggcugaucaugaagucaggagauugagacuauccuggcuaacauggugaaaaccugucuccacuaaaaaauaaaaaaauuagccguuugugcuggcggucccuguagucccagcuacuugggaggcugaggcaggagaauggcgugaacccgggaggcggagcuugcggugagcugagaucaugccaccgcacucgagacugggugacagagcaagaccccgccaaaaaaaaaaaaaauuggauaauuuuaucuaaaauuaaauaccaacuuauauccucucucuuuuuuuuugagauggagucucgcucugucaccaggcugccucagccuccugaguagcuaggacuacaggcacgcgccaccaugccuagcuaauuuuuguauuuuuaguagagaugggguuucaccauguuggccaggauggucucaaucucuugaccucgugauccgcccaccucggccucccaaagugcugagauugcaggcgugagccacugcgcccggcccacucuaauuuucauugagaacuuuaauuggauaugaacugauccuucuuuuuccaaaaaaauaagauuuuauuaccaagaugaggcaaaguuguuaauauucaggauuaaaaaauaauauuucuuuuuuuuuuuaaauuagguauaccagauuucuuuauucucaaccaugugugcacauacacucagauuuuuuucuuucaguagugauuuggcuuuuuguuaauaacaaugacacaaguuuuauguauaauuuaaauauuacaacggcuaaacugguuuuggggaaaauuuuccagaaauuuauuaaauacgaaguuccuuaacuacugacuuagaagaaugaguauuguuuaaccagggaaaaaguugucaaccaccaccagcuuuucuuccuacuguuuuuuagaauauaaaagauaauaucucaauuauuuuuuccucucucaucauuacuuacaaaaaucucaauaauuuaggcauauccuuggcauguucguaaaauuguuccauuaggcauucuauaauuauaaucauauuauuuuuaaucccuacucaucucaccuguaauuuucaaauguuugauuuuuauucaauuuuuauauccuguucacauauuuuuuagcuacaguaaaacaugauuuuucauguguauuuuuuuuucuuuuuuuuugagauggagucuugcucuguugcccaggcuggagugcaguggcaugaucucaguucacugcaaucucccaucucccaaguucaagagauucuccugccuuggccucccaaguagcugggauuacaggugcgcgccaccacgcccggcuaauuuuuuuuuuuuuugagauggauauugugccuauauuucuccuuucuaauuucucauuguaauauuucauaaccaaugucuuuucuuaacagaaucauccaaaacuucguuuuuauuaggaaguaugauacuucaaaauagagauuacaaaaagagccaugaguauguugcuuuaauguaugucuuuguaguuuguguuauguguuguuauugaacagcauuaaguuuuugcggggaauuuuucuugauagaaaauaaaaguccugauuuuugucaacaagaaacuuauauuccagauuuagggcuugaauuuuuugaagacaugaaaaguagaugaaagaauaauaaacaguaagaguuuuaaaaugucaucuucuuguuuaguaaaagcuauugaauuacauugucagaaaaguguacuuauguuuaauauuucacauauuuugcuuugaauuuuuacaaacaauuuuuuguaacuuauuuggcuuucaaauggaaacuagaauuauguagugccagaagguagcuugaauauauggaguuuauucaaauccuagagagaagggaaaaaauuccauaaacaaacaauauaaaaaaagauaucuugugauuucaggauauccagcuguuuguauguuucguuuuuaaacuucacugcuuacuaaaugagugauuuuacauauguuagaaagauacuaccccaugcagaacugcaugucuauuuuuaaaaauuauauaugcuaaaaucauggagauuugugggcauggguauacauguauacaaacaguauuacuuuacauauauuugauuugcuaaaaaaagaaugcauauauacauuuauagguaacaaaaacauuauugccauugaauauuucauuuuuucacuuuuuaauauagugaagucuuagucacuuuugaugguccaguaaauuagguaauacuauuuuaagauaaagugaaaauuucccaugagaaaucacucagcccauuuucaguuuugcuuuuccugguuuagguugaacgccauaucauucugaugaaugagaaugagccuucccauggcuauucuguucucuggaagccaguuuguagaaagguuccugugaaaacaauauuuugggagguacauaguguaguagguuaagagcacaggcuuuugaguaauagggaccuguugguaacucccauuuuugcuuccuaauaacuaugugcccuuagcuaaguaacuuaucuccucugugcuuuaguuuccuuagcuaagguaauaagaccuccccuacagagcuagaggaaggggaaugaaaagauuuuagcacagugccuagaacuuagcauugagaaaauauucauuaaauguguucuuuuauugacuugguuuuaguuacagauucuagacccauaucccuguaguuacauauaauauuuuggccauuuuauuguguagauuuuauguacauucuugccacuuuuaucagagaaaugacaagaaaggaaacaaguaaguuauuguagucaaucagaaagacuaaaacaauuuauagaugauaauuaaaauuuuaauauuuauuuuuaacauaagaaccucccgaagugcuaggauuacaggugugagccgccucacccagcgaguaauuaaaaauuuacucuccuuguucguuuuucuugcagaauugucauucacauuuaaaguuugaaauucugaagacagaaaaagcaaauuaaaauuuaaaaauagccaguggugaaagguaaauaguucauuggugcauggcagagccuucugcuuguuauauauaguaggguacuucuaaggaagguguuucucuugcagaguuacuuguugcaguuagguuuuguuuugggcauaaugccaaguauuuauucuuccuauguguaauauaguaggguauuuuuguguuuaaacaacaguuuuuauuguaaucuuacaucuuauuggauauuaaccucuuugauagcaaacaagccauucuuaccuguugugcacaugcugcucuagcaggcugggagucuucaccacaacacuagcuacauaauagaacauugcuuccugaggucugggaacacuguuuuuuucuucucuccuguggaauaaaugcuuuauauuuaauuuaauuuaauuuuuucagacagagucuugcucugucgccgaggcuggagugcaguggcaugaucuuggcucauugcaaccucugccucccggguucaagcaauuuuccugccccagccuccugaguagcugggacuacaugagugcgccacuguggccagcuaauuuuugaauuuuugguagcgauggggauucaccauguuggccaggcuggucucgaacuccugaccucaggugaucugcccuccuuggccucccaaagugcugggauuacagacaugagccaccguggccggccagaauaaauguuuaaaauuaaucauuuugucaguuacuuucaauauuuuacaaauugcuaacauauaucacauaaaugggacagaauaauuuaguacuaauuagauuugcaagguaugcuccagaucaccugcacugcccuccuccagccaauguuugcauguuugugugaaugaauguguauauaauauuuaauauauagauauauauuauaggaugaacauaaaacauauuuauauguuaugugcaauauguauuuguuaaauauauuuguguacacuuauucccaugguauaagccccauuuccaggggauggcucaugaugacccagagagugcagcucaguucuaaacuuuuuuaggaggaugaaaagaaauagucuuuuguucuccucuacaggaagcuaauauuuugcuccuacuguccaaacucuggaauaguaguauaacaguggcaaagaaugggaaaaugaaaaccgaccguaugaagcuguuuuuggaagauacucuaaaugggaacaaucuucuaagcucagcuggcuuuuuagucggugaagccaucuguuugguuuuucagccagcacucuuuucauucucccugauuuuuauagcuucccuugggaaaccacaagauuccaaaucacuccagcaaugcagagccuuuugaagaguuguguguggcuuagugguuugucagucuucuguuguguaacuucaaaugguuuuuacuucugcuaugcaaaucaugguuuuaggaauauuuggaaagagaagagucugaggagaguagaaagaugguaauuuuuuucuuauauaaauauuuauuuuucagauacacuaauaauaaaauauuauuguucuuucauagagguuaacuuacucauguuucauuuaugaggaaugcauagaccuguuacucaaagcaacauuguauuauauuuguuguucugucuguaguuucuaacauuauuagacaaaguucagugauguuaaagauuguaaacauuccuuaaagcagggguccccaaccccugagccacagaucuccugcuguguggcccaguuccuaacaggccacagacugcuugugguuagguuccaguggccuguuaggaacugggcugcaccauaggaggugagcuagcaagggcagcagguacagcugcuccccaucgcuggcauuacugccugagcuccaccuccugucagaucagcggugguauuagauucucauagagugugaacccuguugugaacugcacaugggagggaucuagguugcaugcuccucaugagaaucuaaugccugaugaucugucacugucucccauccccccgugagggcauggccuaguugcaggaaaacaagcucagggccgccacugauucuacauuauggugaguugugugauuauuucauuauauauuacaguguaauaauaauagaaauaaaguccacaauaaauguaacaugcuuaaaucauccccaaaccaccccacaccagauuugucagucccuggugccagaaagaauggggaccacugccuuaaagcaugcugggauuaugauuggauguagaguuggguguugauguuaaagguacuuauacuuuguuacagugguuaugguuacuuagagcuaucacauaguuacuuuagaauggauauuuuaaaauugaagaauaggcagcagucuguuucuaauuaaugauaggguuccuuguuuuaaaaguuaaacacuuugguaaggauacauuugaagauuaucacguggguggucagcaagugauuccgucccucucuuggcauuuauauauguuauuuauauugaauuacucuuggcagaggaaauaacugaaagucuaaguaaaaaacguuggcuuuauccuguggguagaaaccacuuuuuauuuuuacuuuuaccccaugugcuuuaaauccaauaaccaaccuaccuaccuaccuaccuuccuuccuuccuuccuuccuuccuuccuuccuuccuuccuuccuuccuuccuucuuuccuuccuucccuccuucccuccuucccuccuucucucucucucuuucuuuccuucuuuucuuucuuucuucuuucaacagggucccacucugucacccaggcuggagugcaguggugcaguauuggcuauugcaaccucuacuucccaggcucaagugauccuccugccucagccucccugguggcugggacuacaggcaugugccaucaugaccagcuaauuuuuguauuuuuuguagagagggaguuuugccauguugcccaggcuggucuugauuacaggugugagccacugugccuagcugagacaaucauuccugacuuucauguuauuagagcuucaaaaugugaacaauuauugcccgcuguugucacuaccuuggagaacaagaugaguauagcuuuuaaaaucuuugcgggaauugugucaacuuucauuuaauccaccucuauaaaaauaagaucuauaugcuaaaggauuaauaacagugcaaauugcuacuugaauauuaaaaauuuaaaaucauccacaaggcagagauauucuugaaagucauuacagcucuaagaugucauaauuuuauugaaagugggaaaaaaaacguagccaccauuuaaauauguaaguugucauuuuuguuacauuucacuagcauuguauuugaaccgaauauucauuuuuuacagcacguaaguauccauauaucauaagacauguaacuaccauauuccuuucccagaacuuuauuucauuaucauuuucauuuaauuuaggauaauguacccuugauucuaaaauauaugcucucugauaaagucuaauauacagcaucuauaagaaacuuaaauuuacaagaaaaaaacguaucauucuuuuuggcugcucuacauugggugagcuuuguguaauauuuguucuuuacuuaauaaugcaaccucaaaauauucacccuguuuagacugauucccucaugcuugagagaggaaggcaucucuuccuuuuuuuuuuuuuuggagaaagucuugccgugucauccagguuggagugcaguggcacaaucucagcucacugcaaccucugccucuuggguucaagcgauucuugugccucagccucccaagccaccaugcccagcuaauuuuuguauuuguggcagagauaggguuucaccacauuggcugggcuggucucaaacuccugaccucaagugaucugccggccucagccucccagaguucugggauuacggguguugggcuuuuuuucauauguuuauucacugcauguaugucuuuuggaaaaugucuguuuacauuugcccacuuuuaaugggguuguucuuuucuuguaaauuuguuucuuauagaugcuguauauuagacuuuaucagagagcauauauuuuagaaucaagugugcauuauccuaaauuaaaugaaaacaaauuaucagaacauaugauagaauaaugaagcauaacaacuaaaaaaaaccauauuacauuucagggccaaugaucuaauuuugcuuuuccucugacuguuaccaggagggcagggcaugcaugcagccaugugaacugagagugagagggaaauggaugagaugcuuaaugucagaucuaugccacugcccucaugcuugacguuguggcagccaagccagagauggccaugcgcuccuuaccacggucauucucagcugaaucuacaucacauucacccggaagccugggaguaaucuguaccuaggagucuguagggcaugaccagccugcagaugugagcaaguguguguguauguuucugugucugugucucucucucucuuguguguguguauaugugucuguguuuguauccuguggugccucacagugucuuagaaauauuugaauuacauuaauugccaguguuugaguaucacaagauuucacauaaccauauggauuuacauguugucuugaaaacuucagaugauuugaaacucuuuuaaaaagggcucuuuuaaaaaggguuccaauauaaauugguagagcaguuauugguagagcguauacuuucaucuuuguuauaauggguuugaccgcauuguguuugggugaaguagcagagcaauaacuuuaagauaaaacugguuucuuguaauuuauuaaacuuacccauguauuuggcucccuuuucccuuuuauuuuauuaugucuguuuuagccuuaucuauuucuuucucauguucuagcccucaaaguguguguguguguguguguguguguguguguguguguguuuaauccuccaagcuagaagucacucaagcuuccuggaaucuagguuguaagguacugaggccaauggcugccucuuugucuuuuuucuauuuuuucuauuuuuuuuuuuuuaauuuuguguuuuguuucuuuccaguacuguguugacgaggaagauggcagccucuuugauaugagauagggcucaucugcauguuacguguaguggcaugucacugcugccacugcucuucugcuaccaggauggcuugaaugcaauauaggcuguuccaugugugcuuucccuccguuaugaaacuucuuccugugggguuugugagcuaacugcaagucuuucuuuguuuuagggcuguggauucuguaauuauuacaauuguguacuuccuuaaauuaaggcuuucacguaguagugaucugccuuuccuuugacaguuuuaccuugauguuuuauauaaugaagcaaaacucaaggaauauagaaggaagcauagggggaguaaaggauagucuuaaaugcugagcagugguuaccucugugaucaaauuuauuauuauuauuuuuugagacggcuuuacucugucaccucggcugagugcaguggcaugaucacggccccuuguagccccaaccuccugguuucaaaugacccucccaccuuagccuccugaguagcuacgacuacagccaugugccaccuugcccgcauaauuuuuuuuaaguuuuuuguagagacgaggucuugccaugguucccuggcugucuggaacuccuggagucaagcaauccuccugccucagccucccaaaguuuugggauuguaaaggauuugugagguacugagccuggccucugauugaauuuuaacugauuuuuauucuuuuuuuucuuaccucuguuauucaaguuggaaacaauugaaugugauuuccuguuaacuacaaaaauauuuauagucauuuuuagagcauagauguuaaguaguuaauuuauuuucuguaaagauuuguaagucuuuugaagucauuaucauuugaggaaaauuauuuuacaaacuucgcauuucucuuuggauaaaacaccacuuuaaaauugcacaaauaagggccagguguaguggcucuugccuguaauccuggcacuucaggacgccuaguggggaggaucgccugagcccaggaguucuagaucagccuggguaacguuagcugagcaugguggcgugugccucugguccuggcuacuugggaggcugaggugggaagauugcuugagcccaggaggucaaaacugcagugagccauaauugccccacugcacuccagucugggcgacauagggaaaucuugucucaaaaaaaaaaaaaaagguugcacaaauaauuaucugccccaguggaaacacuuuagucugcugcuauagaauacuuuacugcauuguguagaagugggaauggaaggccuucugugucagaacaacugaaauguuugucaagaaugcagauuucugggccucacuugaauaaucauuaagccagaaucuuuuuuuacaggguccccagauguuucucaugcuugcuaaauucugagauucacuuugcuaugccuugcugccaggagaucagugucaaacuccagacagacuuuuaccuggauccuugcuaauuuucagucaugucgggccuauuuaaauguaaaaaugucauaauguauuccuucugguuagcuuaaauuuauauaucuuaaauggguuacauuagcuucauaauuuaaaagauagauuuugucgaauuauguguuggguuaggaaauccucuuaaaugaaauuaaauuaucugcaagcagagggugcuguugaauuggcaucugaauuuauuaucuuuauugauugaacauccuugcauuugaacuuaugccagauucagaaggccuaggcagugcaggaagugcuuaauauuacagugguaguuuauccuuuaauugucuggaagcugggguguuaaacucuguucuccaaauugcuuuucauuugcaggauuucaugcacaucaguucuggaauggcacuuccuuuuaauaguuugaguacauuguucaaaagagcugcagcaugucuuuuggugacucauuagauuuuggcucacaucuuuuugcuuucaucaccuaaauuaggguaugaucaaauacaugaaaacugcuguguauuuuggcacucauuuucauugugaaaguuaaauauauagguuacuuagggauaaaaauuuaacuugaauauucuuucuguaaauguccucuaaaauccaccagcaacacacuuuuugucaagguagagguuuuuuuuuuuuuuuuuuuuuugccucugugcaacaggggaaacagcacagcauagggaaccauugaucuuaggaagagcuuguuaguagauuucggcuugcuuagguauuguuaggggaaggguucaaagaagagugguuuugguuuggauuggaugcuggcagaaugugggggcaauuguaugaucugguaucuucauuuuagcuauacaacaaggggacuggagcaagcuaaaaguguaauuagcaaaaacaugggaguuacucaaauuagcuggaacuagagguguuggguuauuccugugguuuguauaguguucuuauuuuugcauguguuucaaugauuaugcagugaucuuguuuuugucuugcucuacauugugaucauccagggaccuuaugugaucuccuucucacucucuuucuugcucuacacagccacagacauaccuuccaccucuuacucacugcacgaacccguggacccgcacacauacucacgaaaaugcucacaugcucauaaaaaugcuuacacacaaggaagcuuguuuucucucucauuuuuuccuuguuagucaauugaucuuagguaaacaauaauauaacaugaauauaauuuaucuuuuuucuguuaccaccaguuucauccuuccuuugaaacaauuaacuaaaccaauuuuaccugucacccugguugugaaaauguauauauaaauauuauuuuggguagcauaaauucagagcaauuuguggauuauaaagcauuuaguaguagcauugauguauuuuuuguugauauuuauuugccuaaauguuuguaucuugaacucaugauuagggagaaaguguuguaagcuuaaauuaauuaauuuugacaaaaucaucuuuuaaguaggaucuacuugagaaaauuaaagauggggcuacuaaauuuauaaucugagaauuuaucaaaauagauggaauuuacuacuuagagauaauauuugugugaauuuaacuauauuuuagauuuuaaauaucauuuaaaaccaggauuuuacuacauauagacaauaguaacugauugagcuuggcuuuuaaucuaagguacuuauuaauauuuuucaagauaguggaaauaaucuuaacauguuaaggucuugaaucuuaugcaaaauguguuuuuaauguuugcuuaaacuuuuccuggucauggaagggacugggcugucuguacuuaauuccauagaaaucagaagcagcacaguuggaacucacagauuuuaugauauuuuauuugguccagaugucuuuucuauugguauuuuauggcaaaauuuauaccauucaaaugagaauucaguugugguaaaugaauguaaauuugcaugaauuccuugguaugaaaaauugaaugaguuauguccagucacuucauuugucauuagaugagaaugauccuaugguauugcuuguguaaucaaggggguuaguggaucauauggauuggagaugaaguaguugcaauugauacuauacauggagagauuuugacaaucuauauuuaaagaaauuaugcuuacugcauuuucugacuucgaaaguaagauauguaaagugggguucugcuaauauaucaauaccauauuuuaauuuuauuuuuuauuaauuauauagagauguaccugacacaccuccgugacauuuuucuuuacuuuuuguuccuaccuauuauugaucuccucuucacaucgcaguaauuuuguaauauuucugaagagaauauggcaaggugauucaguuuuugauuuauuuaacauauuuuuggagagcauuacuuauaguuuuaaaacauuucuuuuauugucacaacuugguauuuguaugccaugcagauuuuuaggauuguuauccacauuuaggguaaaucucuaccaaguuucugugauaugugaguuguaauauuuugagacuuuucaagguguuuguuuaugugcguguguuuauguugucugugugcauacacagugaauaauauuugaauauauugaauauacucugaguuuauaaucaguaugucacucauguucuuucuauaguucauuaugaauuuucuuuuacauuuuuuaaugccauuuuauguucaaucagcagaaaacuugucuuuuucacucuuuaauugaauuauuaaauaauucuaaaacauuauuuuuuguuuccuuuuuucuuuuguuuuugccuuuuuauuauuuauaaauuaaaauuuaucucuaaacucaaaauaaaugcaucucacuucauuugcuucuuggccagaucccaaauauuccagcagcuccucugaucccaacuggucuaagucauagugaagggaaggauuauuauggaagaggucaggggguguuuaacagaaucaaaugaaaaugucguacuuuuguaaauuaacaaaaacaaauauagccaugugaauacauuucuagguccuucccaguguaaucucugggagguguuuacauucacuugcgccaaauuucucugaagaaugucaccuuagaguuucuacaaccguacuucuguucugauuuuuuguacucuaaauagcucuagaugugaaagcuauuuuuuucuaauuuuauugguaaagaauggaaauuuuucaauacauuuauuuacaugagaaacugaacauuucucaucuuuaguagucauuuuauguuuuuaaaauucuuuccuuuuuguccuuuauauuucauuuuccuguuagcauuaaugcuuucuuaaugccuauaagaagagcuguuuguuuagauaagguuaaucauaacuaccagucuucuuucuuauugucuuuauucagcauuuuguuuuaugcucagaaaggcuuuguauauuacaauguuauagucauggucauuuagauuuuuaaaaauuuuauaauuuuuuuguaaacccaucuaguauuguuuucauuguaugguaugaggccgagaccaacuuaguuuuccucuagguccuugaauuucaaauuguuuacuugaaauuguuucaaauaaccugaauccaguuuaucccuaaucuauuugucauuuucuaauauggcugugcuuuagaaucaucuagggaguuuuuaaucaguauuggggcccauccugguguaagucagaaucuuggguguguggcuuguuccuugauauuuuuuuuuuaccagcuuguuaggagauuauaauguguaugaaaacugagaaccauugcuguacacuuuuauaaccauuugcauuuuugucuggguuuucauuucuuuuuuauugguuugucagucucguauaugucccuuauucaaaacagauauacuucuccuuauucuucuaaguguaauuugauuuccuguuuuuuucuaggugagaugcugcagugugugucacuuuauucacuugaaucagaauucagcuuuguauauugaaucccaauuuuuaugguuacaucugaagagauaaucaccuauuugauauuaacuguagaaucagucuuugaaauuuauaaucugaagcauuacuaacugcauuaaagaacauuaacuguuuugugacuuacacaguuauuucuuauuaauaugaauaaauuugcaaaacuacuugaaucauccugccauuccuuugguggcauuuguuaguuucaaauaacucuuaagcagaaaugcaguaccuuuucuuauaguagauauuuaucugaacaguaggauuucguucuaaauauacguacuuauaaaagugaccuuguagaaaggcaaauaguauugacauggugaugauaugacacuuuccucauuuuuuuuuuuuuuuuagugugcuguuugcauuuuuuuuuuuuuaauugaucauucuuggguguuucucgcagagggggauuuggcagggucauaggacaauaguggagggaaggucaguagauaaacaagugaacaaaggucucugguuuuccuaugcagaggacccugcggccuuccgcaguguuugugucccuggguacuugagauuagggaguggugaugacucuuaacgagcaugcugccuucaagcaucuuuuuaacaaagcacaucuugcaccgcccuuaauccauuuaacccugaguggacacagcacauguuucagagagcaccggguuggggguaaggucauagaucaacaggaucccaaggcagaagaauuuuucuuaguacagaacaaaauggagucuccuaugucuacuucuuucuacacagaugcagcaacaaucugauuucucuaucuuuuccccacauuucccccuucucuauucgacgaaaccgccaucgucaucauggcccguucucauugagcuguuggguacaccucccagacgggguggcggccgggcagaggggcuccucacuucccagaaggggcggcugggcagaggcgccccccaucucccggacggggcggcuggccggguggagacgcuccucacuucccagacggggcggcugcugggcggaggggcuccucacuucuuagacgggguggcugccgggcggaggggcuccucacuucucagacggggcggccgggcagagacgcuccucaccucccagacgggguugcggccgggcagaggcgcuccucacaucccagaugauggguggccgggcagagacgcuccucauuuccuagacgggauggcggccgggaagaggcgcuccucacuucccagacugggcagaggggcuccucacaucccagacgaugaguggccaggcagagacguuccucacuucccagacgggguggcggcugggcagaggcuguaaucucggcacuuugggaggccaaggcaggcggcugggagguggagguuguagcgagccaagaucacgccacugcccuccagccugggcaccauugagcacugagugaacgagacuccaucugcaaucccggcaccucgggaggccgaggcuggcagaucacucgcgguuaggagcuggagaccagcccggccaacacagcgaaaccccgucuccaccaaaaaaaauacgaaaaccagucaggcguggcggcgcgcgccugcaaucgcaggcacucagcaggcugaggcaggagaaucaggcagggagguugcagugagcggagauggcagcaguacaguccagcuucggcucggcaucagagggagaccguggagggagagggagaccguggggagagggagagggaccauuuuuuuuguuaaugaagccaaagaaucagagauaaauugauguucuuucuggauuuuugagaucccugcauuaauugauuuaaggcucaaguauaacuagcuuauuuagcccaaggagucacauuucuucauaguuaacuuuugaaacuucucuggccacccauguggcugguuuuuuuuuuuuuuuugguggaguaucuuuucuuguuuuuuuuuuuccucaagcuuuauugagauauaguggacaaauaaaaaugguauguauuuacagcauacaaugugauguuuugagaugcauaaauauuuugaaaugauuagcaaauuuuauuauagaagguugucuugaaccuuaaauucuccuuuccagagguuuuauugaugugaacuauucuuucuauaguucauuaugauuuuucccuuguguuuguuaauguuggcauuuuaaauaaucaugguaaguagaaaucuauguuuagaaugaagaaaauuacacugaucuaggcuuuuuuguuuuugguuuuauuuuucccugucuuugagagugcagccucuagguaugggguaaauucauccauacagauuuuagaguguugauagauuugaggggaaguauuuaugugaaaaccuguacuggacaguuguuaauauggaucccuacuaaauucaaagcaaauuuaagcugccucauugucccuuagcaauuagaugaucaucaaaugcugguuuaagugagauuaucucuguauucuguuuauuaauacugauuaaacucaaaacuagcucuucuagcuagccaauguucccuccugauaacguuuauuguagcugcuuauuaucauuuacauaaaaguugaaguuuucagggagagaaagcauacuuuuuuaugguuaacuaacuaauaaauaccuuuaaggaggugcauaugccuuuucaugguucauccgguucaguaucuuuucuuugacugcucuaccaaaaagcuguggcugaguuaaaaucucagauccuuaguagucaugccaugaaccuuuccuuaaauguuucagauaacagaaaauacuugaauuuuggggggaggaggaauagcuuuacaguacuuauucuuugccaucucugaagggaggcauucauuuauucauucuuuaacauuuuuaaauuuuauuuuauuaauuuuuuuuuaacuugacaauaauuguacauauucauuggguacauagugauguuuuaauacauacaauuuauagugaucagucaggguaauucacauacccaucaucucaaacacuuaucauuucuugguguugggaacauucaaugucuucuuucuuagcuauuugaaauuauauauuucuauuaacuauagucauccuacagugguauggaacacuagaacuuauugcuucuaucuagcuguaacuuuguauccuuuaacacaucucucccuguccuuauaugcuuuugaguuauaaauuaaaaccugauaauaaacucugucuucuggacucugaagcccaguaucaguuucuucuagucaugaucugauuacauucuggugcccuuauggagacugauacaucccaugagauuaugggcaccacuaguugcauuuuguuuuuuguugggagucggcuuucuaugaaaaagaggaaugucuugggaacaggaguuaagaguguguauuuauggugggggcuauugaguaucucuuguaaccagaacugaccauuuaagccgaguguuaaacucugugcaaucuacagauaauuauaacaggacaauuacccaugguauacaguuuagacauaacuuugggaaaacacuuaacuguauugagaauuugacugucauuguccuauuucaugcauuuaaucauguagcauagagaugcccaaauucauuuauaauuaaaagagaaaaauuuguaugauuuacuucacuuaguacuuuguaugugaauuggguaugaagucaugaaaacaauagcaauauuauuuaaaugacacguuauaaauauaugauuaugauaauugaucuuuugucauuuuaaguuuuaaauuuuuuuuucucuuuaugccuuuaauauugggguauggcagugugauuuuugaaaauugacccugcuguuacuuagcucauauuuaaaaaauauaauaaccagaguuuauaaggcugaacuuaaaugggcuuaaaaaauacauuguugaugauacuguaaacugauuuaaucuuuaugaaaggaaauuugaggaaaaugugugaaaaauuacaaaaugcacccccuacaaccugacauuuuauuucugaaaaguugaucuaaggauuuagaaauaguuauugguauauguaaagauguuuaacauagaguuauuuaaaacagcaaagcaaagcaaccugaugguacgccuauguccaagaguaaaggguuagauaaauaaaucaaucgugguacaguuuuauaggaaaagaguaugaaaccauucaguaauguuguuaggccaauacuuacugauaugggaaauuguucacaguguguauguguguauauauauauauauauauaauaauaauuauuauuauauguuuuuuugagauggagucucacuuuguugcccaggcuggagugcaguggcacgaucucggcucacugcaaccucugccuccuggguucaaguuauucuccugccucaggcucccaaguagcugggauuacaggcacccacaaccacgccuggcugauuuuuguguuuuuaguagagacgggguuucacuauguuggccaggcugaucucaaacuccugaccucaguugauucaccugccuuggccucccaaacugaugggauuacaggugugagccacugugcccggccccagaguauguuuuaaaagaaagaucaugugcaguauuuguuccagugacauaagugcucuuagaaagaugaacguaagauaaauagguuaaaugugguucucuauaagugguuguuauuuucuuuaugauaguccuuguuacucaacauuuguacagugagcacgguuugcagucgggggagggagaucuaauauuuuuaaagauuuuacuucuuuaaaugacugguacuugcauuuuuaugugaugucauuuuaaaaaugguuuaaggcagcagaaugaauaugauaaaauguaaugcauuaucugagccauuuucaugauuaauugauacuuuacuauuuuagauguuagaaaauuccuugccaacguuucucuguaaaauagcuggaguaggcaguagaucuuuuuuguucauuuuagcuuauuuuaugaauggauauuuauuaugaaaagcaucagacaucucccuuucacucaaacaagacagccugaguguucucacuugaaauauagaguggucuguguauuuaaucaccagcuuauucagcaguuuugauucucauggaguaaaggcuuucccgccuuuauuuuuugaagaugaaauugagagauuuaaacauaauuuauucugcuuugaccuaugguuugaauuaacuuggcuguuugcauuuauuuucaaaagaaacauuuaauacuugcaaugcaauaaucugaucaaucucuuugucuuucaaauugcucuggaggcuguucuaagcugccuagacuauaaagcuuucuuuuauuagaauaugaaauauaaaauugauuuugauagcucauuuugaaaauaauguguauuuaagggaguaauauuuuguuucaaauaaaagucucaguguaccauguuauacaaauauuuuaccaauucauguggaccuuuucuugcugauccucagauaugauuugugaccuuugagagaacggaggauuuuuaaaaacgucaacuauagaauuaguuaugaguaauagugaauacacugauuuuccuaauaugccaccauaucaucccuauuuucuucucccaaacuugaaugguauucucugcuuccugcugccucaucaucauuacauauucacuucuugacccuuggaaaucugguuccucuuccaaccauuuagcugaauuugcucuccaaagucaccacauaccuaguuuuuauauuaaagucuucaucuugaauuuaccuuuucagccucucugagguuucagaaguagcugucgggggucagcaaaccuugcgcauaggacuucuuugcuuucucuuccuucacugcauucauggauacuucaccucauucuaugcucacaucaaaccagucaggcaguauacauucucaggugaauugucuccuccaugucuucugucccuucguacacagauacauaggauucugauccuauauaucuuucagugucuaguucaaacagcagggcugccuuucccaugcaauaugacuuucuccucuuuucuccugagacucuuggaaugucugcuuaguacucggucacgucaaugucuucauaguauguuuguuuuuauguuccuggaagaguggggcuaugguauaauuaauuaugucuguauuuucguagaacucugcacaauuccugcacccaucagcucauaauuguuuguuauauugaauaaaaugaaggauuuuauugacaaugaacuauucugguagcuacucuugacaagucucagacaugaucuuuuuauuugucuguucacgauguguuagccuggggaccaaggagaggccuuauugaucuaucuauaaaauuauaugaaaaauucuuauauauguuaauaaugugcagguuucuggaguuuggauucauagcuuugaggaaauugugaaaggcagcuuuuacaaggcuaagauauucuaauuuaaaugauuuagcauucuauguaacuucuuaaaaguaccuagcccaacaauggagagugaaagccaguaacuauugucaggucaguugagaaucucugaaugggcagacuucauguacccacucccuauuucauggguuuuaguauuuggcaaauucagaaaauucuuguuuaguuccauuuaggguuaaguaauuugaccaggaacagaauauugcaaauugggaauuaaaggccagaauccgauacuaauuauuuugcuucagucucuaguacugcaggaggcaucagggacuuucuguuggaagagugggaacucuuuauuaguuugcuaacgugaacaaugauguacuaaaggaauuuuguggcuagaccccucuuccuccccuucaggaacaggugcaucuccugggagcauaaaagguccauugcugguuacuggauggugaaagccuuugggcuuccagacuagagccaagaucugaaugccucucuauauuuuagcagaaauucuucuacuguggggugguaggaguggacagaguuuuaauaguaucaguuuuuggucagugauaggagaaagagguaaucaguuccuuaggugggguaaggcacagagagaugaaaugcccaaugcacaguugugucaguagguuuugguuuuaccuuugaauagagacaaagcuguuugcuguuuuguuucuuguccuugguucacccuuuguuuuucaugcagugcaguggaccaugacucaggcccugcagagcugaguauagaggccccuuuuccaagagcagagaaggaugccuuugaucuggauucacauaaucauucagcccucuuauuguguugccugcauauuugcauggaaucugugccgcagcuuuaucgaaguaugacucuagaaaaggaaaacgugaccagccucugauuaauggcaugauggcuuuuaacguuuggcgcuugaaauuuuuucagcuuuucccuuucuucuuauguaaaauaguuauaaucuuuuggcuccuugccacauuugccuuaugagcaguaccaagucaguuaacucaguuguggagaaaaauacacacucuguaucaaagugucucagaauuugauguauuaacuuuaauuuccagagcaagucacuaaccgcagauggaacacagugacgcuuugucuaguacaaaauuguucucaaucuuuauaaugcuaguaaaagagcacaauacaaccaguugucuuuagcuaggguuggaaauacaacagaacugugccaccucugccucugccucauuuccagaguguguuuuaguuccuucagaaacugcagugugcacauguucucacuuauuuaugagaucuaaaaaucaaaagaauugaacucauggacaugguagaaggaugguuaccagaggcugaggaggguaguuggggguggugauggggagguggggaugguuaauggguacaaaaaaauagauuuaauaagaucuacuaguugauaccacaauguggugacuauagucgauaauaacuuaauuguacauuuaaaaaucuacuucaagaguguaauuggauuguuuguaacucaaaggauaaaugcuugaggggauggauacuccauuccccaugaugugcuuauuucacauugcaugcuuguaucaaaacaccuuauguacuccacaaauauacacaccuacuaaguacccauaaaaauuuaaaaaauuaaaaaaaauuguaaugugggugcggacgaaggcuaucuuguaauugguguuuguugcccacuaaaagggucaaaugucaccucaccuguuuuucugaaacuccauuucuaaguuggguuggcacacuauaccccccugccuguauuuguaaauaacauuauuuugggacacagccaugcucauuuguuuauguauuaucuaagguugcguuuguacuacaauggcugacuugagugguugugacaaaagaucauauaauacacagagccuaaaauauuuuuacagaaagauaucaccaaucccuucuuuaugaggucugaccaggcccagggaccucauguauuuagauguugucugugcagcuuaggugauuaaccagcuggcaugcuuuauguuuuuugguagcagaaucuuucuuuuaucaaggcauaguaggguauccauuucuuuggcuucagagcucagcuggagcgcuauaguuucugguagugucucugguacugaagccuucucugccauccucuggcuugguucuguuucugaaauagugucuuacuggucaggcaguguuaaguugcagucuuucucacaguugcagcucuuacauuugguuacgauggacaagggaccagcuggcuuugcugacccacuucauaguggggcugauuaauaugagccauuaucuucuguuugugauauuuuucaagcugcauuaucuagagguagaaaauaaugacucuggcauaagcuguuuuauuuguaaugccuugcaaacacaugugcaaauucucccuggcacacagcugcuuaggaagauuauguucugcauaaugcugccuguugucacuuuugauacuuauuuuuaucacaaguccuuuucuauguuucauuauaaauauugugcacuaacccuaccaucuauuuucuuuacaagaugacuaguugcaagaaggaaagcuguguccugccuuuuaugaggguuuuuggcauucgcuuuccauugaaacucucuuaugggacccuguucuuuccagggaaaagaaaccugccuuuuggccacuuuuagagcuuguuaauaccaccaugauauuagguaauuuuuuuuuuucugcaguaauagcagccacagugguaguggcagcgacauugucggagaauacugguaggucaccaccaccaccauaagagaucaaacguggaggcugcuguuucucuguguugugacugauauuuucuauugguugcacaauuguguuguuugugaaauggaaccaggagugggucuggguguucauguuauagcaggagccaugucaagccagggugguggggagggggugaaaacauggcaugcacucagcuccagaaucagagagcugggucugcauacuggcccucuugcuucuuggcuagaaacccuugugcaaacugccuaacccuccugaaccucauguucauggacaauaaaacacaauucgaguacauauauuuuuaauugaugaugguaauaauaaacaguguuaucgaaagccuguagaauccguguuugagggccauggagaaguuggguggugagacggugugaccuccaaguauauugcuucuccgagggagagaacaauuguagacauauaaacauuaguuauaacaacugaggguuugcuucagcaaaguagcuuuuuuuuuuuuuuaauaauugcuuguagauacucuuuuuauugcagggacagaaaguuuuucuccaaccagguguuuccaaaagugacucacaaugccgucuuucaccuguuaacucugcagucuugucaaacaauuaauaauaauacaauaguauuuuuacuagaaauuauuuaacuacugugacagcagcuaaggauaagaauuauaucacauugaggccggugcgguggcucacgcuuguaauaccagcacuuugggaggccaagaugaguggauuaucugagaccagaaguucgagaccagccugaccaacauggugaaacccugucucuacuaaaaauacaaaaaaauuagcugggcaugguggcaugcaccuguaaucucagcuacuugggaggcugaggcaggauaauugcuccaaccagggaggcagagguuguggugagccgagaucgcgccauugcauuccagccugggcaacagagcaagacucugucugaaaaaaaaaaaaucguaucacacugaguaaggaauauuuacuuuuucccccuaguaguuuggcuauaauguuaaaaauacauuaugccuuucuuuauaugauuuuuuuuuuuuuuugggacagggucucacucuguuacccaggcuagagugcaguggcauguucauggcucacugcaaccuccaucuccuuccaccuccgccucccaugugguugggaccacaggugcgcaccaccacacuggcuaauuuuuguguuuuucauagaugcaagcuggucucgaacuccugggcucaagcgauccaccugccuuggccucccgaaguguugggauuacaggcgugagccaccaugcccagccuauguguaauguuaugauaauauuauuagagcacagaugauagguucaauagaaggaaaucauaaaguuccuuuuaugccuccuuuuuaaagccuggagccuagaauaaaacauuuauaguccugcccaaguuuucucuuccuuuuucagagauauccaggaacccagugaacaaaugacuuagcuugauguagauuuacccccaaacacuacuuuuaaaagaaguaggugagaagaggagcacuagagagcccaguuuucuucaugguuuuaucgucuguuugaaauccccaugcuggucccaccauguagucccagauguuacuuuuuauuugaccauaguuagaggaguggaugucagaguccccucacucuugaaaguguuggucuguuucuuugccucccuguccuuuucuucagauacuagacugugguaccugucagaggcucuuggagaauaugccuugaagaaugauuucugaacuuuggucugccuauuguauuuuaaguguacucacucugucuugcuugucguuaucuuagcauagugccaccugauacacagaagcuacauauuuacucugagcaacugcaagagccagcugguagguuuuuacacugguaaaauuuacugaggaaguuuguaucuacugucauucuauagauuuguuucaauuuaagaguuuauauuauaguuaauaagacaacuucaagaagaguaugugaauuguaguauauagucauggcauguuaauucugugaaauuguagucuaguuaggcuacacgaauuaugacuacucauaaguuguuuacaccaaauaacaugacggauauauaugucuuccuuucaguuguaauaaaaggaaaugccugucaacuuaauuuaucaccaggcauguucuuauuuaaagccucuuaaaaugaaauaaaagccugaccuaagauuaugguuacuacgaaagugacaacagcugugguauaaaauacuguaggggccucugcugccauacuaacaacuguguagcccguaugaaaagcuguuacauccagugaaugcuuguagauacagaaacgauuaaaguaauccucccaagcagaagucugagaggccaucugauccaagucccugagagauuccuuaggggucaagaccuucccaaagucacaauggagaaaaagcuuggccaauauuccuuuccccauucccucucuacuccagggcagaacugcugcaguccugauauuuauuacagaugcauauacuguuucauuccacaaagacugugaagcaguugaaagaaggauaaauggaagcucuuuuaaaauguuuuuaauuuuuuuuuuuuuuuuuuaaauacagggucucugucacccaggcugaaguacaguggcauaaucauagcucacugcagccuggaccuccugggcucaagggauccucucuccucagucuccugaguagcuggaacuauaagcuugcaucaccacacucaucuaggggucacucucuuuguuucccaggauggucuaaaacuccugggcucaagcaguccuccuaccucggccuuccaaaaugcuggaauuacaggcaugagucacugugcguggccuauaaaaaggaagcucuuuaaagauugucauagaaaguaggaaaaaaggaaguucuuuaaagagugucguagggagaaagaugguuuaaagaugauuucacacugacacaaauuuucauguacauguguauccauuugucccauaucugaaugcccacccuuuguaggcaguaaacagucucuuucuccaaguugcuuagacccagugcagacauucucagcuucagcaauauugucauuuuuagcagcauccuggccuuuagaaaugccuucaggcauucucaaauauccccuaggaagcaaaaaucaccucaguugagaaccacuaggcuagugagcacuacagucuagugugggaaacggacaaccacacagaaaaaugacauccauacacgcauugugaaacaguagacuacuuaugagcgacaugggguucagugauggagaacagcaagagguggcuucuaggacacucucaaauucacuuucuuuuucuuaggcugacacuuaaacaccauguagugccucuugaauagccacacaaguuuguuuauauuaugucagcauugugaguuugcaaacauuugacaaaauuuauuuacuaaagguaauaucuaaaauuaguuguccuuuauuuuaaaaguuaaauauugcuauagccuaauagucaugaaauagaaaaggauggcuugauaauuauccagugguaauuauggaggacagucuugucaucauguuacuagaugugugcagcacuaaacgugggguggugaauagaagaaccauauuacauccagauggcuugcaugcauauauaguguuuuguguuuauguuacugccuuacuagaugcagguacugaaagguauccaccuacuuucugaacagagauagucgugguuguauaaacugucagaaaaugagugcauaaacuuucuguuuguaaagaagguaacauuguaacuauuucucaucagacagaauauaguauuuauacauagcauaauucauuaguaagguauaaauugucuuuuuaaauaucuaaugucuuaaauuaugacuuaacuaaauucaaaauuauuuaucauaguaauccuuguuaucaaaauucaaauaggugaguguaauauacaagguaagggucuguggcccugucaaacaaaaacaaaaauaaaaacauggugaccucuuugaugguauuuagcuuuauuacuuuucugucauccguucauugucaugauuauuuuuccauauuauugcaucuucucaauagaaauugccaucauuuuaaagcuuuuuucccuucuagcuuaugguguuuuaaggauguugugaaugcaguuucuguguacuacugaaugagugcauguauaaaucaaagacuguagggaaugccugcuggccuucacaaguucauuuauaaaucagcuacugggucgguuaugcuugguaacauuaacuucguuauguacuuaugucagagucgugaggaacccuagagucacagugggauacaagaggagcaccagggggcucuauuggcugugauuuugaagaaaaugaauuaaauugauugauugaaaaaagcaauaggagugaauuugauuaggcauguauguacacauuuaaauauaucuuguacuuuguaugcucaacagccuggaugaacacacagcauacauuauagcuuaagcucccuuccuguagcaguguuuaaucuagcuagcaguaauucaagaaaaaauuauauccaaaugcauuugaagaugaaauguagauaaguuauccagucuucuaguguucagaaacgcaaacugaccuuuggacagugaauccauuaauguucagaugaguuaaggauaauugcaauuuucagcuucugagauaaucacauaaucagaccguaugaagucaacacuuuaugguuucauuuuuaaacaaaguaugagcaaugaucuuuuuaaucaguaugauuuuauuaaaggaacaagaaauccuauaaauguuuucagcauuuacauuuucacauaguaaauuuuuuauagucaacaugauagauucuguaaaauaagauacauuucuuuguuccauuaguagagaaaaaaaaagacaucagcuguaaugacugucacaacccugacucagauuuauuucuucuuaauucagcaguucuucugggcauuuagauuauaauacuuaaaugcauuuagguaacaugaaaacuuuaaauuguguauuuauuuuuaaaaucucauguaauuacucaauuacuaaaaaaagaaaucaacaucaagaaucaaguacuaauguuuucuguaauucauuaugcaugugagaauuaucuagcuaaaauguuaaaucucagaccuauaaauauuuuacaagauacauauaagcuguuuauggacaugauauaguugguuuaaaauuaaaauuugagccaguaaugucuuguggaaucaggcuucuuggguuugaaucuuguguccaccaugaacuuuaugcaaauuacuuaaucuuucugugcauugguuuucucaucuguuauguggggauaauaauuaugccaaccucugaggauugaguuguuaaaugcaguguacuuagaauggugcucaguacuuaguaaacuguaaagugauuaaaaaagugauucuuagcaaguaguuuuuaguaagcaaauaaaaaaauacuagacaaaugcuuuuaguaguauuaauaauuguuggaaauauauucauggacacauuuuuuauucaguuauuaauucaugcaguaaauauuuauugaccacucugguugggaguugcagugaugcaggauaagcacaaucuuuguccucuuacaggaagcccagaggcugacauuaugaaauaaugauacaacuaauuaugaccaguaguaucgugccgcauauucauggcauugaguuguuugugguaggggagcugaccuagucuaugggcauuuaaggugaaauaugaagcauguuagcuagauaaauacaguuggugcaacaagguaacaauacagagaaagauucaggauguagcagagggguaacaguggagagacaggacaucugaguugauacugaugguuucauugcuguuuaaauuuaugagauccauuccuucucuugcaauguguccuguccugugucuuccgcacauucuuccagagaagcaucauuuuccugccucucagucuucuuagacuaccucaaggccccuaacagcuaccuauauguuuuucuacuugaugguguuuccgccacccugacaguucccucucacauuucauuuuuaauccuucuguuucuugcuaucacuuuuuuagcuauuccuagauuaacuauucagugcagaggaguauuugaauguuugaaaaaugguuagaaagcagcuucauuugcaagcuguuggagcuaauaauuuugacuguuagaaagcuaagaacauaacucugauguuaauauuuuacuauuauuauuauuuuucuguaaucuuugcuuucuuuauugucauuuuauuuuauuuauuucaguuauacuuuaaguucuaggcuacaugugcacaacgugcagguuuguuacacauguauacauaugccacguuggugugcugcacccauuaacucaucauuuacauuagguauaucuucuauugcuaucccuccccccuccccugaccccccaacaggcccaggugugugauauuccccauccuguguccaagcguucucauuguucaauucccaccuaugagugagaacaugcgggguuugguuuucuguccuugggauaguuugcugagaaugaugguuuccagcuucauccgugucgcuacaaaggacaugaacucauccuuuuuuuauggcugcauaguauuccauaguguauaugugccacauuuucuuaauccagucuaucauugauggacauuuggauugguuccaagucuuugcuauugugaauagugccacaguaaacauacaugugcaugugucuuuauagaguucaagaccagccugggcaacacggugaaaccccaucucuacuaaaaaauacaaaaaauuagccgggugugguggugggcgccuguagucccagcuacucgugaggcugaggcaggagaauggcgugaacccgggagguggagcuugcagugagccgagaucacgccacugcacuccagccugggggacagagugagacuccgucucaaaaaaaaaaaaaaaaaaaaccacagacugggcgcaguagcacaugccuguaaucccagcuacucgggaggcugaggcaggagaaucacuugagcccaggaggcggagguugcagugagccgagaucgcgccauugcacuccagccugggcuacagagugagacuucgucgggaaaaaaaaaaagcaaagugaacguaugccuagauuuuucuccuacauaaccuuuuuacacccauuuacauuuuuuauucuuaaacuucucuuucuugaaugcgaaaguuuagaaaaauggaaauuuccaggagggugcuuuauaauggcuuuguuucccauuacucuuucuugcauguuauuuauuuuuaaugagagaaaaauuauauguaggaaauaaaagagaaacguggcucuggcuguguaagcauaggaagccuugagcuuaacacaaggcaaauugcaaagaaaaaaaaagucuaaaaccacauaucaauuuuauguucucuaauacaugauauauauauauauauuuggauauauuagguauauuuaugacuaaauuauaaauuuauauauagagagauauauaugacuaaauuauauaaagugaggacaguagugcuaauugauauuaugugacauuuaucuccagaacacaaguuuguuaggguucuccagacuaacaauaccagcaggauauguguguguguauauaugugugucuguuuauggauaugucagcauacuuaauuauggaagcugagaaaccucaagacucugcagucaauaaguugaauacucagaacugaugauguacuuuucugucugagagcuggcauucuugagacccaagcaaaaccuguguuucagguguggucugaaggcagaagcaaacugauguuccaguucaugcagucagacaaacagguccuacuccagggagaggcagggucucauuccaaggcccuuucagcuuguuagauggagccuacccacuugagggagagacaucugcuuuacucacucuacugauucacaguaaucggauuauccaaguaucuagaaacacccuuacagaaacacucagaauaauaucuuacuacauuucuggguaccucauguuccagucaaauugacacauaaaauuaaccaucacaauaaguuugguuuaacauuuaaaagucuaucaguuucauacaccauguuaacagaauaaaggauaaaaagcauaugaccauuuuauuaaaugcagagaaagcagcaugcuuuuuuuauuaaaaacuuucagaguuaacuuugcauuuagauggaaguaagucugaaaaaccuaaagcaaauaccauacuaaauggugaaaauuuagacaccuuaagauuaagauuuggaacaaaguaagaauuuccacuccuaauacuuuuuuuuuuuagacggagucucgcucugucucccaggcuggagugcaguggcgggaucucggcucacugcaagcuccgccuuccagguucacgccauucuccugccucagccuccugaauagcugggaauacaggcgcccgccacugcgcccagcuaauuuuuuguauuuuuaguagagacgggguuucacuguggucuugaucuccugaccucgugauccgcccgccucugccucccaaagugcugggauuacaggcgugagccaccgcgccgggccucacucuuaauacuuuuauguaacauuuuacugaaggccacagccacugcaguaagccaaggcaugaagaucagaaacaaauaaguaaaaauaucucuguuuguagauaugauuguuuaugaagaauaaaucuguauguagaucuaguucuugguuuacgucuagaucuuccuuaauagaagaguuaauccacaucagauccauauuuauauaugguauuuaguuuuuugucaaaggcauccaaccauccaguagggaaaaaaagucuucauuauuuaggacaaaauaaaccuugaaccucaccauacacaacuacuaauucaagauuuaucuuagaccugacagagaaaauuaauauaggaagcuauuagaugaaaauauaggggacagagcuaucuuuauaacuugaggauaggcaaagacugcuuaaaucacagaaugcaauaaucauaaaaaaauugaugauuuagggucucguuaaaguuaaaaacugcugcucaccaaauauaucacuaaaaaauugaauuagcaagacccagaggaggauaaaacauuugcaaaacgugucugauaaggacugguaguugggacauacaaagaaccugaaaaacucaaucaugaagugacuaaagcaucucccugaaaaaugggccaaaaauuauacagacuccuggccgggcaugguggcucacaccuguaaucccagcacuuggggaggccaaggcaggcggaucacuugaggucaggaguucaagaccaaccuugccaacauggugaaaccucgucucuauuaaaaauacaaauauuagccgggcuugguggcaggcgccuguaaucccagcuacucggggggcugaagcaggaagaucacuugagcccaggaggcggagguugcagugagccaagauugugccgcugcacuccugccugggugacagagcaagcuuccacuaaaaaaaaaaaaaaaaaaaauuguacagacucuugagaaaggaagauaugcaagauuaaaacguucacagaaagacuugcacaugaauguacaguuguuccuaguaagucugggugcaaaaggaacuaggcugugaaauuguuggaaggacuggaggagugaaacgggcuuguagggaagaugcuguuaucuggagaucaugacaggcagggggcucaccugcaccuguaugccuucuguugcaaucucuuuuuacuuucucugccuuauaaucucuguaaguuuucucaauaugagaaccauaccagagcccuauuauccucgaguucagaguucagaagauccgggaugauacacauuauuaguacuccauauccuggauucucauuauauugugaguuuuuagcaguacagauacugaugccaaaaagauaugaggcugugucuuuaccacuugcauauucuauggcuuuucauaaguaaaugguucuuugauuccaacauuaguaaaguagggauauuaauaguuucucaugggauacgaagauuaauugagacaauaucuauaaugacugaaugagaaaaugcuuuacauuuaucauuguaccugguacuuaguaugcacacaguaagugguagauguuugcuaucacuaucagcgugaauuuuuaaaaauuaugaucuauuaauuauguuuuaaaauuuuucaaaaguaagaacuaagauaggccuccuucaccuuaugaacuuagaaaacuaaacaugaaugaacaaugcccugggugcacucaugccuauaauccuagcauuuugggaggcugaagugggagauucacuugagaucaggauuuugagaccagccuggguaacauaguucagucccugucucuacaaaaguuauuuuuaauaaaugaagaaaugccaucaauuacuugccauugaggaaaggagaccaagauuaccauuuauguguaugcuggguaguucuuggugaagcaguuuuuuaugcagccucuguuguaggaacuuuguguucugcuuagucaggucuucucagagagaggacgucugcucucucugauguugcugugguuaaacaauaauuaaguuaaacuguuuccacauauuuuaugguuucauaaagaauguaaaagaaaaaguaguugaauucugcccuucugcguuauaaguuuacuuuguuggaacugcuagaauaauuccaaagugaggguucguugaaaauaggcuuccaaaaaccuuuguaguucaaugccaguuacuuaacauuaucuuuggaccuauguuauucauuuucagguacuucauaauuuuauaucucugugguuauuggaugucauauuuuugacauuuuauuaaaauuacuguuuggaucuauguauuaaagugagaugguauuuuauauugggcuuuuacaauaaucuguuuuaguuugaguguuuaaaauuuuuauauugguucugggauauuggaauauguaacuucuguuggguuaauuguguguguguguguuuugagacagagucuugcucugucacccaagcuggagugcaguggcaugauauuggcucacugcaaccuccaacuccugguucaaaugauucuugugccucggcuuucugaguaccugggaccacaggcacggaucaccacaccuggcuaauuuuuguauuuguagcagagaugggguuucaccauauuggccaggcuggucucgaacuccugaccucaagugaucugccugcgucugccucccaaagugcugggauuauaggcuugagccaccgugcucggccuggguuguuaauuacuauuuugauauuuauuucuuaaugcuauagagccagaauugcauuuuuauauguauaaacuuuucauauuaaggccuuuuuguauguucugauugacauuuaaaaucuuggcugguuuaaacagcaaucuaaaaaucaagccuccacauuaagaacauaggguuuuuuuuaucugcugauaggcuugauauuccaagcauauuaacugacuugaauuguuuugaacacauguaaaaauggaaauguaaacagucucuuuuggcagauccuuauauauacuguuccauuacugauugucuuauucguuuaacuuuuacauccgugccuggaucacaucacaugacugucuuaccugauaacgcauuccaucccaugcugacuaucaaaucauuuuuucauaugucaaauacaaauuguuacgcucugguuucaaccguagaugcauuuccagucuggaggaccguuuuuauuuaaaauuuuuuuucuauguucagaggugauuuuaacauuucuuuugaguguuauauacuuagagauuaauauuaagugcaucgauucugccuaagcugguccuauggguaaacauucucuggaugcaggacuaccuacuugacauuucuugucauacuuucugcucuguugauuucuuucucaggcaguuguuucccauguuguggcagagaugacuguuagcuucuguaggauaacaagcuaccgacacauucccacuguaccucauugguguugcuugggccaugugcccaucucugaaccaaucacuguugccauugggguggaauguuuggccagucuagcuucccuaaauuacaugccugaguuugggggacaaucaaggugcucuuuuuagucagaaagcauccuaacgaagagaaaucuuaggaacaaaucaugcggugcaauuuugucauuuaauucagccacaucaguuccaguaaaauuuuuuaaaaagauuaaauaaugaguaaugguuucuuaugaauaaaauagcccuguuaaguuucccaaaacuuaaccagugaugaacauugaaaacuuuuuauacuucugcccucccucuuguaguuuacuuacuuaugaaccuuggucacuguaauuguaccuguugggacacauuaggcaccaaaauauuuguagagugaaugcuucauagcugguuacuguggacauauugcuguagcacaaguauuaaauuugaaccaaagauggauguaauuuaauauuugauuaaagugcuggacuuccuguuaguuuucuuuccaauauacauuucauagagaggggaaauuagagcuugugguggcauaggcuucaugauuuugcacugugaaggaaaggcuuguaauuuagucuugggccagagauuauauggaucaggugugauaacuuuguggcuaaaaugacuuagaauaguugagaagccauuuucaacuuauguccuguucuuggacaaagggaaggagaaaguaugagcagaauugguaugugauaauuguuuauugcuauuuaaaaaacaguauucccaccccccgccccuaacccccaccccggucucacccccaggguaccuccucuuaggaacaacucauggaauguaggaugaaccaaaaccgaaaugaugcacucauacacuaaccccaucauucccucggcucuaccgucuucucccuuuuaauuuggucuuucagaccccaugaggaaaggguuuugcauuuugauuuaauggauagcugcugcagcuuauauuuaugcacuggugaugacagcgcauuccuuuuuuuuaaaaagaaaagauuuaaaaaaauuuuugugccaguggauggauuguaauaggcagccacaucugaagaaauaagugaaacuauagccauguagugauuucuuauuacacauauagaugaguaaucuuugcugugauuauuauauaaguuauacaaauguggagcuuuuuuuuggcucuagaaauauggauggauaguuggaauuguuuuaaaguggucuuuacugcuuggcagaacauggggcugauuucagcugcauuuaugauuccuuuuuggauuuauuccaguuuggauuuaaauauauuaaaagugccugugaauaugaggaaauguagaucauuaaaacugcauuuauuauguagccuguuuuaaaauuuggacugaucaaugaaucucuguagaguaaaaauacaccugaucguaccaaaucacuuucuagauuuuaucagcggucugugccccucggguagucaaggaauucuuuuguccagagcuuguuaaugauucauuacaucaaugaugauucuacauuuuauuugaauuaaccaauuucuuaacaaguguaugcauaguuagaaaucuguauuguaguuuguagaugaaugucauuuccugggcaaagaaagcuccuuaauauuuaugacauguuucauauuaauuaaggcagacuucccccauguaguaaugcaauacuuuaagguuaucuaaucaaggguucuacacaaugaucagguaauuuaauuuuaaaauaacuuacauaaauagaaaugagggaaguuauugaauaauucaaauauggugagucaacauucgauuuuaauuuucauuuuugacuuguuucuaacauugcuggcauuacucuagugggcuagccaucauucaacuaauauuuauggagcauauacuauguaaugaugacagauauucagugguaaaacagaccugaugccugucuucaccgaguguagguuuuaguguugaaaacaacugagaacuaaaaaaauacacaaaauaugauuacacguggcaagugauuugaagggaaaauaacaauggguacgaaauaaaacaccuuugguuuaagauaaauauagaaagaucaagagagugagagaucaagagagagaccuugaucucuuacucacuccaucuauuuaggggggagccauuuccuauuuugugaaaauagggguguguguguguguguauauauauauacacacauauguauauaaauaucuguguaugugaaaauagaaaaagaaaacacacacacaccuauuuucucuaccuaaugguaaugcauuuccauaugauuauauuuucucccauaaaaucaguuuacaugguuauaccauaauuuuuuaaaggaguauuagaaaauuuuuuucuaauuuuaagauauuugguaaacacagaugagcugugcguuguuaaaauuaaguugguguauuaauucaaaauuaucugcuuaggaaaaugccaccaguuguggucauagguuauucauauuuuaaaagacuguuaaauauuuuaaacauucugguauguguugccaaauuguugccaugcuuuauucuuaccaugucacagacugguuuaaugcagcuuuguuuugcuauucaugaguuucauguuaggcagcuaaugguaacagucaugggaguuaguucugcguguuggauaccuguuggguuuaaacugauuuaaauccaguucuucucauuuugauuuauuagaauaauaaugaaucuucuuucaagaaauguuuccccauauucuuccugauugauuauguuuaaauuuggcuagagagaaauuguaagaacacugaaauccauuguguguuuuucuaucuucuguuugcuuuuuuucugauucgaguuuaauacaucugucuuuuguccacuuuaaaucauuucaugaaacuaauaacagagaaaauauaauaguggggccagacauagucucauacuugagagggaaggcagggauugcuagguaaagugaaucugagauggugaauuauuuacuuauaguacuacuguuuuuauggagaaguuuggcugaaaaaguauguuuugucauugaauugucaaacuuuuauuucaaaaacaugaguuguuuucauuuucuuauuuaguguuaaauuucugcugcugcuuuuuuucuccccagauauggggucuugcuguguugcccaggcugcucuugaacuucuggccucaagcaaucuuccugugucagccuuccaaagugcuaggauuacaggcgugagccccacugcacccagccccugaccauauuguuaacauuagaaaaucaaauagacuaaaagcauuacucucuuggucuaguuagcuuucuuuagguauuuucccacuuuagaaacaaugucaaagaguuuucacguggcaggagacauguaaucagaguacauggagugcagguuauuguuuucgacauggcugcuaaauaaaucaagguuucauuuuuuccagagacucacacucaaaauuaguaugacauauagcauuuaaaaauaugguaaccuagaauuuauuugaaaauuguuauuuuuguuucucucaagugagagcacccuugauauacuauuuagagcuucuauucugggaauuuuauuaugcaugcauagcuaguuuuaaaauuuuucuccuuauugauuuguuaaucaauccucaucccuucccuucuuuuaaaacauuauuuccucauuaauauuuaccuacauucauacugcuguuugacuugugcagaaaagauggaggaggacaggagaugcuguguuuaucucauauucagcagaaguagaaaaagguaaaugucuucaacaucgcucagaugguacuuacuguggccagcauugugaaaccugugagacagcuaguucuguauucagacccuucaauuacucauuauguuccuguguacucagugguuacgaaauugaaaaacccaaagaggcuggugggcaggauacugaaucucacaucacuuaaacccccuuuucccccaguuacuauccuugugacauccaacaagucaguuagcauuuuugugccucaguuucuuauccauaaauuaggauaugaugauucaaguggaugacuuacuuccuaagguucaggaugcguucuaauuguguuaacuucgucauugaaaaagaaauaccugaaagacucucuaacaaggaaaucaguauaccugaacauuuuaauaaaaacauuuuaggagaaggauuauauauaacguuauauucaacaauaugcauccaugcuauuucugucugcuuuuuugucuuucuuuugagacggagucuuacucugucguccaggcuggagugcaguugugcgaccgcggcucacugcaaccuacgccucuuggguucaagcaguucuccugccuguuucccgaguagcugagauuacaggcaugugccaccaugccugaguaauuuuuguauuuuuaguagagacggaguuucaccaugauggccaggcuggucucaaacuccugaccucaggugcucugcccgcuucggccucugaaagugcugggauuccaggcgugacccaccgcacccugccugucuguuuucauaugugaucauauagacucauacaaauauuuauguuuacaaggaauuuagaucucuaagagugugcagagcccuauuuuuaucugaucuuccucagauuuaucauccauauaaacugugacauggagugcaugaauucagaacaaaacaacuuuaucuacccccgaauacuaaagaguucaauuucaugcuguuuuacauggcacagcaggaguggauuguuuaauaucucuaacucugaacuuccacaaccuuucuaucagauauucagguaagugcugagaagcagaaauucuaaaaauaauuucuacugaaucuuuuggagaccccggagcaaacuauuugaauccauuccccuucuuuuugcauaguuuuucuuugucuauuugaacagugcucucaugggucagaaagauugaguuucuagucccauaccuuaaauugcuuuauaauugccuuacuuuauaagggagacauauccuggcacagugaagccugcaaauauuccagagaaauuaaucugaaccuauuagaagugggaggagggaaagaaacuuauuuuggaaaauuguuagcuaggcugguuaaacucuaucaacacagcaugauaucaugcauagaaagcaaauauaaugagucccggacauuuauuugcagcuacaauuucaguuugguuaugggucauagauaaagaagauugagauggaaaaauguggccauuuaaaugauaaagcauguuguauguauuaaaugugguuuuguuuuggaauuuccacaguagauuggguaagaguguagaagugcuagauuugaaucuagcaaagucucuguuacuuauuagguaugugaccuuggacuaauuaaugugaguccucugcgccugucucuguuucuucauauauuuuuuuaagguuauuuaacaaacauuuuuaagggacucuuauucucuaggcaccuagaauauacuucucuauaagacagacacuguguguagcucaugguuaaguauagagugguguaggaaggucagauggggcaaaguaucugagauaauucacuaaugguucauuaaaauuagaauaagaaauucagggccugugugguggcucacaccuguaaucccaccgcuuugggcgagguggguggaucacccgaggucaggaguuugagaccagcuuggcuaacauagcaaaaccccgucucuacuaaaaauacaaaaauuagccgagcgugguggcacaugccugugaucccagcuacucgggaggcugaggcaggagaaucgcuucaaccagggagggagagguugcagugagccgagauugcgccacuguacuccagccugggugacaaagugagaccuugucucaaaaauaaaauaaaaaaucaguuaggggauuauaccuuuuuuguuuuuuguuuuugagacuaacguaucugaacuugcacagaucuaugugauuaugagaguguagucugaggaguuagaauaaaauuaugugucaggccuaauuaaugauuuuggcccuguuaguuaccaccaccagacauauucuugguuaaauaagagguuacuuugaugcuaacacuuagcagugcuuuguuacuucuuacuauagaaauaaugagcaauuaugaauuaugaagucauaauacaaguuagaaauaacuguuaauaauagauucuuaauucuuacugucuucacuaacauuaggguuauuagaaaacaaugagauauagaaugucuuccauuuguccauaauauuauauauauaguacuauucagagggcaauuuguauuaauaacauauaaacuguuggguucuuaaagccauugaacauuuugcauuuuaaaguuuuauacacagucccauguuuuuauaccuuauauauugggggauguuaggcacuuucgcuuuguguuggauagaauauagaacagaugccuuuuucaugcuguaguucugaucuaaugugauuugauugugccucaaagauaauuagcugauagccuucaagagcaauaacauuuuugggaaaggagaggcuagaguuugauuuaaaaauuuaggguguuuaaaacuaacuuuugcuuuuuaaauuauccauucccauuucuuaaggaaauagcaauaaauauguuguuugauuuuuuuuuuggcauaagucauuuuuaucgguaaauacauuuuugguggcuacuguaaagggcaguauuuuagaucuaaaggauaagauaggacagcauaggucuagagauaugauaucuacucaggcaucaccagaagacaacaauuuguguuucauuugggcuuauuuguuuugagacuggauuaugagauuaauuuuuguauuuuugguagaaacgggguuuugacauguuucccaggcuggucuagaacuccugggaucaagccauccaccugccucggccucccaaaguucugggacuacagguuauagccaugugccucgugucauuuggacauauuuaaaucuucaaaauaagaguuugccaucggcuccucccuucuuuaugauuguccuguucaaaaaucuaauugaucuucuacauuggguucuuuucauaauuguuggaaaauuaguaauuuucuaugaaagacaguaauucuuuuuaaauuuuaaauauuauccucuuuagguuauaauaugauauguucgaaauucacuagaguuuuauuuuauguaagcaagaaaucaacuuuuucccaguauguucugaaaguuauucuucaauccugagauucaaguggauauuauuucaugucucccaaaaccacauacauguugccauguaauaccaagcucuuauguuaaaaggaggccuauuuuguuuuuuaaauacaguggagaaugaagaagucacauaagucgaaccccugccuccaucuuauuuuacuuuacagcauccuaccuuggacaccugggcaguauuaauucauguuauggacauuuccuuucauuaaugccugucaucugcugggccuccaguuucaguuguuugcucuagaugugaagccauggaguugagucugguugcaacauaugauccaaacaggagcuugauguacacugcugucaccucuccugugacaauggcccaguccucuaggguuuuuucaaucccccacaagucugggauugcuccuccuguuugauucuucagaaccacuaugcacuuacuuccccuugacccuuaagaccauuuguuagaugcaguauucugauucuuauuucuuuuguugcuuccacuuuuucaguaaggcaaaauaagauaacacuagaaaccucaauguucuuguggucagguuaccaaaaagcaauuuguauaagccauauucggccuuuuaaaaauaggcacuuaucuagcauuuucagcaacauucuacaagaacaaaaaguuuaauucuauugucagccccaugaggauaguuaccacuguuacucucaguuuuucagauggagaaacugaggcacagagagguuaaacaagcuguucaagauuucauagcuugucaguguugaagcugggguuugaauuuagucuuuuaaacacuauuugcauugugggucuuacaguuucucagcaaauugauaugauguaaucuuuuucacaucuuccauugcauaauaauuccaaauaaacuuuaaagguguaaucuuuuuauauuaucuuuuauaccauuacugagauuguaauuguugguggguuuagguuauuuagaaaaauuuaguauagguggguuuucugguugauuuaauccucaaguaacaaaucuuacgacacaugguggcauguuucuguaccuccugaaggguaguuuguuagggcuguuguaauagcccagugagguucuguccacucagucguucugcaucuguggcuuguccuuggagucauuccuuucuuuuuuucugucucuguuccuuucaguucaggcuggcagcauuucugcugguauaaaagucucaaaauccuugucagucuucuguguaguucauggacauccaagcaucaagcaagacaguccugcacagcucucuccuggauaaccacauucucucuuccuggcuucugcugacaugguugauuggauccacgagucacauacuucaucuguuuagcaaguuuguccagcaguaccauccuccagucucggagcacacuccucuuugaccauggcuuaucugcuguuucuguuuaggcuucauagcaucaucugagcaaacaagaugaauauuaauaaggucaaagguuuuuuuuucugagacacuuuccucagaaauaguguucuguaccucaccagcuuaucugcccuagggauguugcaauuguaaucaugaucaggccuaaaucagcucauuaaaguggggagcaucacuuuuguucacuguuuauuuuucuuugugaagcaauauuaguaacacuuuaagaaaguuucugguuguaaguccaagcuuuuuucccccuuuugucaaaagauuacaucuuaauccaaaauaucuuucaauuucucaggaucuucauuuucuuuauuccaauggcaagauaauuaugcaagguaacuuagaaaccucauuauauguaaccaauaauagaaagcaguggugcagauaaauaguauuagguucagaggaacaguugggacaauuuauauucagagccgaggaugaaguuuugcuggauagccggcuaguaugcaggaagguggugugguaggaggaaaauacugaaguaaaugaagcauaaggggcauuugggcucccaugacuuggguugaagaggaauauacauguugacuugcugugggagagaaaccugaaaaucucauugguggaguaaagucuuggagcccuuaaugccaggcucauaaauuuagaccuuauucuaggucuaagaaaagcagggugauuacaccuuauugaacucaggaaugaaagauuguaagagauuugggggagacgaaaguaacagcuauaacgauggauuauuguuaggagagacuacaggcagggaaauuagccuuguuaugcuaggauucaaggccuggcagugcagcugcaaggaugcuggcagaaggaauugagacaggagaugccguaaauggagacaaggcugaauuuuuaggggugaagacauagggagugucuaggaauguggacuauguauguaggagaauagaagaacugugguaucauuugguagcgacagagugugguuugaaguugaagacauuaauuuuagguauuuugaauguaauggccauuaggaugagaacucuguggugggaguuuggguuuggauauauuaagacuuuggaguuaauuugcauggaggugauaauuguaucaccaagauaucuaaagucuuauugugucaaaacuguucagucagucuguuaccggguauguuagggauugucaaggucuaucaguuaaaucuuggagauuauuuaugcaccaccauuugaaugauaacuucccuguugcguagugcuggccuagaccugauaaaacuuugugugaagucuuuauagaaaacuugcuuaauaagaugugacugauaacuauguauucaugagaauuaaaggcauaguagauucaaaauaauuuuuucuuugaacuucucaccuuuaccccaugucuucauuuuaguggauauguuuguuguuguuguugaugguauuggauguuguaugugaugugauguagaaaaggcuguucauuugcuccuaauuuuggguuaccuuaugagaguucguuaauaaccauaaauauaauaaaauauaucuuagaguaaauuuaucucaacucacugguuaaaguauucuaaucacacauucauuggguuauuuuauuuguugacaacccagguuuucagcuuuacagaccuuuuagcgcucaguucauugacacaucauugugaugggcaaauaaucuuuccauugcaggcgugcuuccaaaugagcacucuuuccuuuuaguuuuucuuaguacauaguucccugugagguccacaaaccauuauaaccacauuauaaaugugaauauauagauucucaucucuauucagaagaaauuggguuuaucacccauugaauguuugauaauguaaugcauuauccuccauuauguagugacuaaguauucauggaugauguguucaaggaccaacucuguguuacuguauaguuagcgaaacguuuaacacucuccaacccgguuguguuucagugcacuugcaggaaagacauggugaagauuucaauggauaucuuugugaggaaauuucagccagacagauaucagcuuuggaaacaaggaaaggauauauacaccauugaucacacgaagccuacuccagcauccaccccugaaguaaaagcauggcugcagaggaggaggaaaguaagaaaagcaucccgaagguaaugaccccucaccccacugaccugccuugccugucguguuuucucaguuaaaaugggucauuggauguggcaauuuacuugcuuuuucuauuuauucaucauaacuuaauaccuuucugaaaaugugagacauuauuuuuaauucuuagguguguaauaaauacaauauaggaagagauguauauuuauuuuguuugagaauauuccugaaguugcucgacauggcaaauagaacaauauagaacuuguuagaccacuuacaugaauguguuuuaugguuguauuauuccuuucugugcauuuccauauuuuaaucaauaacuugauuuuccacuuuuucauuuugccaccauuuugcuuuuuggcuuuagugguuaucuucuucauuuguccaacaucugagcuacugcucucuucuggaugcuuauauuuuacuacauuuuaugcacaugguuuuauucuuuuguaagauguaaaacacagcauauagcauuucuguaacaugcuuauccuugugaacuuuauucuccauuccaucuuuguggccaggaucauuucaaaagcuuuuagaugugcugugggcaucuuguuguuuuaaaaccuauugaauagggugugugugguguugcucagguccuuaggcuaccuuuuaagggucuuauguuuuccaauuuuauguuaaauuuuccucuucaauauuacucauuguuuuucuuucagauuauaaaaguaauauuugugcauuggaggaaauuuguaaaauaaggaaaagaauaaugaaggaaucccauaucacucauaaccucacuauccagagauaaccaguauuaacauuuuguauauauccuuuaccuauauauuuauuauauauuuuauaauauuauauaucuuuccaaaauuggggccaugcucuguuaauaaucugacaaucaguuuugaguguuuuuuucauguaacugauugauuugcugcaacaugauuuuuaaugccugcauguauuuaauccccuguagcuuguguccacuuuuuugauauuaacuaaguaacaccauaauuuuacaucuuugcccagacuuaugaugcuuauuuucugucuuuuuuuuuucccugauauuuauuuucugcuuauuuagagugguagugaguggaagaaccuuaggaacauggagucaaacuucggcaucuuauaagagguagaccugaggugcagaacuaacucagguguugauauuucccccuguaguuuaccgcaaugaucgucaaaguguuuguuaguaggucaggaccaacauuuuaaaaugaggugguaaaauagaauaaaaaguauuauagugcuuccucugugguaagggcaaauauucacucaugacaugugugaguauguguguauguguguauauagugucacuaucugaaauauauaacucacuguggguuacauucaagaaaaguuugagaaauacuaauuuggacagucagugucuuugauaacuguguuaauucacagcacuaaagaagccagcgcuggaaggaggcaguauccaauccugaguucagaauacacaccaggagaacaucuugagcauuguucugucauggauggaaaacacaauauuuucauuagguguaugacuugguuuccagguauuaaccacagugggccuuuuggguugauagagaacauggauuuaugacacuugaacagaucaaaaugcuugucaguagguucaaauaaucaauggaacuugcucaccuacuuagaaagccugacuaugggcuuguuuaauaugcucagccuuguggcuugauauuuagagauuauugaucucccuuuggaaauagcccauuuagggaagucugaugaagggaaugauucauugaugucucaagcacaugucagccuucuuuuuuucacauauacuacacuguuuauaauguugagauuuucccacaucagccaaugcauggauuugcaacaaaagcaaugauggugaugaucauacuacugcaguuacugccaucaguagcagugaaagcuaauuuauauagguuaucgcaggccacccuauucucugcccucccugacuuccuacagugcuuaguccuguggugguuucuuguguguguauaauacauauggguguguuuuggacacuguugcuuugaguugauuuguaauuguuccuaauuguuaggaauguuuguuucauauguaaaaagcauauaugccaaagcuaucaagugaccugcuggaaaauacucaggaagaagauaaaaauuguguucacucugaaaauaguauguugauguacgauguuaaauacauaaaauuaggcugaaugugguggcucaugccuguuaucccagcacuuugggaggcagugggggaggaucacuugaggccaggaguucuagaccacccgggacaauauagugagacagugucuuuaugacacacacacacacacacacacacacacacacacacacaccaguuagccugugucuguuuuaaauccuuucgcuauugaugaauuggcauuuaauuugaacuauuuucauacauaccugacaauuauacaaaacucaaugaaaaguagucaguaguuuaccuugaaauauaaaaaauuuacuuuuagcacuagccuaacaggauauucugauuuuuauuuauuuucuucauuuucuaaauauuuuauuuauugauuuuauuucugucucauuucaacauuuuuuacuuuauuuuuauuuucagacuuuuaaaauguugucacaaaauuuuaggaauggcccuuuuucaaaauaauguuuaauaauuauuuacaguugugugaauuuuaaaguuuuauugauugauaagaaaauuguguuuaagauuuugauuucaaauuuaaucauucaguugugaacauugacuuggcauagugauuaacaaugucaguuguuuccuucuuuaagcaagugaaaaugacauuuauauugggauguguuuuucauauccauugcagacaucccgcucugaccacugcuucucuuguugacagcuuccagugugcuaggucuaccucuaaaaggccuaaggcugaugaggaagaggaagugucagaugaagucgauggggcagaggucccuaaccccgacucagucacagaugaccucaaggucagugaaaagucagaagcagcagugaagcugaggaacacagaagcaucuucagaagaagagucaucugcuagcaggaugcagguggagcagaauuuaucagaucauaucaaacucucaggugagaagaugguugauuagguuucacauauaaguaguaggugguugaugaucagaugucuuaaauggauguucacuaugacaaguaucugacuaguccacauagcuuaaucaguaaucuaccaaagucauggguaacucaaccaauagucccagggaauauuguaaaagucaggagccucacugcuauguguagcagaauugugagacaagcagucagcagugccuauuugguuuaauaaaaaagaagauucuaaaaugaguuuuuuuuuuuucgugcaacucaauuuacaauauacguuuuuggaaggcuucuuuugaauucacaugaguagagaaaaccaauuauagauaauucuuuguagauucuuagcuuucgacuuaagaagaaaauaaagaucaagguuuuaagaacaacaauaaugaaaagucaaccuagugaaaugacauguauaguccccuugcuucucuuuuguacuaaagccauugucugaaaaucucagcuacuuugccuuuucucccuuugguagcauauuuuucugaaacugcuuuagugauuugccucuuucauauuuguuggaguuuuuguauuguaauaagcuaauuccuguguuccucucauacuucucauccuguaaauccuuccucaugggauuccccccuccgccagaauccgacucccucugcugcuuccuccucacucauggcaccauagcuguugccuggaugacugcagcaauugcuuccuucuuauucaggaaugucagcuguagucacccccgcuagucaguucuccagguggccauuagagugauccuuuaaaagaaaaaaagcuuaggucuugugacuaccuucuucuuaguauuauuccaccuauaauaaaagaaaaagucuucacauaguccuaaacugguccucagcugcuacuccagccucauugccuuugcucuugaaauagcuguguggauagaguuuaaaccacagaacuuuuaaaaaaugaguucauguuuuaguggagagcuaggcaaauaaccacauaauuacaauccaaugugguaaguagcauuauagagauugcauaggauguugcugguuuaccaaggaaggacuucaaacacacaagagcuggauagccaagguuucuuggcaaaggugauaucugaauugaguuuugaugaauggauauaagauagcaaggcagagaagguagggaagggaauuacaacaaaugcagaauagagaguuaggcaauacauauggauauuucacuauagucccuuuuuuuaaaauuuuuaaauuuuuuuugagacagagucucucucugucgcccaggcuggagugccguggcacaaucauagcucccugcaaccucugccucucagguucaagcgauuuuuuugccucagccuccugaguaucugggacuaaaggugugcaccacuaugccuaacuaauuuuuauauuuuuaguagagcugggguuucgccguguuggccaggcugaucuugaacuucuggccucaagugauccaccugccuuggccucccaaagugcugggauuacacacgugagccaccgugcccggcuccucaucaugcuuucucuuacacuguguuuaauuagccaguuuaugaauugcuggaugguuuugccuaagggcccugaauuucauuaguucugucacuacaugguucuuugcacauugaucuccagauuuugagcccuggcauaauacuugaguagaagaacuggguuguucaguaucagagcuaguaugugauggguacaaaugagguuuguuuugugugugugcauguaugugcaugcgcaugcguguguauguguguguaagauacagaaucauuugggaauaguuuaccaauucuacuuaguaguaauacagugcaugauuuauuaacagucuucuguuuuauccucaggaaacagcugcuuaaguacaucuguaacagaagacauaaaaacugaggaugacaaagcuuaugcauauagaaguguaccuucuauauccagugaggcugaugauuccauuccauugucuaguggcuaugagaagcccgagaaaucagacccauccgagcuuucauggccaaagucaccugagucaugcucaucaguggcagagaguaaugguguguuaacagagggagaagagagugauguggagagccaugggaauggccuugaaccuggggaaaucccagcgguccccaguggagagagaaauagcuucaaaguccccaguguauguggcaauauccauuuuuuaccauauucauuauauggugagagcacauuuugaaaacaacaugcugugcacugaaauccuccuuuagggcacagauaaauaacauuuuacauuuaugggucuuaaucauauucauucaauaacugggagguaagccuccugugagcuguggcucacauagugauaauuuagcacauggagcuuauggccacgugucgaugcuugauuuucuuuuuuuuguuaaaaaauuaaacucuuuacuuugagguaauuguagacucguaugcaguugugggaaauagugcacagugauucuuuguacccuuuacucaguuucucccaaugcuaccaucuuagaaaacuauaguacaaagucacaaucauaucgacauugauacaguaaagauuacagaauuguucugucaccugcagaagaauucaucugcugggcacugaucacuuucugccaauaguuaauaccuccuggucccagccuucccacagcuucuauuucagugucaggacucacguggucaugcuuucuucuuacucuuuccucauggacccugaaucucaggaccagggugaccuuucuuguccugcccccuccucgaaagaggcccuuugccucugagaaaagacuccucuauauuauuuagcuucccauugugacuuuuuggaaaauuguacaauauuguccuuguacaguauuaauauuccauauucaguagaaacuguccauguagccauaagaguggaucaggggagcuaggacugucuguagcgauugucagaauucaguacuuuuuuuugauguauccagccugauuagggaauucagguggaucaggaaggaguaauuguuugagcugauagguugcgcuggcugcagaacagacacugcuccugcugguuucaacucaaaauagauccuugugucccugaguaggagcaagggagguuguauaaggacagcagcuuugaauaccuugcgucuuaucagucuuaaaauguuaauuaaaauauacuuuucugauuugacccaauaguguuuaucuuuuuauguagaauuguauaucucauugaauuauaaacacaucaaaaauaugaaagauaaaaaaaauauggucugguuucuuugaaaaggugccuaagaguaguuugaaaauagcauucacauacuaauaagcaaaauuuacaacuuuggccaaaugugguggcuuauuucuguaaucccugcacuuugagagacuguggugggaggauccccucgagcccagagguucgagaugagccuggacaacauggucacacccugugucuacaaaaaaaaaauaaaaaaaaauuuaguggugugugccugugguccuagcuacuagggaggcuaagguaggaggaucacucgagcucaggaauucaaggcugcagugagcugugaucccaccacugcacucuagccugggugacagagugagagacccugucucuuaaaaaaaaaaaaaaaaaaaaaaaaaaggaaaaaaaauuugcaacuuaauuucaugaauggcuuaaauguagccaagcagauauucauucuuuggacaggugacugagucaaaugccugcuuuaguuauuuuuagcgaccuucuuuaaaguagaauggagcugaaaguaauucucagauuucuuugcucucaaggaaggugauuauagaucuagugcuguuuaucuucaucuuuaucauuuccccaagcaaagacugacaguagagaaaccaacauugcuauugaaggcugagaggcuuggcuugccuguaagaacaacugcaugacauccuuuucuuacaccaugguguuggauaacuccuagauguaauacagccccacuuaauuuuuguguaguuuuggucaguuuuuuuuaguauucaguguaaugcuauguguaugcugauagcugcuggcauuagcugaucuacucaauaaguauuauguuauuuuuuaaagccauccauccauccauccauccauccauccauccauccauccauccauccauucaucuugggcucaaagcuguaccuggaacacaccgaguauguucucacuuuacgugcuauucuugcucccccagaugcuccucccccagauaaucauauguaugcacucaaaguuccccucaaguaucacuguaucagaaaggccuucucugauuacccuauaaaacugcccccuccccaucacuuucuauuccuuuguccuucuuuauuuuccuucguuacauauuuaccgaguaguauuugauaaauacgacuuauucauuuauuauguauucccuuaccccucuauaaucuacacuucuugagagcagaaaccugauguaauuuuuccugcuauagcuccagcuaugacaacgguauggugcauaguaguguguugauaugucuucuuggcuguguuauaauuucccauauuguuuuuuagcuauuauaaacauagauagcugucaucguauauugcauuugucauucuuuucuuauuccuagcuuugauuacaauggucuuacacauuuucuuagaaucauguguuggagucagaggccagaguaguuucccuauaucuggccacugcuucuucagcuuaccgggaagaagacuaagauuguuuucuuucauagucaacucuugauguaagcuugcuggguucaaacucucucugauauccucuuucccuucccccugccuuuaaaaauuuugcguugugcgagcaagagagcuuaaaagguggguccuagcuggaagguguaaggauacacaugacuuucuacccgggaaaggaauauauagucuguaaaucccaggacaaaaaaaucauugguaaaauuuaagugguuucaacauggcauuaauguaucauuaaaaaaagagaauacuuuugguuucuuguuuaauuguuauuuaugugaucuagaaguggugauucauuucugaauggaaagaaguguugcaguauugucuucucugugaggauagaaaauaaaauuccuugcuaaauguuaacaugggaacaucuuagaggugaccaagagccacaguccuguauuuuuaugagaaugcaaucuuagauuuacuuauuuauuuuuggcgacagggucuugcccugucacccaggcuguugugcaguggcuugaucuuggcucauugcagccuccaccuccugggcucaagggauccucccaccuuagccuccugaggaccugggaccacaggcauaugccucuauaccuggcuauuuuuuuuuuuuuaaauuauugacacagagucucccuauguugcccaggcuagucucaagcuccugggcucaagggaucccuucaccuuggccucccaaaaugcugagauuacaggcaugagccacugugccuggccuauaauccuaaauuuacauuaguuguaagaacuuuagaaaacuuguuaacugcugagcuuauugcagguuuaauaagccuacccugcccuacagcuuguauuuuaauacaaaguggaagaagaauuaauugaccucuggcuaaaauuacuaauagaauugauuccuauuucuuuugaccuuaaguuuaaauuucuuaaaggacuaguuccccaagagguaaacaaccacaagauuucuucaacauuaagugauaaauaauugugaacuguaggguuuuuuuuuuuuguaguuuguuuuugauaaugguauuucuccaccauuuuuguucuauaacuagauagcagagggagagaacaaaaccucuaagaguuggcgccauccacuuagcaggccuccagcaagaucuccgaugacucuugugaagcagcaggcgccaagugaugaaggugagauggugacccuuuuugggauuuuuuuuuuuuuuuuugguguguaaaacaaacuauuguaaaaaaaauugcugaauagaaaaaaaauucaacaaguagcaaauacguacuauuaggagaucauacauaauaaauaauuuacagguaaaaggaauuuggaacuuagagguaaagacguacuucauauaagcuagccuuauuacugguaaaagucuuccaguuuuaugucaugggguaaaaucagucagccuugacauguuuuaggguucuacagaagaagcugagacucauuucucuaaagguguuagauuuuagaguuaacgugcuguagguuucuuuacauugucuuuacuuuuaacuucaacucuuuacauuaauuuaaccaccuucaguaaaagucuaugugccauauccuuuuccauauccuuuuguaacugguguggggugaaacauccuuuuuccuucacuagaucgcugugaugcagcuggauguaacgcaguuucauuuacaaucauuuaccauuccuagauguaaauuuaucuuuuucccccuuuuguucuuuuuucaagacagggucucgcucuguuauucaugcuggagugcaguggagggugaucacggcucacugcagccucaaccucccaggccuaagugauccuccuaccucagccucccaagcagcugggaccacaagcaugcaccaucaugcuugguuaauuuaaaaaaaaaauuuuuuuuuguagagauggguuuugcuauugcccaggcuagucuugaacuccugagcucaagcauuucuccugccucagccccgcaaagugcugagauuauaagcauuagccacugcaugccugguuacccuucucaccuuucuuuuauaaaaaagaaauuuuuguugccucaaauuaaaaaucagaucccugauucguaagugucuuguauaugucuccuagcaucaugaaggccuuauuuuuucuguguuuagaggauuaauucaggcagguuuucuguuaagaguccuucucugaaguauucuccaguuuuacuuauggaaauuauuaccuaaggucaugugucugugagaauacuguuaagugaguaacaagaagcucaaguuucuuguuuaaauaaauuuaucagaguagguagauaucuuucacagauuuuuucccccuuucacucacuuuucacuuaugucccauguuuaguuagaaaacaagaucauggcagggcauaguggcugacuccugcagucccagcugccugggaagcagaggugggagcauugcuugagcucaggaguuuaagaccagccugggcaacuuggggagacccuguaucauaaaaaaguaaaaauaucaugaauguagggauuagggaucauaguaguuuguaugaaaccaauccaggguugaauucugauucaaguaauagaaguaaugaaacauauuugcauugauuuccauauaucauaauguugaguucuuuuucuuuuuuuuuugcuacuuuauuauacccaguacaaaccauuuucccuuuaguguuaagacauaugacaauucuguguaaaguaauuaauacuuaauguauaaugcucaugauuguaauuucccuuucccaugguagacucucuucaguauaacuuuugugaagggaauaggcuaugcuaaggcuguaccaacacauagagaaagcugcuuucuccuguguccuuauuugccuaggaaguuuauuuugaugugggccaucauaaauuggcccagaguuucuuuuuggaaagcaguucugauuucaguuuguauagcuugcaagauuuauaaauggauugguuugaugaagucgucucaaggguuugagguuacauauuuuguagaaacgaugauuguagcuuuugcaacagucuuucuuuccuuucuaauauguuaaggaccccuggugaccucuggggauuuuucagaauugauuagaaaaaucagagaaguuuugugauggcuuaaaguuuuuacaagcuuucaaacuggcaacagagaauauucuguugcccgaaguaaauuauuuacaucauugggaacuugaauguuaccuuagccauuugccucugugucuauguugcuugcaaaguugaaagugaauaaacauuaucauuguuagauugugaugugcagugaguguuuuacucacugggagcauacaauuccaaauccaacuccuuugggggauuuucuguccuaacuauucugcuccuuuugcacuccucauacguaggagcauaacuauauuagagcauaggagaauugcaucuuuaaacaacaaucagugucuucuguuggugaacgagcauuucucuauugaagcuggaaaguuucucccuaacagaaaggcugcacaggggaaagugacuugguccaggaccucugggagcugcuaugccacuggcagcugagagaugagccacuuguacguugcuauucucuuuaggacagugcaguggcucuuugauacccaaauaaccugaaacaccauagaucauucugacugguggcacauccuguaauuacaggaucaggaaggacuucgugacuccuagccuguuauuuuccgggaaaagauuuuccauguugaacagcaaaacaugaaaguugguggugguggagaagagggggcuauguaauaaaagaauaaugauuagaauguaucuuuacauaaaaauuagcaucuaacuuauucuuuuuuggugaaaaauaauguuaaauauauacuacauguuuauauuuuauaacuuaaaugaaaauacuaaacugccucuuuuuuucuuuuaacugaaauguuuuucaguugcauguuuuucuaagguuaggcagcuggauaaggugacugaaacuucaauuaaaauucuuuuuauugcccaguuguuuaaaaauuacgcaaauguuguguugaaaccuagacugauaagcaaagcuguuuggauuguuuuauucucgaagcauccaggauauguacguauucuucuguugccauuuguugauauuauuggcauauuccugcucuuuccugaguucacuguccauagagaaggaggauguguaugaagugcaugggugaacuaugcaugcucuggugcacccgugcacuuaggggagagggcaaugcucugucucuggccauggaacguacuagaugugaugaacccacugaagggcggccagcuuagaaaucugcggcaguauuucuuucuuucuuuguuuuugguuggugaggaugccugcucagaagcucucagguuuccuggaauuguaaaaugcuucaguacagguuaaaugcucaauuucuuuguguggcuuugaaaccaguugucauucaaugcugccugcucucucuagcuucauuucccuuaacuuugcgacgugagucuuccuuucuguucagaccaucauuccccugccuuuuuagcaccaggcacugguuuuguagaagacaguuuuuccauggauggggcagggguauagggguggggaugguuuugggauaaagcuguuccaccucggaucaucaggcauuagauuaucauagggagugugcaaccuagaucccuuacaugcaugguucacaauaggauuuguguuccuaugagaguauaaugccacugcugaucugacaggagguggagcuuaggcuucugcucaccccuugcuguguggccuguuuacuaacaggccacggacugguacuauucuauauccugggaguuggggaccccugauuuagacaacuucuccuuacccucccccugcugcuuuucuuccauguauuugcccaggcuguuacauuauguguggcacucuuuuccuucuuggaauguuucaaucccuugucaccacucaccucuccucuuccaccucuaccgcccauagacuccauaugugcuugguucucuugcaccacugaucaccuuacacugugguuuguuauuugucuguccguguaucugucuccccacucucauuccucucuuuugcuuccccuaucaugcuuuugguagugaacauuucccugcaaucaugguagcuuaaaucacuuauggauucaagagugggaaugcccuggauaaggcaaucaguaauacuugaaaucagccauuaaaaaguuaaguaccucaacguguuacauacugucauauuaaaagaaaaauguaaauccuuguccaggaaauagucucccuauauauguguauagaaaaacauguuguuuuaauuaccaauauaaaugugauaaauuauauauuuaauaugucagcucuuucaguuuuguaucuugacagaauugaaaaucucucuaccacugugccaacuucuagaauuaccucaaaguuaaaaugcagcugacccauuguagaugcggcuggugccuuggaguuugagggcuuuuggagcugugacauuacguugggucaguaagugacuccuuuuuaaggacuagcuuauuuaggcuauggugguuguacaggcuacggugguccugagagugguuuuuuuuuuccccacccacaacaaaggaaugaugcauacuguugucuucagcacauuaauuagagaauggguuuuuuccuaggauuuuuuuuuuuuuuggauugcugagaaaggaguguugugugaggaagaaaagaagaaagaucaagacuaagucaguucaggagaagucacuagugaacuuaaauuuccugaucuuugcaguuuguauuucuguugcuuuauaaaaccauucuuugaaacauaaauguguguacauacaccuguauggacacacacagacacacaggcacagacacacacacacacacaaugugguauuuccacacagagaauaguugccauggagaugaaagccuaccuugaauaagguaaaugucucauaaaagggaauuguucaagggaagcauggucaugguguagcaauucacugaaacauuaugcagcuauauagaauguuuucaaaguaucaucuuuagcacucuugggauaaugccuccaauauaagguuaagugguaaaauacaguucagcuagguuuguuuacauuggaaauauuuugaggcaaguaauuaucuuuugaugguuucagaaaguacuuacaccuuugcagguuuuaaauuuuuuuuuuuugagauggcgucucgcacugucgcccaggcuggagugcaguggcgcagucucagcucacugcaagcucugccugcuggguucacaccauucuccuaccucagccucccaaguagcugggacuacaggcgccugccaccacgcccggcuaauuuuuuguauuuuugguagagaugggguuucacuguguuagccaggauggucucgaucugaccucgugaucugcccaccucggccucccaaagugcugggauuacaggcgugagccaccgcgcccggcccugcagguuuuaaguuuuaaaaauauauuuaggggguacaaguucagauuuauuacauggauauacugcauaguggugaagucuggacuuuagucuaaccaucaccugaauaguguacauuguacccaugagguaauuaauuucucaucccucacccacuuugguaucucuguuuguugccuugcugcccauuuugaugugauucacacucacaaauguuuuaagccauggcaagcuucuucucacuagcauucuuaucagcagcacuuuaaucgugcugacgccaacuccagaacuucccuugaagugacguugggcuaauaaucauccugcauugacaucaguaucugaacaugugcuuuaucacacccccuucccccuucuucuggccucauggugcauuguuuguucuuugaagcuuucauccugcacaugugugcauuuguuucccaacauuucuuauuuuacuauauuguuuucaauuaaaaauggaaaaauuguuuucaauaaaaaauuuccagcuuuuccuacuguuacuucuagucugcucacugcuuuugugcuuauugugcuuccaauccccuugguuaagagaugagguuaaugauguuucuaaugcaauuguaaacuaaggacaagccgugcuaguguacagaggacgucgugagcauggcauuugcugacacagugauacuccucugcucagcgauucccaccaugugcuaguggugaguauagcuaacauacuugugcugacagugaaguuuuguuggagucugugaaaguuaacuggaaauuuauaagaaaauugcaagacuguuauuaggugauuuuaguuuucuuuuuuaugcugauaauuuuucauauuuucugugacaaacauuucuuuuauauuuggccaaacaaguguuuuuuacagagugucaauaugauggaguggguuaucugauaauacccuagguauaaaacaacuagaaauaauggcuaauauaaaauaaacaacuuuuauacuugcauagagaggcaaaaauagcacaaaggauaauaucucuccaugccuacaaaugagggucagucggcuccagcacucuacugugugaugccucggugccugcguuuacaaaguagugaugguagcagcaccugccgcauggaggaauuguuuugaggguuaaaaaaguguuuggcacauaaugacuguuuguuguugcuguuguaaggagagggggaaagugacagcugauugguaagggggagccaaguuguggccguugaggagaaauuuuccaggaccagaaugggcgcagagcgaucagaacuaggaaacuaaagggccccucagacaugcggagcuggagccuuaaaagccuacaccuuuacuuaagugcacacuugagaaaaagaaaaaguggaaaacaaaauccagaaacaaacaaaaacaagagagcuugcuugccugaaacuuaggcuuggauggugaagggcaauaugauagaagagaaaguuauucuaagaauuccuacccauguggucaaguuuauaccucuucuucuaagugagaaauuuaaaaugcaacuuaggcuggcgauucaugccucuggggcaucuggcacaagcaguugcaaaaucuuugaacacccacugaauaaaagucugguugacuaacagucaauagauuuuggagucuugacuuugugcuuuauauguuuuuugacuuuggguaagcccucucucuggccucuuuccuccuguguaaaaugugaggcuuggucaugaaugauaaguguuccuaaccuguaaguucauauauggauuuugggcauuuugaauccccugaaauagcauguggugacagguugaaggcugcuuuuccaaagagcugauugccauuaaucuaaacuuuuacuuauaacucuucaacuauaauuuuauguuuucuagaauaaucaacacagaaaguuggaaagaugcagauaaccaaguguacuguguuuagucaagugcagaggcagccucaucuguuaauacaaguuuggauauuggcaauauucagauuaaagcccugguuuugggucugauuuucucuaaucugaauuuuccaaauaacuuuucaucagucaucaguucagcaagugcacuacuguaaugagcuguuaagcaucuuuuugaaauuaaagacagcuuacacccugaucccuaucucuguaaugucugcaugccuugaggauuagauuaagaguguauuucaggcaauguuacaguaauuuauuucuugggacgucuguauauauauaauauuuuauucaguaauggauugaguguuuaaauauacagacagaagagguggaauuggagaucuuucuugguguuuaaccaucauuuaacccaucuaacccagguuuucuguuguuuugaagaauaaaauguauacauuuauucacuuuuaaguaagugaaaucucaggaagucccguuugacuaaauuugauuacuuccuuaaaugguuuucucuaguucacauuucuuuuauuagaacaauuguuuauaggcuggguuugguggcucacgccuguaaucccagcacuuugggaggccgaggcaggcggaucaccugaggucaggaguucgagaccagccugguuaacaucgcaaaacccugccucuacuaaaaauacaaaaauuagcugagugugguggcacacaccuguaaucccagcuacuugggaggcugaggcaagagaaucgcuggaaccugggagguggaggcugcagugcgcugagaucaugcuauugcacuccagccugggcaacacagcaggacucugguuccaaaaaaacaaaccaaccaacaaacaaacaacaacaacaacaacaaaaaauuguuuauaacaauugaauacuaaagugguccuauguguguuuucccaggacuagagcugcccacugauugcacuucauucuagguuguuuuuuuuucuggcaucgccugggauuucccgugguauuuucugaguacuucaccccgugucuuguagucauuguccugcugguacuuuuacuacacaagcuggcucucagacacuuugcaauugucccucaaacaaaaggacauuaguuagaaguggaauuuagaaauagaacuagaaaucaaagaguuagaauuuagaauuggcuguugcccuuuaccuuuuguagauagguguuuggggaaaauuaugcccuccugcuccuggcaagcuguuacucucuguuuuaacuguauugauguagauuugccagucuuaauuuugugucucuuauuuuaaggauuuauuaagugaauauguugaccaaauauaaugaugaugucuuuuugauucagaaauuacaaauuuuuuuaaaguauuaaauauaaauguuauuuuaaauauuaaaaacaggccgggcgcgguggcucacgccuguaaucccagcacuuugggaggcagaggcgggcggaucaugaggucaggagaucgagaccauccuggcuaacgcggugaaaccccgccucuacuaaaaauacaaaaaauuagccgggcgugguggcgggcgccuguggucccggcuacucgggaggcugaggcaggagaauggcgugaacccgggaggcggagcuugcagugagccgaggucgcgccacugcacuccagccugggcgacagagcgagacuccgucucaaaaaaaaaaaaaaaaaaaaaaaacaaucuuuuguuuuccagaugcuacuggguacaugacugucugcuuuaggguaggcaggcugcgacuuggcuuacgaauagguacaucucccauugaaagucuuuccccugcguaaaaaguucuuuucccugccaguuuugaaaaauaaaugcugugugauggcugcugcaugucaugcuccaaauguuauuaauuuuuacauaaugaucucuuuguuccaucaauucuuuuuagcuugagguauuacuauacuuucauaauaagcacauuuauaguucugucuguuuaagcaauaaaacagcaaauucagcagauuacuaaguagauuggcuuggaauguuuguugauaggucacagccaguguuuuccugcguuauguggacacaaaacauuagauguuguuggcauucagauaaaauggauauuuuaucuagugcuuaagguuuguaauaauaauuugguguucucaguuuagccuuauuucugucaguaaauuccacuggaagucccaguggcguugauuuuuacuguaguauggugaauaaaaaaaucaaaaccaccucacuuuuauuaugcuaguggcuuggucagguuuugauuaaauuagagacaaaaaugcuggcuuuauaauuuaugugaugcuguugcuuucuguauuucuuacuuucaauuuugaaacuuuucuaaacaaugauuagcaugaaaucuuaugaucagguuucugaaugugcuaaaagcauggagauuguaagaugauaagaaagaguuugagucuuuggguucauguaugccuuguuauuuuuuuaaaauuaacuuauaaauaaauucaaccauaaccuuguuacucuuaaaguccuguagaaaacuacccaggaacagauuuugauagcacaguuucauggugcauucaauucuuuagaaaaauaaugauuguauuagguuauaauauauaugaaauugucaauauuugaaauuuuuuuuacucuaugaaaacugcaauuucauacaacucaaguguguuacuuuacauuuuuuucaaccugaacgccaguuucuuuuucuuggagauagaaugucucagccuuauagaccaccgaauuagcacauauuuugguacacuuuguuuucauuguuacuuucaccuuuucuuugguuguaaaauuagcucugaagauguagaaucagcauggaaaguuuauguauauuucaaauuuuaauauuguggugacuuuaugucuucauauucuuuguuuugccgcuggccaaugaaaacuuaguccuggcuggcaacauucuacagguuggcauuugugcacguuggucauggaaguuaaguaacauguccaagacuuccagcuagugaaugguuagaagguggcucucuuuaucagcauuuuaauuuucauagaguuguuuuaguccuuuucccuuuuggagguguuagguucccaggcuucagagaaauggugagaugaguauaucuuuauaccugucaagugaaccuauaaauucuggauugauauuccauuguuuuaguguuuauguucuuuguuuuguuuuacagagauuuuuguugugcuuuaaaaacuagaaacuuaaggaggaaugauuggcuaugauauguauauguguuugaguguuacauaaauauuuccauaguuguugaugaagucuuuucuugaggaguaaacuugauaaugccuucaagugagugaaccauggaucuggguuaagaaucuucuuggggacccccaggagaagauugaaucuuucaugagguagagcugacaggaccauguaauguauuuugaagggaaaugagaggaagaagauguauagccuuguucucuccuuauuucuguaugcuccccugaauaguccaugucuuuaucuuccuuaguuggugugauggccacccuacuugaaguucucucccuagcagcuguuuugugugaucugccacgugauaacuccuauuaguuguugggucaaaauaucugugauuccugcugucauuuacauagaugaccaaagcugacaucuuuuuuuuuuugguauggggagcuucuuuuucauguagauugcaucaugcuaguguuaauaguuucuugcuuggagaucuuguuuugccaucuuuugacuuuguauuguauaugcuguuaaugaaauagcuuaugaaucuggagguuuuucccaugagugguuuuuguuuguuuguuugagacagagucuuacucuguugccuacacuggugugcaguggcacaaucuuggcucacugcagcauccgccuccuggguucaagugauucuccugccuuagccucccgaguaucuaggacuacaggcacguaccaccacaccuggcuaguuuuucuauuuuuaguagagacaggguuucuccauguuggccaggcuggucucgaacuccuggccucaagugauccuccugccuuggccucccaaaaugcugggauuacaggcaugagccaccgcacuugccucccauggguaguuuugaacuccauaaagggaaagggcuguugcuuuuaauuucuuauuuccagaaucuuuuauauuaccuagcauauggugaauuucauaugcuuaguaccuaucuuuguuuuuuaauuguaaauugacaauuuauaauuguauaaauuuaugggguacaaaaugguguuacguuuuauuaguacaauguggaauaaguuaguugacuuaugugucaccuuaaauacauaauauuuuguggugagaacaugagacuuuuacuguguuagcaauuuuaaaauguauuaauacuauuauuucucuucagaucauguggcucuuucuccuuuuucaccuaucuuugauuugaugcucagaauauguuccuucuggugccauguugacagcuaaguuucccaaggauaugccagcuuucuuuaggaguuuucuucuucucauuccuaccaugaugugagaauugacugagcugguuuccuccuauuuguuguacacauuacuaguaaccauuacuuauaauuauuuuagaugaugcuagcaucauuuuuacugguaaggcaaucgaagcucauagacaugaauucacuuguccuagaucacaaagcuaguaagugguagauaacaggcuuuaaauacugucuguucaauuccaaaguuuacacucuacacucuuguguuuuagauagacuauugcuaugucugccaggcuggagugcgguggcacgaucucggcucacugcagccuccaucucccagguucaagugauucuccugucucagccucccgaguaacugggacugcaggcgccugccaccauucucggcuaauguuuguauuguauuuuugguagagacuggauuucaccauguuugucaggcuggucucgaacuccugaccucaagugauccaucugccucgcccucccaaagugccaggauuacagacgugagccacuguguccagccuacucuuucaacacuaacaaccucccaaaauagcuagaauacugguaaaagaaguugaaguggacacauauaaaugucugauuauagccagauaccuuuguuaauaguguagauaaacuucccagcauuccuuguuuuuguucaugcguguuauaaaauauauauaaaauaugagcuaauguucuguaagaaacuucagccacgcugguaaugccauaguuccuggugaaacccaucuccucagagguagcauaauuaucauggguguuuuuuuuuuuuuugguaauaggaauuuugaaguuguguccuuuggaauguuucuuauuuaaaguguauauagagucauuuggaauguauccuucugaaauacuuuuguaucaguguuauugagaggugauacauaaagaacaaaacuauauacauccauuuaauuucuuaagugcuuuagacuuuaaacuguagaauucucugcuauccauuauuacauuagcauuuugggggaacuguaaugcagaauuugauuuuuccucaaugucaucacuucuuaguaaaaucauaccuaaaguccuguaauuuuuuucucuuuuguacuuuugaacacagcuuuauaaauguuugaaggucagcauuucaaaaaaaucacuuaaauauaguuucauacauuauucaguacagaaauuauaaaguucccaaguuugaaucuuugccuuuuugaguaucucacuucugcacuuaucccaccccacuacaccccccauucccugcaggauguuugaaaccauauauaaaugccucccaggacugagauuuugcucaaguaccugaaacguaacagaugcugcugugcuuuucauaguagagaauggugcuguaccagccaaaacaccucacuggagcaucaccccaagcagcagaaugagugugaugacuggcaaagggaaauuauacuguaguggagcugauagcuuuucucaucugcugaguuccauccacaaguccuggcagcagcccuuucacaaauggccugaauaauuuuccuuagggacgucacuuacauguaacaaaauuuguucaaagauacuguccugagugagugaacgaaucuggcaaaaaucuguucuuaaggcaagguuucccccaguucauaguucucaccuaauauuauuuugacagcaguuuuuaaaaaacuuuuaagaugacauauuuuuauaacuaugaaaacuuaaaaagccucuuuauuccagacauuuaaccuuuuaaauagaauuggcaauguucccuauacaugguuuugugcucccauuuuuuauugauuauauuauauucaacuaauauguuguguaauauauauagucauacuguauauuucauuaauccucaaaagcauuucuucuaauguaugcauuauauagcuaugccauaauuuauuugcauauuuuaaaaaagauucuuuuagauacuuuuguaaaagacauuaauuucuuuauuaccaucaauuauauucaaugauguuuuugagugaaugggagaauaaaggcuuuuauuuucccuacaaggcuaaaccuuuugauggaaauacuuauauauaggagauaacuuggcgucugucuagauuggcucuguucuaaucuguguugucaucuuaaacacauuacaguguuuaagcauacauuuacagcauacauuuucagaaauuuucuggauggcugcugcgggguucuguccugcagacccugacccaaugacugaugaauaaaguacacugacacacagauagucugcuuugccaguucuacugaguguccgggcuacuuagucacagccauggccccgaccagccagcgagacucacauuuauucaguaaagauuaauugacaaaggcuugagucaacaccacuagaagguaguugacauugugggcuuccugaguagaaagcaauuaagcacccaugguagaacaaagguuagcauuaagaccccaugaguaggcugggugcaguggcucacaccuguaaucccagcacuuugggaggcugaggugggcagaucaucugaggucaggaguucaagaccagccuggccaacauggugaaaccccaucucuacuaaaaauacaaaguuagccgggcgugguggcgcaugccuguaaucccagcuacucgggaggcugaggcaggagaaucgcuugaacccaggaggcggagguuucagugagucgagaucaagccguugcacuccagccugggcaacaaaagugaaacucugucucaaaaaaaaaaaaaaaaagaccacaugaguaaagaagugaguuagauaaacgccccacauuccuuuguuucuacucuaauuuauuuaacuaaagguaaggggacuaggcugccuucagccagauuuauuaccgaaauuuugcaaacucucaaggcuuccaagaggguuuguggcuauuauaacuaaaauuuuucccaccagccugacugaacccccacagaccuuugcagagauuauguuggaggccuagaggggaaggaucaucauguccugaaguacuagguugcgcauaccagcaaauagcagcuuuauggcuaucucauauaacuuguuggaaaacccugacauuuaacuaaucuuguacucauuuuacagauugagaaauagguuuagaaucaucacccaaccaagacuguauagacugcaugaaugaagcauuauuuuaauuuauucugauagguuggagcagagcucuacacuuaaagccaugcuuaucuuagaauaauuuggugucacuuggacuaauguuuucaaauauauauuuucuagugugacuuuuuacuuuacauaaaagucguuuacacuuuuguaugaaaagugauacaaauuaauguguauaaaaagcaacgaaaaauaaucauugaaauaaacacuguauguuuacaccguugcuaacaacaucucagugugacccucaccuugggaaguuuuauuaaucugcaggaauacugcaaauuaguauaaguagaaaacuuuuggaguuucucugaaugucuuaagauacucaaagugaauuucagcaagccugacuuucuuauuagaaccagaaaguuuuuagaauuuccugugcuucaaauuaauggggccuccccuucucauaacauguccugugggguugagucucuuccaggcagaccucucugacuguuggggaaucauugcuugagcaucagaggugauacugauugucuauuuaaugaucaaugacaagacagaaaucuagcuaucccuuugagguguuugaaaaacagaauuguuuaugguccugaggagugggcggugugauuugaauggcaagcagggagaauagcuuuggagaugcauuuaagacaccuuggaaaggcugagaagggaggguuguaagcaggcugugaauggcuaauuacugugauuuuaccuauagguaauuguacaagcagaaguuguggucaguuucuuaauacccagcuggcacacauauaaaucacauauuuuuguuuuaacucauauuucuuuuugaggacuauuuuuaggcccugcuugcauagcuauuucuacuaccuuuguccucgaguuuuuaauucugccagaaauauucagaguaagaggugaugauugguuuccugggucuaagugagaaugaauacuuuuaauacuacuauaaaaaaaauuucagucuauuguguauaugauccaggaguuucaucuauaggcaaguucguuuauaaaaugaaacaguuuauaaaauaaauuuuuauuuuuauugacauggcgauuaaaaaauuugaaaacagcuauugaagguauuguugccaagguggcaauauuuucaacagguuucuucaguacauugauccaaguuaguaucugguuuccccauuuccaccucacaguaguguuuguuuaggcgcuagcccucuuacauaggauggcccuuuuagccacugcuuauguuuccuuauuuaggacaaaguuccacauaccuuggugccugguauacugggcuucuguaaauuuagaaaggcuuacauagauuugaggaacugcuuuguauuuaggcucaugguuuucuugacugcauguuacuugcuacaaggaaugacaauguuuuuguaaaaaucuuagucuaggaguacggguuuccaccaugaaguaagaggcucacugacugaggaagaaaaaaaugaagugcucuuggcauaaaaucuuuguuuucuucaauuucuggcaaaccuugcagacauucuugaaagaaccuagggagaaaaggaggccuuuuugcuguguugacucuuguuuucuuuuugcuuaaguauuucaaguugauuaaggcaagcugauuaugaaguuacugcuuggcuuuaagauugaagccuacaucagguguuuuuaagaccuguauuguuuagcagugacucuuugauacuaacacuuuuagaaaaauguacacauguauauggcagugguucucagucuuuuuggucucaggaagccuuauguucuuaucucuucugaggaccugaaagaagauucuuuuauuuccuuuuuuguggguucauuuuauugauauuuacuuacuggaaaucacaccagggaaaauuuaaauuauauuaauucauuuaaaaauagcaauaaaaacaacauuuacauaaaguuacauuuauuuucauaaaaaauaaugauuuucccaacccauaaaaaauaauuagaaacaucagcaagacaguggaauaggacuucacagcgcuuguccccuggcagaaacaucgauuuaacaacuaucaaugcucaaaaaugccuucaaaagagauacaggaaccagaugagagaugauggcaccugaguauagcacagacaugaaaaaagaugcauugaagagauaggaaggacaguuuugcauuaccuguauuaccacuccccuaaucccaggcgguacagugaggagagggauagggauaccugugugggaaggagagugaugugagaaacagauuuugccucagaucccaaucuaagguccguugcagugaaacccagcaccacacagucccaccgcccuggauuccuggcugguaccugcagacugagccuccaggauugcuccagugucaggccaucucucagccucaagacuagcucaagugucaggucaguacccacauccuuagacuccagaccagcacccacggagccagccuccaagucugccucaacaguagccagcauuugcagucccagacuccaggcucacuccagagccaagacaacccccacagacccaggcuccaagcugguccccuggucuaggauguagagcagcacuuguggaccuggguuucaugccugcccuagugaacccuggguacaggucuaccauagaagacccuggcauugggccaacucccacagaccaaacauccaggaacaucccuguggaugcaguugacaggaccacaccaguggaauguuggugccaagcuggcccccgugaacccaagauccuggccuaacucaguagacccaagcuucaguucuuacaugguggacuuaggcuccagauccaaccccaugaacccagguaccaggccagcucacauacugacgcagacacaaggccggaggauuccaggagcaagccuacccuuggaccaugccagauggccugccuagaaaauuuggauggacugacuggugaaggguuguccaagccaaagccagucuacaaagguuggaauaagucacuaguucuucaaaugcauggauaccaacucauggucacaagaaucaugaauaaucagggaaacaugacaccacugagggaacaaaauaaaaccucaguaaccaacaauaaagaaauauagauuuacaaacugccuaaaaguaauucaaaauaauaaucuuaaagaagcucaaugagcugcaagugaauacagauagacaacuaaaugaaaucaggaagacaaugcacaaacaaguugagaauuucaacaaagagauagaagccauaaaagagaaccaaacauauucuggagguaaagaacacaauaacugaacugaaaaguuccacagagggcuucacauuucugccagccacccaagucugaaugacuguaguuugucugcuaauaauuuuuuucauggaaaaaguggcguuccaugaaaauggcagguaauucaaccugcaauucaauuaauugcucaagugcuuuuuuaaagaacacucuugaacuuuaguguguacagaaauauuuuaugcauacauucuuuuuuuuucacagauuuaauaaaauugaugcuuuuuuccccccaucaaagguguuauuaagagaaacugccuuuuuguuaccucuguaaguaugagguagucaauauaaugauuccuuuggugccacugccuugauucaugcugagacaccaacaauuuuacucucuacuacuuucguaucaccguuacaaaucucaaaugguuaauagucaaaucauggguguuauuaugaaaguaguuuugacuauguagaugccaugcaacaggguuguguauccccuggaguucacagaucauauuuugagaacugugguuaucuuucaauuccacuugacuccuugaacaucauugguuugaauuguuugacucuacuuacaugcaauuuuuuucaauaaauacauuagaacauuucucauagacucagaacaauuugaaaaaacucacaaaugaaucauguagccuagaaauauuuaaaaaauuaagaaaaagauaugucaugaaggcauaaaauauaugcagauacaagacuuuuaucauuuacuacuauaaacauaaaucuauuauaaaaaguuaaaauuugucacaacauaugcacacaaacauggauguaaccaaauauaaaggugcaguauuaaaucauaaaugcauaaaauuagcuguaguauauccuaugcuauaauaauuuuuuagccaucuccuuuugcuauuauggugaggccaagugcugcgagaaacagguuacauuuagagucagauuacuucauugcaaauauaggcaaagacucuuaucuuuuguuuucaaauacucuacccaugggugaauaccaaguguuuuccauuguaaaaauaauaacaacaacaaccaugauaacgugauuauuaugauaauaaugccacccuuugugcuacaguuggcauuugacauauuuugaguuauuuucagccucauucaguccuucccauuuugccaucagugcaaaucuaauuugacuuuuucuaaaacagguaagucaacaugggaagggcuggaacacacuuacucaccagugauuuguaguuaagcacauugcucuacaguauuuauugaucagacuuugaaagcuacuuaugcagauauuuagaaugugucacagcccuagacacugggugcagcuuuuauucuggccacuugcucugauguacugcccucugcuauaggcauugaagaguauuuuucuaacauguuugucuuucuguauuuuucuggugcucuguaagauuuuauaaagugcuguucuuguggaguaaagaaauauacauuuuagaccaggcucagugguucaugccuguaauuccagcacuuugggaggcugagguggguggaucaccugaggucaggaguucuagaccagccuggccaucauggugaaacuccacuacuaaaaauacaaaaaaaauucgcuaggcauggugguggguggcuguaauccuaacuacucagaaggcugaggcgguacaauggcuugaacccuggaggcggugguugcagugagcugagauugcaccauuguacuccagccugggcacgaagagcaaaacuccaucuuaaaaaagaaaaaaagaaagaaaaagaaauauacauuuuaaagacuugacucucuagggguauuuuaugagaagaucugacuagggauuuucuuuuauauccauguaaugccaguauauugcuugguacuuuauagcugcucuguaaauguuaauuguaauaaauucuugaacccagaauuuaauucaaugaaguucaguuaaacuuuuauugagccauguacuauguuagaugaagaaaguaaaaauauuggcaaaguaguuucuggacugugaauuccucucauaacuagaagauaaucucauacacauaaaccuguuuuaguauuggagcuuuuaccguagcaguagagacacggaagaaguaaugugggaaggagggaacaguguaauuauuucugguagggauagggaggguuacaaaaugagggugguugucuggccgugggaucugaucuagucuuugaggcuugaggaggauuauaaggcaacuucccuuauccuggcucucucaggauguauuugaaagacaaaguagguuugguuuccggccuuaauaucacagauucuguggaauguuuauuucuuuuguacucagggugauuguuuucccugguucccaugcucaugguauuuuccugccuucucccuuaagaauugccugagguucuguccauugaggaggaaguggaagaaacagagucuugggcgaaaccucucauccaccuuuggcagacgaaguccccuaacuucgcagcugagcaagaguauaaugcaacaguggccaggaugaagccacacugugccaucugcacucugcucaugccguaccacaagguaaaggagccugcuaucauaguucccuucacugcucugccuuccaugugaccacauaccacaagaucacuguaaauuguugugggcuuccuuugcacauaagaaggaagacguccuuagguagcugauggcuuucauagaaccacaaacaguuucuacaugauccuugagagacacuuuucugaaaguacuuuaucuuuuccuuuugagauagggucaugcucuguugcccaggcugaagugcaguggcacaaucaugacuccgugcaggcuuguacucuggcucaggcgaucccucugccucagcuuccacaguagcuacgacuauaggugugagccaccauaccugccuaauuuuuuaaauuuauuuuuuaauuuuuguagcgacugggucuuacuauguugccuaggcuagucuugagcuccuggccucaagcaauccuuccgcuuuggucucccaaaucuuuuuugaguaucuuauuuuauuucauggguggguuacuuucaacuuuucuaucucuuuuacuaagaaacacagaacuuaaagcuuacaaauaguagaagcuuucaaagagagaacuuaaacuuaaucucuguuuuuuuuuguuugaaaacgucauucucaaauaauagaaaugucagcccuagguccaaauuuuaagugucucuuuucaccuucccauguggaacaugcaaaagacacagccaagacucacuacaaacuaaauuuuccaguucauccucaucagcuggcugugcgugauguuguuuucagcgucauuccauagauauuauacugauagcaccucagcuaauggagggucacaguccucagcacucaaacaguugaaauauuuuuaggaaucucguaaggguggaacuaugugguucauuuuaagguacaauauauuaugaaguauauugacaugaacauuguguuuuggguuauauuuuuauuuauagaaacaaauauuuuauucaagauuaugucugucuuagaguuccuuauaaaaauaaacuguucuguucagacauuucagagcaagaaaaugugugauaucucacauuuucagaccuuuguaacagaggaaauaauuuauucccuucauguuuuuuaauguggcacuggugagugacaaacauuauuuuucucuuccuuuagucauuaaauuucuggguuuuaacuacuuauugauucuuauuucuauauuauaaucuguauauuucucaauaauuaaaaaauucaaacuaaaauaauaagauuuguggagauuuaauauaaaguaauacaguauaaaacauaaaguaauauaaaaucuguaagguaauucauuacuuauacuuucaaguaaguacuaaacuuuuuaaaaucuuuuggugugaggugauaauuuuguuugauacauuauccuuucuuauuuagugacaugugccaguucucucucacuugcuuucaaauacugcaagugaugaggcaaaaauucuuaaagccucucuuaauacugcugcacagauuaaaacuggggucuuuguacacuccuucaaguguagcaagguaugauucuucaguaaaugaaaacagaucuguuaacucuagugcauaugaagaagcaaaagaauugaugcuuuccacgaacuaauuuuggaaagacacaguuuuaguagccaguugcuuucuuauaugaacagacauauagaauauuguccuuuuccugcagauuaacauuugggugggagucugagguggaauauugauuuaaaaaaaacuaguaguuuggucaaggagaacaacaggaagaacaaaaguuagaaguuagugucuggaacaggaguuaguggauuugagugacuagaaugaugagcucuuuuccauguuuuucacucauguggaaacguuauguuuuucagccagauagcagcaaugaagaaaaugaugcuagaugggagacaaaauuagaugaagucguuacaucggagggaaagacuaagccccucauaccagagauguguuuuauuuauagugaagaaaauauagaauauucuccacccaaugccuuccuugaagaggauggaacaagucuccuuauuuccugugcaaagugcugcguacggguucaugcaaguaaauggaucuauaauucaucaaucacuggcuuuucagcauuucacaucaucuuuauuucucacuuuuuuggaaccugucagaucuguugcauggacuauuggcauucuuaaugguuauaucauucuuuuucauauuucugcugguaaaaguaugaguugguauauucauccuuuuuucaccacuuucauguaguauccguggagagcaggucugguuuuuuuuguugguuuguuuguuugggguccaguugaggagucaugaugggguuccuuucacauguuuggauuuuacuuacuuuaagaucuaguuuauaaaaacuuaauuugaaagucugauacugauugaugacugcuuuucuuugugacuuuuaaaagagaaaugaauguuccuuugguuguucugagaauuguuguacugaguuaacuuuuuuucauucgugaggauaggaaucucuauuguauuccaggggagaacagucauuacaguuguuuuaccccugcacugggauagucuccacaccuaucucaauuuauuauuuuuaacaauuggauaagugguaaauauuuauuggucugccauguaaauccuaugaacuauguaaaagggaucucauauaauacaacucuauuuuaaggcauuuuaauauuccagaucuuaccaaaucacacauucuaguaacacacuuagguauggccuguacuuugucaauguaguuugaaugguuuauaauauagauauuaucuucuguauuuaccucagaguaauaauuccuuuguauuaggguugaaacagcuuccucaucuaucauuuauuaauuaauuagagacuaccuacuuccucaagggauuuaaaugcuaucugcuugaaauauaaucguagccaucuucuuuuuguauugaaggcaauuuguaacacacacacacacacacacacacacacacacacacaccuuacauuauuauguguauacaauagguaaagcaccaggacacaaaauaauugggauauaaucugauuccugaauguagcagcuaugcaguguagccauacuauuuuauacacauaugcuuuaacucauuauuucauggacaugguuaacugugauagguuuuuuccuugggaaauuacauuucuguuauuuuguuuucaucucaaauguuacagaaauuuucaaaaauuacucauuaaaucuuaacccucuuauacggagggguuuuuaauauuggaaauauuaaaaauuacucauuuaaauauuucagaauucucuuaucucaagaagucagagugacauguguuccuugaugccauauaauugcuauguauauuugcaucaucagccaucaccuuagauaguuauuuugggucaggcgugaacugaauagacaaaucgaauugaaaauacuccuucauugcuaacucugaauuugcagcauuugcccuaucauugagguuaaagguaguuagacuuaauuuuugaagcaauuuuaaauuauauuaauuuaaaaauauuagguuaaaauguauuuauuauauuauuuuugacauuuccuuaaacuuugccccauggauugcaacuuauuuuaagaugucugugugugaacaaauuaguagacuugacaguuuaaaauuuuauuacccauucaagauguuccauaaguauucacuguaacuguuguguuaguuaucaguaagacucacauucaccuugcuuauguuuuguucuauacagugagaaucaagacaguaugguaggcuagugucccauuuuuauuuauuucaguacugagaucugcaauauuuuaaaggugaaaaagaccuaacgcauggauacauacuauuauuuuauagguuguuaugguauuccuucucaugagaucugugauggauggcugugugcccggugcaaaagaaaugcguggacagcaguaaguagcuuauuuuaguauugcuuaaccuuucuucccacccuacccacuguggacacauuuaagucuagggaaaagauaagauugcucaggugcuuauaugugcaguucugcacuuccuuguguuucuagucuucccucucaaaagcaucuuaccugcugguucuauauccauuauagaaauauuagguaaauuuauuuucuuuuuuuuuuuuugagacggagucucucucugucgcccaggcuagagugcaguggcaagaucuuggcucacugcaagcuccaccuuccagguucacaccauucuccugccucagccucccaaguagcugggacuacaggcacccgccaccacgccuggcuaauuuuuuguauuuuuaguagagacgggguuucaacguguuaaccaggauggucucgaucuccugaccuugugaucugcucgccucggccucccaaagugcugggauuacaggcgggagccacuguuccuggcuuuuuuuuuuuuuuuuuuugagauggagucucacuccauugcccaggcuggaaugcaguggcgugagcucagcucauugcaaccuccgccucccagguuaagcaauucuccagucucagccuccugaguaucugggacuacgggcgccugccaccaugccuggcugauuuuuguauuuuuaguagagacgggguuucaccuugcuagucaggcuggucuugaacuccugaccucauuugauccaccugccucggccucccaaaaugcuaggauuacagccgugagccacugugcccgacuauuagguaaauuucugguggcaguccucuacuuaggaagcugcagggacugucaauuuaucguguccacauuuacauuuucaaggcuucagaauuuuucuucauuuucuuguccaucccuauuuugcaauacuugaaaauaaguauuucaaguaacagucaaggugggggauccucagugaccccugaagaaacuguguucauauccaguguuuauuuuucucuuuuugagacagggucucacucugucauccagacuggagugcaguggugcaaucauggcucaccacagucucgaacuccugggcucaagugaucuucccacuucacccuccuggguagcugggacuacaggcaugcgccaccaugccuggguaauuuuuaaauucuuuuguagagacaaggucucacuauguugcccaggcuguucucaaacuccugagcucaagugauccucucaccuuggccuccugaagugcugggguuauagguaucagccccugugccugacaucauaucuaacuuuucaacuagcaugaggucuuuccccacuuacucauccuuacauuuauacuuuaauacauuuuagaguuucuggucuguacuaggcauugcugugaauuuuaggcagaauauuuaauaacaaaugauccccuauuuagagaccaagaauugacuugaccuaaauuguuuuucuaaagaccuuguuaaaaauuuaccuuacuacuuuccugcagauuuuuuugggggcagaagaaaauaauaauaauaauaauguuauaaaaguuuagcuuacuucaaaucuuuguuuuccauucuaacaaucuaugucaacuuuguugccauuugauuaaguuuuaccuuaauuuuucuuaaaaauugucuuucaagaggaaucagaacauucuugaaagugacgaacaaucagaccucagcaguguaugccucacucaugaucucagagcaggugcucagcucgaugauuucagcuguaauagcagcauuuacuuuauuccucaaugaucucuaaugacagagaauuacacuuccuugcaacugaaguuaaaaaccugaaugacaauauaaagaauacgccuuauaugaugaaaauuuuugucaugacuguguauauuuaguucucaguaagucugagaguggugucuuucuggaugauuuuauugcuggcauucacuuuggggagugaaagaagggauaaaaauauggacacucuuuauggucugaauaaucugguauauuuaauguuagagguuuuaccucccauuuaagaagucccugcaucagugggcccagaaagcauuuugguacagguaugcauuacuuaaugacagggauacauucugagaaaugcaucguuaggcaauuuugucauugugugaacauaauacaguguacugacacaaaccuggaugguauagccugcuacacaccuaggcuguacgauguagcccauugcuacuaauguccugaguaguguaggcaauuuuaacacaaugguaaguguucguguaccuaaacauagaaaagguacaaaagacauaacagccuuacaaucuuaugggacuacugucaugugugcaguccaucuuugaccaaaaugucuuuaugugacacaugaccauauuuccuuucaugugauuauuauguuaauaaauguaaagcauauuuaacacagccaggaaguccugcuucuaaucuugaccauacaaauauaucaagcucuuauuuauuauauagguccuauuccuaguauaugagccaacauaaaguauugcagaaucaguuuggucagugauguuaucuccuucgcccugaaucauaaauuuagaaguuagagauuaucugaucagcucaccaaggcauuaagaguucucuguuccauccacaguuacugccuggcuccugugcucacacacugagcaguccuguuguccaagguaccauugucuuugcauggcaaccuagggccaggccuaggccacucacccugauucuaaagcugguucugauugauuaugcuguuuucauguagcauguuucauacagaaaaugcuaugauuaaucacucuuuggaauagacuuaaagcaucuuucuauuaauuuuaacuccuugcccccucagaaaauacaaucuugcuauuuguauuuuaauauugaaacuauguaaaucucugucaauuuacaguugaacugggaacucuugaauauaacauuacaaugauuuuuagaccuacauaauuuauuucuaccuguaagugaucugaauucacaguggauuccacuuguuuuuucagcguauccauuugaguguacuuuuucuaugaagcucccuuccuauuucuguugaaaaaauaauugaaugaaguuuaaauauuguagaaaaguaacugacaguauugauauucugacuuuaacccucugauuuagugucguggugaguguuacaauauuaauuuuuacuaaacacuuaaguaugauuucuuuaaauuuuguggcugcaaugauugcauuuuuaaaguauccuuaaaacugacuucuucagcaaucaaucucauaucuucaguuuuacacuccagaggagcccuagccuccuuguaaauaaagggcucuaaaggagcucauggaaaucaaauagugcagcugaagucagaugauauuucauugguggcuuguaguucacuaacucucauuccuaauucccuggaauuuuuuuuuuaaaaaaccugccuugugaagguaagguuauucaucaggaacguaaaauauuccuauagcauauucaguuugagacacgugauuauacaacaaauuuaauuguucuguugguguuuccuuucaugguaagugcuuuucaacgccucguguucauuuuuuaugagguauaugagaauuguauguggugguucuauuuuuuaaagauucucuuuaaaaagagagacuauauuauaaaaauauaauauuuuuauauauaaaaauauaauauuuuuauauauaaaaauauaauauuuuuauauauaaaaauauaauauuuuuauauauaaaaauauuuuagaagcaaagacaucuuauuauuucacccauucccagacauaaauaaauaaauucauacuaaaauggaguaauuuuuucggcuucagccugggcaaaacagaaaguggaggguguacgcauggcuggagucaauaaucauagaucagcucucuuuuuauuuuccaauucuaaagaguagaugucgcucuagacucaaauuaggaagauagagaucauagugaugugggcuggaucuuuaucugugacuuucuguguccucaucauuucuaaagauuagcuucagacgucacucugauucauuguguucccauuuucuuacuuuuccauucacguccauuaaaauaaaaaccaaaauauauauugcagcuucaauugcauaugcuugaggagagauuaguuacaauuuuuuauuguacccuaauuuggauucuagaauuauggcccuaugcccaacuucaacugaaaugaaaugauacaaagaacuccacaaauaacugucaauccuuggauacaguuuauauauuucauaauuccaauuagauaucaucgcuuugagucccugccuuacccuauuucaguauuacccaaauaaauaggcacaacuaucugacagcuauagcguuugacuuauggcuuauaaaucagcuuuauuauuucauuuucagcucuguuugauugaaacccuuuuuggucaauuuauauaauucuuuuuggagcaauuuuuccuccuuuguuauauaaucauuuuagagcacguuccaaacauuaccaaauccagauuuuagguaucaaaagucaauacucuugauauuaguaucugugucucauuauguugacucuucauguacaucucacuacuuuuuaaaaaauauuuuuauuuguaauuuuuuugguauguuguaaguguauauauuuauggguuacaugagauacuuugauacagacaugcaguacauaauaaccacaucagguuaaaugggguguacgucauuucaagcauuuaugcuuuguguuacaaacaauccaguuauacucauugcguuacuuuaaaauguacaauuaaauuauuuuugacuguagucaccuugcuguguagcaaauacuguuuuauucauuuuccuuuuuuuuuuuuuguacccauuaaccauucccauuccccucacccccaccacccuuccuagccucugguuaccuccuagccucugguaaccauccuccuagucucuggcuucauguguucaauuaguuuuuucugauuuugugaagagugucaaugguugagcaccuuuucauacaccuguuugucauuuguacauacauauauauauguguguguguguguguguguauauauauauauguauuuuuuuuuuuuugagauggggucuugcucuguggcccaggcugcagugcaguggcacaaucucggcucacugcaaccucugccucccagguuccagcaauucucagccuccuggguagcugggauuacaggcgcaugccaccaugcccggcuaauuuuuguguuuuuaguagagaugggguuucaccauguuggccaggcuggucucgaacuccugaccucaggugaucugccuucgucggccucccaaagugcugggauuacaggcgugagccacugggccuggccugucguuugcauauuuucuuuugaggaaguucaauucagaucuuuugcccauuuuuuaaucagauuauuagauauuuuuccuauaguguuugaguuccuuuuauauucuaguuauuacuccuuugucagauggguaguuugcaaauguuuucucccuuucuguggguugucucuucacuguguuuuucuuugcugugcagaagcuuuuaaacuugaugugaucccauuuauccauuuuuacuucguugccuguguuuaugggguauuacucaagaaauuuuugcccagaccaguauucuggagaguuucccaauauuuucuguuaguaguuucauaguuucaggucuuagauuuaagucugcaguccauuuugauuugauuuuuguauaugggaagagauaggggucaaguuucauucauuuccauuuaaguaucuaguuuucccagcaucauuuauugaagagacuguccuguucccaauguauauucuugucaucuuuguugaaaaugaguuuacuguagauguauggauuuaccucuggguucucuauucucuuccacugaucuaagugucuguuuuuaugccauuaccaugucauuuugguuacuacagcucuguauuauaauuuuaaguuaggcaauaugauucuuccauuuuguucuuuuugcuuaggauaguuuuggcuguucugggucuuuugugauuccauauaaauuuuaggauuuuuuuucuauuucugugaagaaugucuuuaguauuuugauagggauugcauugaaucuuuagauagcuuuggauaguguggacauuucaacaguauugauucuuccaguucaugaacauggauuaucuuuccauuuuuuuguuuccucuucaauuuuuugcaucaguguuuuauaguuuucauuguagagaucuuucacuucucugguaaguuaaauccuagguauuuacuuuucuuuguagcuacuguaaaugggauuacuuucuugauuucuuuuuuagauuguucacuguugguauauagaaaugcuucugauuuuuauguguugauuuucugcaccuuuacugaauuuaucaguucuaguaguuuuuugguggagucuuccaguuuuuucaaguacaagauuauaucaucugcaaacaacaauaauuugaauucuuccuuuccaauuugcaaacccuuuauuucuuuuuuuuuuuuuugucugauuacgcuggcuaggauuuccaguacuguguugaagaacaguguugaaaauaggaauccuuguuguguuacaggucuuagagaaaaggcuuucaguuuuucaccacuuaaaauaauacuagcugugaguuggucauauauggcuuuuauuguguugugguauguaccuucuguacccaguuuuuugaggguuuucaugaagggauguuggacuuuaucaaaugcuuuuucagcaucaauugcagugaucauacgguuuuuguucuucauucuaaugauaugauguaucacauugauugauuugcauauguugaaucauccuugcauuccugggauaaaucccacuuggucaugaugaaugaucuuuuuaauguguuguugaauuugguuugcuaguauuuuguugaagauuucugcaucaguguucaucagggcuauuggcugugguuuucuuuuugauguuuccuuugauuuugguaucaggguaauacuggccucacggagugagcuuggaaguguucccucauccucuacuuuuuggaagaguuuaaguaggauugguguucuuauuuaaauguuugguagaauucagcacugaagccauuggguccuaggcuuuucuuuacugggagaccuuuuuauuauggcuuugaucucauuacuuguuauuggucuguuuggguuuuggauuucuuuaugauucaaucuuaguagguugaauauuucuaggaauuuacccauuuguuuuagauuuuccuauuuauuggcauauaguugcuccuaguagcuacuagugauccuuugaauuucuguaauaucagcuauaaugucuccuuuuucaucucugauuuuauuuauuuugaucuucucuccuuuuuucuuacucuggguagagguuugucaguuuuguuuuucuuucuuuuuaaaaaacaucuuuuuguuuuauugaucuguuguguucucauuucaaauucacuuauuucuacucugaucuucauuauuguuuuucgucuaauuuuguguuucguuugcucuugcuuuuguaguuuuuuaagaugcauuguuagguuguuuauuugaaguuuuucuucuuuuuuuauauaagcacuuacagcuguaaacauuccucuuaguauugcuuuugcuguaucccauagauuuugguguguuguguuucuguuaucauuuguuucaagaaauguuucaauuuccuucuuaguuucuacauggacccacuggucauucaggagcauauuguuucauuuccauguguuuguacaucuuccaaaauucuuuuuguuauugauuucuauuuuuauuccauuguggucaaagaagaugcuugauauuauugcacuuuuuuugaacguuugaagacaaguuuugugaccuaacaugaccuaucuuugagaaugaucugugugcagaggaaaagaauguguauccugugaccuucguaugaaauguucuguaaauaucuguuaggucgauuuggucuguaguguagauuacgugugauauuucuuuguuacuuuucuaucuggaggaucuguccauugcugagugugguguguugaugucuccagcuguuauuguauuggagucuaucucucuuuuuaucucuaauguuuucguuuuuuuuuuuuaauuuucuuuucaagguguuuuuuuuuugaauuuuuaaaauuauuauuauacuuuaaguuuuaggguacaugugcacaaugugagguuuguuacauauguauacaugugccauguuggugugcugcacccauuaaccugucauuuagcauuagguauaucaccuaaugcuaucccucccccguccccccaccccacaacagucccuggagugugauguuccccuuccuguguccauguguucucauuguucaauucccaccugugagugagaacaugugguguuugguuuucuguucuugcaauacuuugcugagaaugaugguuuccagcuucauccaugucccugcaaagggcaugaacucaucauuuuuuauggcugcauaguauuccaugguguauaugugccacauuuucuuaauccagucuaccauuguuggacauuuggguugauuccaagucuuugcuauugugaauagugcugcaauaaacauacgugugcaugugucuuuauagcagcaugauuuauaauccuuuggguauauauccaguaaugggauggcugggucaaaugguauuuguaguucuagaucccugaggaaucgccacaccaacuuccacagugguugaacuaguuuacagucccaccaacaguguaaaaguguuccuauuucuccacauccucuccagcaccuguuguuucgugacuuuuaauguuuucuucauauaucuaggugcuccacuguugaaugcauauauauuuaugauuguuauauucucuugcucaguugaccucuuuauuauuauauagugaccuuauuuuucucuucuuacaguuuuugucuugaaaucuauuuugacugauacaaguguagcuacuccagcucuuuuuugcuuuugucgccauggaauaucuuuuuuucaucugcuuauuuucagccuaugugugucuuuauaagugaaauguguuucuuguagacaacagauaauugggucuuguuuuuuuauccauucagagccacucugugucuuuugauuugagaguuuagugcguuuccauuguuauuaagaaguaaggauauguucugccauuguauuguuugucuuuugcuuguuuuguggucuucucuuccuuucuucauuccuucauuucuuuuauugaaggugauuuugucuugugguaugauuuaauuucuuccuuuuuauuuuuuagguauauguuauaugguuuuugauuugagguuaugaugagucuugcaaauauuaucuuacaaccuauuauuuuaagcugacaaccacuuaacauugcauaggcaaaaacacacagaggcaaaaagaaaaccaauaaaagcucuacacuuuagccucuugcuuuuuaacuuuuuguugucucuguuuauaucucauuauaauuucuaugucuugaaaaguugucauuauuaguuuugguugguucaucuuuuagucuuucuccuuaagaucagaguauuuuauauaucacauuuacaguguuauaauaugcugcauuuuuuuguguacuuacuauuaccagugaguuuuggaccuucaguugauuucuuauuacucaucaacuuccuuuucuuucugauugaaaaacucccaggcuggacacgguggcccaugccuguaaucccagcacucugggaggcugaggugggcugaucccuugaggucaggaguucgagaccauccuggaaaauguggcaaagcuccaucuguacuaaaaauauaaaaaauuaguuggguguuguggcgagcaccuguaaucccagcuaccugugaggcugaggcaggagaucgcuugaacccgggagacgaagguugcagugagccgagaucgcaccgcuguacuccagccugggugacagagcgagacgccaucucaagaaaaaaaaaaaaaagaaacagaaaaacucccuuuagcauuuauuguaggauagguaugauguuuaugaaaucccucagguuuuguuugucugggaaagucuuuuuuucuccuuuacguucagaggauauuuucaccagauauacuauuuuaggguaaauguuuuuuuuucuuucagcacuuuaaauaugucaugacacucucuccuggccuguuagguuuucacugaaaaaucugcugccagacagacauauuuggagcuccauugaauguuauuuuuuucuuuucucuugcugcuuuuaggauccuuuuuuuccccuugaccuuugggaguuugauuauuaaaugccuugggauagucuucuuuggguuagaucugcuugguauucuguaaucuucuuguacuuugacauuaauaucauucccuagguuugggaaauucucuauuauucuuccucuugaccaacuuucuacccucaucuguuucucugccucugcguuaaggcuagugacucucagauuugcccuuuugaggcuuucuugauccuguaggugugcuucacugguuuuuauucuuucuucuuuugucuccucucauuguguauuuucaaauaaccugucuucgaguucacuaguuccuucuucugcuugaucaguucuguccuuacaagacuuugaugcauucuucaaugucaguagcauuuuucaacucagaauuucuacuugauucuuuuuaauuauuucaaucucuucguuaaguuuaucugauauaauuuugaauuccuuccuugugguauguugaauuucuuugaguuuacucugagcaguuacuuugaauucuuugagaggucacauaucuguguuucuccaggacuggccccuggugccuuauuuaguuuacuuggugagaucauguuuuccuggauugucuugaugcuuauggauguucaucugucuaggcauuaaagaguuagguauuuacuguagucuuccaagccuaggcugguuuuuacccauucuccuugggaaggcuuuccagguauuuggaaggacuugagcauugugaucuaagcuguaucugcauuagcagacaccccaagcucaguaacacugugguucuugcagacuugcagagguacugucuucauguucuuggauaaaauccagaggaauuuucuggauuacuaggcagggacucuuguucucuucccuuacuuucuuccaaacaaagggagucucucuguuuguucugagccauguggagcuguagguagugugacagaagacucucuguuguuaccaccucuaggacugugcugguucagaacugaagcaagcacagcauuagaucucaccuaacgcuggcccacuguaaccacuacuuggcuaccagauacuauguuugcucaggccuugggacacuacagucagcagauggugaagcuagcuaggcuuguguccugcccuucaugauggugaguuguugugggcccaggugcguacugagguaccauccaggagcuagggacuggagugagaaaccuuagaagucuuucugguguucugcuguccugcagcugugcuggcacucaaaccagaagacacaguacuucucaccuuucuuucccauuucuacuggcagaggagccucagcccaugaccgccacuacuacaggcucauggagaauacugcugggcuaccaccaauauucaguuaaggcccuagggcucuuaagucaguuuguggugaauagugccagccugggacucacccuucgggacacugggcuccccgcuggcccagaacugguaaagaaaugcuaagagccaaggccuggaauugaggaccccaagauccugcuugguacuccaauuccuguggccaagcugguaccuaaggugcaagagaaagucaccuuuacuuuccccccuacuuuucuuaucagaaagaaucucuccuuguggccaccauuaccuaggaaugugcugacuugcaacuaaaguuagcaagucucggagucucacccaaggcucacgggguaccaucuggguaucacugcugguuauucagggcucaagggcuguuuagucagcagaugaugggucuugccaauacuggguccauuguuucaaggcagugaguucccuuccggccaagggugugucuagaaauguccaggagcuaggcccugcaauggagccuucaugacucugcccagugccauguccuacagugggugagcugguauccaagaugcaaggcaaaguccuuuuuacucucucuucuccucuccucaagcagaaggaagggaucucuuuaauugagcucugcugccugaaauugaggucggagguggcacaaguacuuccucagcugccucgacuggugucucaguaaguugaauguccaguggcucugagcccaguccagcaccaugacucgccuaggaguugcaguucuuguggccuagacugccuuucauguuuauuucgcaccccagaguacucuagcccgugguggcaaggcuugcuggaacugggaugugugaucucccucugacguggacugguuaaauauucccucugugggcaggcgccaggucagcucagccagguuugcuuucucuuguaacugggcagcacggaauucagugcauucucuuacaauuucugugcucuccugugccaugugaccguugccaggggauaagggaggggcggcguuggugauucaagacuguuucuccuaccgucuucagugccucuuucagugauaggaaguuaaaaaccagguacugugggugcucaccugauuuuugguucuuaugaagguacuuuuuuauacagaugguuguuaaauuugguguuccuccagaggggaugauucguggagccuucuauuuggccaucuuguucugcccugucuccaaaauccucucauuacuuuugacuuaaguuucuacaguuugugucuaaucugugcaucaguuucuccugcaggcuauugcuaauuuaaaauuuaaugccaauaugcucaccauaaaaauguagaauuuggagagcuuucuuucuggguuuccccccaccguuuuuuuuuuuuuuuuuugccuauacugaaaauuguuaaggcuaaguauuucugugaaauacaucaacacuacuuuagggauauacuuuuaauuaugaaggaggauguuaguuaaaugccuggaauauguugauaaccuaaauguuuaccucuauuccaauaaauuauaauccaaguccuuaaucuucuguagaguauuacaagguaauugcuaauaaguaauaggagaauuuuuugugugaucuucugaagaauuuaaauuauaaaauucuaaagaguaaauauaaaaauaaaauuaauauaagaauaaauuaauaaacaaaaaggaauguguguaagauuauuuuuuaauuugggggacaguauagcauuugguagauguuucucuccaggaaauuuggauguuucuuccaggaccuuucggggacugagggcugugggauuuuguuagagugccacaaauaugaaugagaacugcaugugaagauugauaauguaacaucauagaaagucacagaauguaacauccaacucccuuuuaugacuuugaccaaucaugaguugccuggaaucuguacauggcagcauuaagccuauggugucauuguuuauugccaguuugaaaaacuccaaauaaaguaucaguugugcuauguccuucuagggagcuuuuuuguuaccuuaaagaauucuuggaggucaggcaggguaaauacaguagccaguauaccuauaaucuagauauuaaaucaaaauugaaggaagauguaaaaguaauauaaugagaagauuuggcuuuauuaaagaucuucagccaagguucuuuuuggcccuagaauuuguuuauucuggcuugcuuuguauuuccauuuugcuuuaauuaguuugucuuaaaaauuagggaccuuaaauaaaacugaauuuacuuacucauugcauuuuuuaaccuagaggugguggguaagagaaauauagaagaauaacaugugacacugauaaauacugaccagaugacuaauuacaugucauuauauauuuucaucauuauacaucauucaucuaugaaaaugcuguguuugauaguauaaugguaaauauaugucauuauacuuuuguccaacccauagaauguacaacaccaagagugaauccuaaacuaaacuguggauucugggugaugaugugucaguguagguucaucaguuguaacaaaugugcugcucuggugggggauguugauaaugauggaagcuauguaugugugcaggcaagagauaauugggaaguuucuguacccuucaauuaugcuaugaacuuaaaguugcuauaaaaaauaaagucuaauaaaaaaguuauuuuaaggccuuacuguaacccugucugcuuugaugcaaaguacauuguauuuuaaauuccauuuuauuucaauauaugccuuacaguuaauucaggagaauuugaauauuuaugcuugauaguaauauaguacaacaaaaaaagcagcuauccauuauaccauuauaguuuuggaugacuauugccaugcuaucaaaaacuagauuuuguaaugaaaaauguaagagcacuuuauagguuggaauucucauuccauauaauggaaugcauaaacuagguaauuaugcacauuuauuauuuacugaaaagcauuuauuuuacucugcagaaucauaaagaaaguuguauuuauuauguacauauaauaaacauaacauucuuuuucuuuuucccaaaaugguuuuaagaaaucaaaacccaaacaugaaauggguuuccaacuuagccauacauguauucauuguguccuuuauuuuacuuguuuauuuauuuauuuauuuauuuauuuauuuauuuauuuauguauguuuugagauggagucuggcucuguugcccaggcuggagugcaguggugugaucuugguucacugcaaccucugccuccuggguucaagugguucucuugccucagccuccugaguagcugggauuacaggugcacacccccaugcccagguuuuuuguauuuuuaguagagacaggguuucaccguguuggccaggcuggugucaaacuccugaccucugguggucugccugccuuggccucccaaagugcugggauuacaggcgugagccauugcaccuggccaguuuuuuuaaaaauuguaguaacaauuagauauaagcaaacuauaucuugaugaucacuuggaauuagcuuuccuuuuccacuuacaaagaauggaauauacaauuggagugauuuuaaaaaaaacuauuuugguggcuguuuauguguacauauauacacacacagauacauauauauguauauauaaacagccaccaauauuuuauauauauauguguguguguauguguguguguguguauaaaauauugcuugguuauaaguaaguggcaucugcauauuaaguaaugguugccacuaaugcccuucagugcugcacguggccauuuuauuugucuucugaaccaaagugaagucauuugucugcauaaaucauaguuauagaauuaacuuccagaacuaucugagguguaauggucuucauaaaucccacuccccuaguacugcuaaauuuugugagcuagagauuguaagugacuuguugaaaaauauuuaucagaccucuggaacuuuggaguauaccuuagucuacuuuccaaccuuaaguuucagguaaagacaauucaugucuuagaaaacugguaacucuugacaucuuugugaaccacgaagcuccaaccccuguaacucuguauuuacuuuuccauaauauuaggcagguggugaaagaauguuagguagaaucuuugacucccaacacuguuugaagcugaguccaauaaauugagcguaauuccuguagauggaggcacaucucguaagaagcaaccuaacuccauucaguugaaucugaaggcaacuuucuguccugucuacagcaagaguuagcuuaggguagagauuauuaaagaaaauuuguaugguugaggauuauguuacuuuuauuccagaacacaaccuuuauuaccccuguccaaccucccaaauaaaaauaaugaugcugauaauugauguuagaaauuaccaagcauuugucucuuggaaucuucugcuuuagagaaaguaguuucauuuucgaacuuuggaccuauguguucagaauaacuauggauuuucauguaagcuaauauaacuagcagggauagacuuuucuuuauuuccacagaacuugauaccgauaaaggcuaaggaauucuucgucuaucucagaagccucguuuuacaacuaaugaaccggaggguguuagaguugugauuccuuugcccaggaucacucuuguguguccuaagagaaccaggaugccagaccaucucauucccaggccuugccuccucugcucagcuuuuguuuuuggaggggaaagaaggccaagccacugaccuaauccugaacaauguauuugacuaguuuuuguuuguuuacauugaaaauaaagccagcacuaacuucuggcguuacugguuuucuacuuaacguagaauaauuagcauuauugguuggaugagcagguucuuuucccuuucauauguacucuagguucugccuagaggaccuuucccagaacuggauaacgucuugaauucaauuucccaacugacaacagcauuggcauuuuucuuuuucgaagagcucugaagcggcuuuguagaucagagcgauugauuuugagaucagauuggcuuauggccuugagaguucaugguggcauugcuguucccucugaucuguuuuaugcuggauuuuuuuuuuuuuuuuuaauuccacgggauacugucaagaccaggugaugagaggcugucagccugcaaggccgacuuugaucuuuauacaaaguaaaacuaguggaaaaagaaaggcccgguucuugucaaaggcaggacauucaccauugggcggguagccaagugguugcuuuugcuaucuuauucuucccuacuguggugucucuuaaaacacuggacaggacucuccucucucauuugagguaauagauuuggcuucaaaaucaccucuugccuccugagguggcagauuauucugaauugcugcagacuuaaaccuuggccugcaaaggccauggugguaauaauuauuucacuuuaaccaaacagaagagcacauaagaggauaucaguuauccugacagcauagcuaugauguggaagccguccuguuagggaacugcugaguggcuaaaaagucacaaaucauuuuucucuguucuuuccucuuucuuuugcucaauaacaccccccaccucugcucuguaauggagagaaauaaaaagaaguuuagauagcuuacuguaaguggaacuguauucauaaauagcuucuugauugagaacaaaugccucauuaaucuuuagugcuucaacuagaaagcacaaguaaagucaagaagaauaaugagugacauuacagggagccuaacauacuguacuacacaccaggcugugcuugccuggaggucacugggcugcaaggcacaucucuuuugcaaugaggagagagauccccaggaagaguguggaaaaacugcagugcaggcauuucucuugaguggcaaaaauuaauucagugacaugaugaagaaaucauguacuuuuuuuuuuuuuggugguggugguggggcaucaguuggucucucaaucugauuguugcuuuucuuaaaaaauuguuuuuuaaauugacauaauuguacauauucaugggguacacagugguguuucaguacauacaauguauagugaucagggcaauuaacauauccgucaucucaaacauuuaucauuucuugauguugggaacaugcaauaccuccucuagcuauuugaaauuguauguuauuguuagcuauagucauccuacacugguauagaccacagaaauauagaacuuaguccuaucuagcuguaauuuuuuaucuuuuaacacaucucucccaauuccuccuuucugucuauccuucucagccucuaguaucguuuuacuuuuuacuucuaugggaucaacuuguuucagcauccacauaugagugagaaugugcaguguuuaauuuucuguuccuggcuuauuucgcuuaauguccuccaguuccuuccauguuguugcaaaugacaagauuucauuccaugguguauacaugccacauuuucuuuauucaucuuucauuggauaccuagguugauuccauaucuuagcuauuuucaacagugcuacaguaaacauagagggggcauauaugucucuuugauauaaugauuucuuuuccuuugcauaaauucccaguagugguauugcuguaucaugugguaguucuauuuguaguuuuuugaagaaacuucauauuguucuccaugguggcuuuacuaguuuacauucccaccaacagugauaagaguuccuuuuucuccacguccuuaccaguauuuguuacuuuuugucauuuaauaauacacauucucacuggggugaaaggauaacucauuguaguuuugauuuacauuucccuggugauguuuacccuuucuuuuuguauauuuguuuuccauuuguauguauuuugugaaauguauguucagaucauuugcccauucuuuguuucuuuuuguuuguuuguuuuugagacagggucucacuuccauugcccaggcuggaguuuaguggugcucucucagcucacuguauucucuacuuccugagcucaugugauccucccaccuuugccucccaaguagcugggacuacaggcacaugccaccacacccagcugaguuuuuguauuuuuaguagagaugagguuuugccauguugcccaggcuggucuugaacucuugggcucaagugauccucccgccuuggccucucaaagugcuaggauuauaggcaugagcuaccaugccuggccauuugcccauucuuaaaucagauuuuuuuuuuuucuguugagauguuugaguuccuuguguauuccagauaguaauccucuuuuucagaugaguaguuugcaaauauuuuuucccauucuguaguucuucuuuucacucuauuauuuccuuugcugugcagaagcuuuuucgcuugauauaucccauuuguuuauuuuugcuuuuguugcccuugcuuuugagguuuuauucauaaaaucauuucccagaccaauguccugaaguguuucccuuauguuuucuucucauaguuuuauuguuucagaucuuagguuuaggucuuugauucauuuuaaguugauuuuuguauagggugagaagugggagucuacuuucauucuucugcauguggauauccaauuuuuccggcacuguucauugaagagacugucaauucccuaacgaguguucauggcaccuuuguccaaaucguaugacuguagauaugugggguaauuucugggcucucuauucuguucccuugauguaugugucuguuuuuaugccaguuccaugcuguuguugguuacuacagcuuuguaguauauuuugaugucuaguagugugaugccucuagcuuugauauuugcuuaagcuugcuuuggcuauuugggaucauuugugguuccauacaaauguuaggguuauuuuuuucuguuucugugaagagugucauugguguuuugauagggauugcauugaaucuguagauugccuuggguaauacugucauuguaacaauguuaauucuuccaaucuaugagcuugggauguuuucccauuuauuuguaucuccuucaguuucuuucuucauuuuuuuauaguuucucuuauaguggucuuucaccuucuugguuaaauuuauuucuagguauuugaaaucaaguacuuugcuguuuguugucaguggucaugcugggaagaaagaauaagccagcuggguuuuuauuugaaaaccaaauguuguauaacguuaacaaaguaaagauguauguucaucuuggagucuuugcucaggacccuggaaauacuauuauguaaauguuguaagcuccauguagaguacuucugaccagucuuacauguuucuugccacuuaauaugugccuggcuuguaacauagcuaccagagcggugcucugaacaccucaaauuaauuuucauagcauuguaaacaaacagaacaugauuuucuguucuucuguucucuuuuauguaaauugucgucugcugauauuuaaauagauaaaauauaguaaguuuacuugguuaguguuguaaauuagaugaagaaaaacuaaauuucuguaaugcaaaaaauacugaaugaaaauucaguuuguauauuaugacuuucucaauauuuucaguugguuagaauucaagccuacuucacuuaaaagauuugucugcaccaccccccgauauaagucaacugugagggcaggaucuuugucauucacuguguugcucagggucuagagcacaucauggugauuaauaguuguugaauuaaugaaugaauguuuucacuaagugagagaacuuacuugccaguacagaauucauuacaggugaauuuuggauuugcaaauuuguggaauuuccauuuaaaagguacugcaggacacuugucauucaauuauauaaucacucagaacucauaccagcucuguccuucggugagagauccugucuucucuccagcccugauaaugagccacauauccagaaaugguucucccaugucuugcugaucagcacggguuuucuguuaaugugauuaauuacucuuuguuuucccagcucagagagcccuauuuuacgguuuuguguuucuguuaugaacgugucagauaaaugaggguguguuuguggggguacuucaaucuaauuauuuuucuaugacacugaaaauuggcuuuaguggcacuuauggauaugcuacuaaaaugagagcuuccuacaaugcagcuugagaauguugguauuggcauuucuuuaacugauguuuuauagaagagacauuggaacaugauuucccucggcugcaaauaaugaacaacugugacagccauauuacaacaaugcuguucucaccacugucaauguugugucagcauuuugauuauaaauacucuuuuccaugguuuaauaacugaggcauaaagaaaucauuccauguuaugaauugcuaugcuaacuuuucaucucaguggugauuuuuuaugaaaccaaauuuuaaaaauagcuggcauuguuaaaaggggauuuugucagugguauuaggugagcgaaagggaccucaucaggaaaaguacaaaacuguucagaauaugaucagauuuuauauuuuuucauuuaucuuuuaaccacccugaggaaaaaaauauacagcagaaugguuuuuuaaaugcuguucuuuggagacagaaauaacagcugccuuauagaguaaucauguuacaacaggcauuuuaguauauauauuuucuguuuuguuuuggggaacauuggcugacuagcaguauagccagaucuuuguaauagugaaucauuuuaugcuggguguuauuguuccuggaaaagccaugcucauuaaacauaaaacaaggcuggcaaugagcacagacuguuugauuuuauuuauuuauuuuguucuguaaggaugaacaguuuugauaucaccguagguuagauuggaaagaaguuauaguacacugaaagagucuggaagagaucauaggugccguuuuaaauuuucaucuaauuaaaagaaaauagaaaaaagauauaaauacccacagucacauuaauuuuaaauuguacguuucuuguaaaaagguuuaauuucuuuaugugugugucugugaguuugcuuucuuuaauacaaaggaacuagauauuaucaagaaagucucccauuuccaacacucucaaaaucucaaauuucauuuuuuacagaaaacuacuuaagcuguuuugucaguuggccuuucagcucuuuucuauguauuauaaucugguguuauggcuugcuguaugggacccaaaugauaucacaauuuauuuaacuuuccuuaguguuuucccuucauacuacuuguuuuaauucuuaguaucccaguggcuguggauuuaccaugucguuuucauuacuguuugaaauuuuaagcuuuguuauaaaaauuuugacauuacaaauaaaauuuuggcuucugauaauuccaguucccaccagagguaacuauuuucuccauuauaaacagaaaugaaauuauagucguuauauaguccuucuccauagauucaaauauuuagguuagauuauaagaagucagccugcugagucauuauuucugugcauuuaaauuuuaauggacaauguuaaauucuucuccguaaccaucauaacagcuuacaugacccccaaacuagauauauucugauuuaaaauguaagguuagaucucauucuuuuccuuuuucauuuucuuuauucuugagguugguuuucuuuucaugugcuuacuggcaaugaagagccauugaacuuuuuacauauuuuuuguaacugugggcuuuaaaaaauauuuuccagaaaacaauuuuugauauauguauugggaguauuuuuguguuauuuuauguuaauuauguuguauuuuauucuuuaugauuuuuaaauuuugauauguaucuuuugucuuuuaaaugucuucuuaaggagccguauuuguccuaacuucaucaguauauuuuccuauauuuucuuauaauacuuuuauaggucuguucuguuuuuaaguuuaggucuguaaaucaauuggaguauauuuuuuaugagugagggacauaacacauaaacacacacuccauucaguuggaucuggacauuuugaauacuguuacugaauaguuuuuggugugagguuuugguuauuuauucagcucugucuuucuccucucuaauucuguucuuaggaguaaucugcuauucaacauauuauuuauaagucuaauuucaauuuuuuuguagaauucuguaugguugauuucuaaaaauauaauuugucauuuagagucucuuuuuuauauuuuuaauauacuuauuuuuaaaaacuuauuaaaauacagcugacccuugaccaacauggaagucagaggugcugacccccaguucagcuaaaaaucugcauauaacuuuggacucccccaauaccuaacuaguaauagcuuacuguuuacuggaagccuuauugauauaacacaauuaacacacaguuuauauguuauauuuauuauaugcuguauuuuuacaauaacuuaugcuagggaaaagaaaauguuauuaagaaaaucauaaggaagagaaaauauauuuauucauugaguggaucaucauaaaggucuucauccuuguuaucuucauguugaguaggcugaaaaggaagaggaugagggguuggcccagcugacucagggguggcagagucuauauauaaauggccccaugcaguucaagcuuacauuguucauggguuagcucuauguauuuugcauuuuguggcucauaucauuuugcaucuaauuccacuacuaauuuuugcugauagaaccauguuucuuguguuuuauugaguuuugauugugagcuuauguuucuuagaauucaauacugggaaauuuuuagaggccuuuguuauaagugguugccaaaaauuacaauuuacauuuuugaaugagcacacucugccuucaaauaauauccuacuucaugaacaguguaagacucuuaaaacaguauaacuucauuagcacuucccuuugauuuguggucuuaucuuacauuuuacuucuucauauacuauacuccacaguguuauuauuuuuguuuuaagcauuugucuuuuaaugaaauuuguucauucucucuuucccuuuccuucccucccucccucugucucucuuucccucccucccucccuuccucuuucccucucucucuaccccacucugugugugugugugugugugugugugugugugugugcguguguaugugucugugugucuguuuguugaagauacuaaaaaaugauuuuauauuuacccagguauuuuuggaguucuucauuccuuccugcugauccuugguaacgugugauuucauuuuccucauucugaagaacuuuauuuuggcauuuguuaugauguggaucuccuggggacaaauucuguuagauuuuuaucacacugagaguguuucuauuuuuccuuuuuuuuuaaaagguuguuuucuugggagguagacuuuuaggcuggcugcuuuuucuuguaguauuuaauagauauuauuccauuaccuauuugccuucacaauuucagguuagaugucacuuguaacucauauaauuguuuacuaaauguggcuuuuuuuuucucugauuuuaagauauguucuuuuuauuugguuuccagaauuuugauugcuauguagccagguauguuuuauuuauauuuaucuguuuagaguuugcugcaauuuuuugaucuguagguugauaucuuuuaucaguuguggaaaauuuucugucaauaucucuuccaauauuaucaccccuuuucucuuuuuucaccuuuuaguacuccaauuauacauaaacugaguaguuuuuuuuuuucccuagaucuguauugguuuuuaaaauucucuuuuugucuuucaauucuauacauauggcccucuguauccauggguggauauguggauucaaccaacuguggaucagaaauacauuuaggccuauaaugguugugucuguacucaacauguacagacuuuuuuuccuugucauuauucccuaauugauacaguauaacaauuuacauaucuuuuacauuguauuaaguauuauaaguaaucuagagaugauuuaaaguauacaggaggauaugcaugguuuauaugcagauacuaagcuguuuuauauaaaggacuucagcaucucuggauuuugguaucugugaggggucuuggaaccaaucucccuuggauacugagggucgacuguacuuccuauucauuugucucuauagucauuaaacuuuuacucugccaauuccaguuugcuucucaaucuguugaaugaaaucaacauuuuguuuuuuccuaucuugaucauaaaugauuuuuuuuugcuuuuuauuauaucuuguacuuuuuugauugugugcuagacauuuugucuaugaugacugaaaugaguauuauuauuuccagaaagggugugcugcuuuuucucuuagguuccuacaguggggugaagucaaucugauuuauauuugagcugggcaugugcuuuauugcagcuuuaguuugauuaaguccacucagguuucagguguuuugagggugggauuaggacuuucccuucugcagggucuguuaucugggcgcugaggagauucugaagaucugccugccuuucauaguugagcuggcagcuuuuaagaacuauggaauaucuuuugcuguuuagaccacaguugccuggacuuugaguuccuggagaguuuucuuuucucuccacuucuauuucuugcuuuuugcaccucaagaggauuauucaucacagauccauauuuuuuuguuucccgcuaaacagcuacacugagauuauggacugacaauguuauauuuauguuaucuagaaccacaguuaaucuugugcauguuuaacuacuguaccuuucguauuuaguaugugcuuagggaauguuuuacauacauuaauuuagggaaguacuaauuuuuuccucuacagauaaaguaucugaggcacagagguugaguaacugaucacagucauaagaguaauaaauggcagaacuuuuauuugaaccuggccaucugcauuauauuaaacauugugauaugucauggcucuccaguuucacuguuguuccucucaguuaaauuugauucauuuagccugagguuauauugcguaacauaacuaaaaucuugguuuguuuuaaaugguaucauuacuucgaaggauaaaguagggaaaacuuaaugauguuauaccaaugagauguuuuauuagcuagauuaaugaaacaaauaggaacacaaauuguuauaugcugucggguaacacaauuuuuuaugauauggguucuuuugcagggauuguguuuugaaaaggaguucuugauuauuuauggaaaugagcaaauggagacuuaguaaugccucuaccaguaucaucuucgugguuuguuuaaguacauacaggaacuuucuucuugucaguugugaacuucacagggcaggcauugcuucuuguuuauuuuugcacucuacuuugauaccuuaugccuugccuuaugcuuuggggcagaagauguuagagaaaaggugcauggacauuuggauuaggcagacauaaguuugaaucucaauuguucuccuugcugauuggaucagauuuuggaaugcuuuaacccaugguccugaucuagcccacugccuauuuuguaaauaacaauguuguuggcauauaggcacaaccaguagcuuaaauauuuuccuccagaggcagaguugagugauuacaacuacucuauaguugugcaaagucuaaacuaguaaauaucuagucauuuacagaaaaaguuugauaaccauuggguuggaugauuuuaggaauaucacuuaaucuuuugaaucugaguuucuuuaucuauuaagugaaauaauaaauuacuuaauaaguuugugauaaagaagggaggugaaguauaugaaauuuuuggcaugguacguggaaugcauuaggcuuucaauacaugucucuguucuucuaauuuuuauucuugauaucaaguuuaaugacucagugucuugauggauacucuagcacuuuccuaccuucuccuuaaauucuuucauugaaagauuuggaggaaaaugauacagguacaauuacuguuuuguguagugccuuacauguaucagacauuguagauucuuaagaaaacuugggcugcuuuuugagugagaguuaaccuguuaauuuuuagaguuaucaauucuguucucugacaguaaaguacuauuuaaaaaaggaaagaaagguuaaaaauugucuuaucuguuauguuuucuacugggcuuuaaucauaggcauguaaugaaacuacaaaugaaugaauggacagguuggcaucuuuauguuuuuaccagaucaacuaguuugacccucugagggccauugagucaaacaaaugauguaacuugacaugacuuugguuguuuccuacuuuuuuuuuuucaaaauugggagaauagaacagaaacugugauaucauauaaauaacuuaugaguguaccuggccaugaauauuuuuguucuucacaaagaaauaagauuucuuaaguaaaucauggcaaaaauaacuuugucaacucacuaaagcuugcagcauacuuuacuuagaaagucccaguaugugaaaauggucuuugcauuuuauuaauccuuugcuaauuuucaagauuuucacucuucccuguuuugccauguuuuguuauuuauuuaacaaacucauauuaaggguauacucucuauuggauaucauaauagaguaagagcaauuaaccugacagauauuccaauagcacucagugaguuuacaguuuagugagggcagcagauagcaugcaacaaauaguugcaagaguaauaaagcuaauaaaaggggaguaucagugaaagugucagugggaaugccugagauagaaguaccugagccaggggauuggggauucuuguuugagggaguaacauuuagguugagauuucaagaauguguuuaguuuaauuauugaugaauggcgcaggcuggcucuaaaguguucaggacagaaggaaccucagggagguccuugaggugucuaaacacagugaggcuggccaagaccaagaccugaugauucuagcccucugaggccauauuagguacugagaagcauuaaaaaccuucucucaugggguucagaguagcucuggguggcuauugcaauaguuuaggucuggugaaggauacugggacuaucagcgaaagugauggcagugaugauggagagaacaggguggauuuggaggugggauugacagaacucaguugauuggaucuaaaggaugagaggaaaaauguguccuccaauaugagcuagaauggaugguaggcaccaaugauggaaaacagucggggaguacaggcuugagaagaagauaugaguucaguuuugcauguguguuugagauaccuguggcacuguuagucagacaccucagggaauuaaggugugagccauuggccuauagagagugaucggaaucaggguaguggaucagaugcucagcaggcauguguggagagagaaguaauagggccuauuacagaaauuccagugugugaggauagugaaagagaagccuguuaaaggaaacugagggucagcuagaggugcaggaggacaaugaggagucuaagggucauggaaaccacagggagaaaaucuuucaggaaggaucaacaguguuguauggugcuaagaggucaggugaaccaaggacuuggaauugucuauuagauacugugacuuggaggggaggcuaggaagagugaauaucuucuugugaugguggagaaucuuaaaauccauuuaaaaucuugagccuacacauuguauuuuagaagacuuuuuccucuuguuagauuagugcucuagaacauguguaccuguuaaugauccuaaucaggugcuuuugagcagcuuccaugcugcugcgcuguauuugacuuuccuaacuugucccuuuaggcuucuucucacugcuacuuucauuaaucagacaucuaauucucuuagagccugagugcuucacaguccacaacucuuugcugcauucccacuuugaaacuaacaucuucauguauacaacgaaaguacuugaccucaaguuuuguuuccuuuuucauucauucauuuucuuucucaccuccucuuucucuguagaaaguguguuaaauuacuggaaaaauaccuaaaauugagaacuuauaaaaugaacuaccagaguucucauuuucaguauuuggauugugaaauuuugcuuguugugauucaucaaaaccaguuauuccaaaggccucuaggauauggcuuugugguauggauagagaaaauucuucauugaguuguuaacuccuugagcuggguuuauaauggauucaaaucaauauacacaguguaucuuuuacuacucugaauccaggaauuuucauauagauuuacagagacuuuucagacacacaaaccuguuggacauuucuaguuguuugcauuuauuacugccuaacaaaaguuauacagauacaugauucuuuccaguuguuuugguaucguuuuccucagaaaaguaaaagcuaugaaguuucacaccucauuaauaguagaucaguuagauggauuccuuguaaagcuaggaaaaauugucaaaauuuguuaaggaacaucacuuuaguggacaggguaaagagguuucguauauaaacuuuggaggaaaaaacuccaaauaacuucuaccaauuuaaaaaauguauuaaugcagaaaauugagaggacaagcuugaaacaauuuaggucaagagaaggcagugcacugcucucugguccuccuuuuccuggucuuuuucaugagaguguagugagaaauaacuaauaaaaucuauauuuguagcaauuggagucaucuuggaguagaaaauuacauucuaagcuaagacacauaagagugcugaaagguuaagcuuaugugggaaggauaaagcaaaacguuucuuggugcuguuuucucgggccggauagcugggguugaucaggacacuuuuuauaacacuauuugcccacagaaagagugaggcgcaaguguuacuuuggugaaaagaguaucguuuaaaaauagccucuugcuuauccuuguaguagaaaaaagccugcccagacuccauucauuagccacccuguauccaggagugaauucccagagcacaaggcuacaccgucgugugugcauucucugcucuagaauucuugcauauacuagguguguggacuagguucucuggacugcuagguucucugugucacagcuuuccuuugaugacagugucaauuuaaaauuauaccagguucauuucaugaugguucccucugggagaauuuuauacccugaaauuugagggguguaccucuaccauuucccccuccgcugucuuucuuuuugaacuucucagagauagaccuucauguaauuccugaugguuuuaauuuuagaaugaaaaaucaggaucucugagaauauuuagaugaaugguaaugacuuuuguuaugugggucuggucaucaugugguauuuucuuuuccccccaggaaugcugucucugcaauuugagaggaggugcucuuaagcaaacgaagaacaauaaguaaguaauacauuaauuguguugaauuucauuauuuuucuuucuccauucuagaaccuuuggaugacaguucgcuuuaccucucauuguacacgugguuucaaagcuuuugcugcucagaucugagguuggaauucugugcuucagagacuucuacuguuugcacucucaucucggcagggcaagagcaguccaaguuaugcuucucuucuuuguauuugacaccaugaaaaauaaccccucuuuuacucacagaguuuugaaaauggaguuagcccauaucauccaggugccauuagaauccugguguuuaauaugaugaaugcuauuggucuguuaaaacagggcauaccugagaaagugaaaccgugaucuucagauaaaucagucauagcaaugauaauaaaacaaaaccauuuacuuuuuacauuagcaaauuuaugagaauguaaguguacuaaauuagaaaagauagggagaaaacauugauguuaagauuuaaagggaucagguggagaauaugaagagagucuugaaagagagucauaagugaacauaaaaggaaggcagucuaguuuuuaugacuguucugcauggauuuuauuuuuuuuucaugaccagguuuuaauauugaaaauggggccaaagcauauuacaggguccgcuggaauagagacaugucaaaauaaccugggcggauuuugcaggcuggcacuugagggccagauucaugucuaagauauguuuuguuggacccaggcaccauuuuauaaauugcaucuaaaauuuaaaauugagagauuuuuacauaaaaauccagauuuucaucuuuaauugaaaaugauuguauaucccuauaaggcaguaauaacaaguugggauagaacccagugucaguggggcagguacuccucaguucaccaugacuuccuaguauauguguauuugcuuacauuccgccuggcccccugggcacuggaguuaggacuccugguguaauguaaugguggauuuagcauaauucuuuacaugugcacauguuucugauugcugggaaggaggagugaagguauuuaucauuauuacauuaauaaaauuuguuguaaggaacuguaggguuugcuuaauuuuugaaagaagauguucuuccacaguccugguugauaugauucgcacuauacugaaagucuucacuaguucuuggauauugcacuggaugccauacugugagaugguuuaggugguuccuguaaaaacacgggugauaagacguucucuuccuaugcuuggaccacaacaaaaagaaauaguguuuucuguggaaugauaguauuuauuucgauguggaagaaugcccuggugggaucgauacuuguucucucuuccuguggucuugaaagacaggauagagucugauacuguuugagugaaguaaauaugcuuuggcuuaaaaauagguugauggauuugacaauucuuucaagaucucuucaaaccucaugauucuuuauauuuauuuugggauauaacauuuaugagacauuuaauaguauuaacgggaaaguugucauuuuucagaaagugaaaaaaguaggaaacuaggguaugagauaaacuucauuucuuuuugucucuggguuucauugauuauaguaagauugcagcaagaaacaauuuaauuaaagauuagcauuaauucuuuuggaaaacuuuugcuacuuaaacaaguuugcuucaugacauuuguauuauuuuaaaagguugugugcuauacccaguucauaccuuuuauuaauugaacuaaucuuuugccacauauugauuagcuuaaguacuuuaagcacauacaugcauauuccagcaucaaaugaaauaagaaacccacauuucaguauuuugcagaucaaguguagaaaaauaugugcacguuaauaggauagagucgugggccuuuaucagcucuucauggcacaauguuguugggcagcugugguacugagucuguccagguaucauucaggagguuuacaguucagaaucuguuugugauggauuuaggcuuuuggcuuucuugcucaucuguguauuucccaucugugagaacuggcaucaccaaguugaaguauguaaguuuagggaacuuuuguuuauguuuaaugucuccuuuccuguaggugggcccaugucaugugcgccguugcggucccagaaguucgauucacuaaugucccagaaaggacacaaauagauguaggcagaauaccuuuacagagguuaaaauuggugaguggcaaagcuucuuuuuuaccucauaaauuaguguuaauuucaaguucugaauuuuuccauuaaugcacacauucccaagguauauuuucuccuagcuuucuuuuauuuuucuacccuuauuuuccuuuagccuaaauuuauuuauucuuacaaauucuuuuccuguuauauuguaaguuugcauauaaccuuccucaauuucugucugaaaugaggaaaaagauaguaauacauuuccugaauuaaugugaacuuucaaacuauagguuaucugguaagauuugucaguacuggagcugagccaucuaacucuauuuaaauuguuuagauuuuucucucuugacucucuuugguuggucuuaaccuagcaaaauguaucuaaccuaauuucauuaucucuucaccaagaagagacacacagagaaauaaagaagcuuuuauuuuuacgaagauauuuucucacucuugaauagguacaagucacuuaauaugccaaacucucuggcuuguucagaaacuguguaaaaaucuucccauugguuucuguuaagagcauuuuucauugaaaauauaggccuuuauugucuuuaacauugaaguaacuuuguaguuuuauucaauuaugagccagcagauccuuaguuuaggcccuuauauugcauaccuaauuagaacuuuccccaaaguucaacugcaugaccuuaauguauuggagcacgucuuacagguggacuuaaaacucuagaauuuccugagucguuguuauuuuccacugaaggucuuuccacuguacagcauuucaggcaucaucacuaugacucuuuuuucuugacuguugcuuguuuucccacugcucuuuuccccaauggcgagcugggugugccgucucuggggcucucuuauaggaacucacagucuagccuacuguauuuuguuuucggagaagugaaagugaacacuguuauuugccaucauaccuccaucaagaauuucacuucacuaggaaauauaugggccuuucauggaacugaugauuacuguggcugaugugaguguugggcuuaggaugcucagcaugugguaguuggaaguuuuguaaucuaagauggaaaugagugggccauuuaaauggcccucuaaaggucacagugacugucagaagaaguaagaagagaguauaauucuucagcuccuggacuuccauaggaaagcuugaaaucuuauacccagauuaccaaaaaaaaaaaaagacaccaaaaaacaaacaaaacguuuguaagaauuaggacuauaagauaugauauccaaaaaaaaguugaacuaccacauguuaaauaauuuaauguuuggugugacaaauauuaacaaauguuaacauuuuaauauuuuuuucugauuauaaaaguaauagauauuugucaaaauucuacaccaccuuuuaaaaucaccuuuguuucuguguuauuaccagugcagugccccucagaaggaguagucacugcucuugaggcugccuccacaggccuaugucuuggcuucucuaguccauaagugcuuccuuaaagauuuaacguuacccacaucagucccaaaggguuuuugagagaacagcagggaagggcagcaggauuauuucauccacauucaggguguuauaucuagaaauaucauaauugcaaguaaagauggugaagcuugucgcuuuccucacagugcugugcuucaucuugauagugcauaucacauuucucauggaacauuuccuuccuuaagcagucgguaccuuuaaaagagcaugucuuaacugaaugucauuaucaccaaaagucuauucaaaugauaacauagagcuaugguuacagauguaaacugagaucugugaaauauuuuuggaugaaaauagcagccucuugaccagauuauuuuucauauaauguuauauuuauggaaaguuucuuagaaugauccucaucaaaaugcuuguaguaguuaucuuuaguggaauaauaauacgaggagcaacuucauuuggggggaagaaugucuaaguuuguaauaguuugacaggggcaaugacugaaagucuggauucuuuuucaccaagaguccucaggaaggaaucaucacccuugugaguccacugcaguccagugucugugccccagucuucauugauguuccauggugaucagacucagagaggauggcuuugaauaauacaauuuacuuauguggggaaugaaacgcaccuuuccagggaauaggaugcucugccuguaugucguguuaaggguacacuuuccugacauaggcauucuucugaaguuuaaaugguaaccuaacaaguucauggccggcaggaaagcagaguaguuuugugugguauuucauccaggcaaaaguaaguccagguaagcuauuuuauucugccuauuucauaaauauauaugugucugccagugucaguuucaauauuuuuuucuggagcugugggcauuccuuuucugaacucuagacuguccauucugccuuccucuucauacaacuggaaaauaauaagaauuauuuagaugucauaaucaauuuauuucaccaaacaauuaucacuugucuugccauguaguauacauuuuugaaucagacacaguuuuuguucugucaaccuuggcauuacugacauuuuagagcagauaauucuucguuguggaggacugucaugugcaucauaggauuccagcagccuucaccaaacaggcauugccagcuauccccugggaggcaaaaucacccucauuuaagaauccacgggucuacagcgaagauauagacagaaagagaacauuuucaauauuugucauuuuuagagaauaucuugguuggaagaacugaauucaagacugacagaacagaaauuguuaaauguuuuuaaaaacaaaccuggauuuuuuucuuuuuucaaauccaaauuucuuuuuuguuagcaaagcaauaaagucugguaacaugugcauaucagcuacuauauacuuauuaauuauauaaucucauuuaacaauuuaacauuaccuguucuuauggaaauugaacaaccaaauugaauacuaaucaaguuucaccuaagauuaaaauucugugauguauguguauaugcacauaguagucacugaguaaauauuuaugaaaugaauaaaaggcagcaaaucauuauucauuauuugcacgucaggcuuauaaugacuguggcuggaggagugcgaucagacaauaacaaauggccuuugccuuuccacgguuucuccuuuaaauguaacagaucuaauucacacacaugucugcauauugcucuaaagcaaggcauuacuuuacuuaucugcaucacaggagacauaugauuaaauuguagagcccagcaguacuccagagagccuaugaaacaugcaugcaguacucaucuuguugguugaaaauucugaucuuggaacuucuggucagcuggggauugaaaaugaguggacaagugguucaucccugaagcagcagcaagggcugcaucucuucaguacccacgagguggugcugcugcaccaguuucuuauguugcucuuaaacuaccaccucccuucucuagugccuaaccagagcucuggccacaccugcagagagagagagagagagagagagagagagagagagagcgagcgagugcccaagggaugacaauagagcaucgaaaguacugcucgugaugcauucaaaguguugaauuccaaaggacaguuuuuuaguuuaguuuuucauuuaacuguagaaaaagagcugcugucccuuggggcaaguuagaguuuuucugaauaaguaauaaacaacacuaguauaaagcuaguaacugcaagaggcuaauagaaugacuggugggcaagcauaaguuuaaaaugucuuccauuauaugaaggcuguuuauuuuuaaaaugcucauuauuagcagucuuucuagaauaugaaauacuggaauuuaugcagagguauuugaauauuuugguaacacuauuguuagucguuuauuuauucagagcuucaaccuacagcuuuugaaaagcuccucugguaaauuauucgugcaaggagaauuuuguggcggauacaggaaaggauuuguuuacuugagcagauuuuuuccucuuauguauaauggccaguuuuuaaaaaaugacaacuaauggaaaacaagccuuuuggugcucuucuguggauuuauugauccuaaaauggugugugcuucauggagauccuuuagcucauccagccaccuugcuugguaaugucacagguguggccuuuguucaucauacaauuaaauggacaacaaugaugacauuagacuuauuuucaagacauuauauuuucuuuuauuucuguguccaauuuuaaauacuuuaauaauuaacuuuuaaaaaccuaaaacauuuuaaugaaaaauaaguuuggcuguaguggucuccauccaguuaaauuuguucuuucuuucguuuucuuuaacaauauuucacuuuuguguaauuauuaaaguaauugcugccccagcuaaaaaaaugcuacagguugcuauccaaaacuaccggguuauuaaguagagucauccuguuacagggcagaaaugaaaaugcuaacaaaucuuaagaaaugaaaaguuagcugaaugggcuaaagacuucauauccaaaagggagaaccaguuucccugucagcuucagcauucuucugauauuuaaugcagguuuuauauuauguaguauuuuuauuaccuguccauuagaauaaauugcuuugcuucugaaugacuuuacuguaugggaaaaguuauccuuguggcaaguccuauuacugcaaaccccuucccugugcccugcagcaccuucucuguucaccaaaagaauaugugaggauuggcacuuuguaggauaauaggaggcuacugaggacguuuccuucuccccguagcccaucuaggggguugugugaagucacaggugauuggugugccugaggacugaaagaaaaagaauugaccccaagugguauagauuuagaauuuauucagaauuuuuuccuuuucuucuuucuuucuuauuuucucuacuaguaugauugauuggccguagucauaagugaaucucuggaagaagaacaaaauugugcacagacaaaaacaagggaacauagagauauauaaaacacacauuaagacagaauggccuauuuuguuuuuacaauauaaaaaugaucaggaagaaggauuaaggaugggacuuuagagauaacaaaugauguuuuuaugguaucacacagaaggaagaaggcgguaggguuuggagacagaucacuguaaaaaucuuagauuugauuauaaaauuuaagagaaggacauuuuaaaaaucuagcaaaaggaguuaaaaagaaguauggauuucugguaguugcuguauguuuaccaugaauguuuauuguauacauugaucacuuccugcagcuuaaauuaauuaaagaucugugguauuuuuguaaauaagccagcagagcagguuuguggguuuuaagaaaucuuaggaaguuguagcagauccuaaaugcaacuauuaguuuuaaauacucuauuuggagauaaaguuuucaaauaggacuguuguaugaauauuuaaauauuaaaucacaucuuucaaugcagcggaugucuguucugauugcugucauugcauaacaaacuuagcauugagaccauccuggccaacauggugaaaccccaucucuacuaaaaauacaaaaauuagccggguguggguggugcaugcuuguaguaccagcugcucgggagccuaucgcaggagaauugcuugaaccugggaggcggaaguugcagugaaccgagauggcgccacugcacuccauccuggcgacagagcaaggcuacgucucaaaaaacaaacaaacacaaaaaauuuggcauuguucaugggucacaaaugcauccguccucacagugguguagcacagugccuuugguuucuaugucuuuagaccuuucuaggacuuuuacauuugaaauccuauuucugcaaccaaauagagggagaaaugaauuuuggaauagcaggauuugccccugggcauucgaugaccucugauuuguguuugacaagugaacaaagcccaggcacaaguguucucugagugaagaacauuauuuugaaaaggaauuuacacuacaaugaugacugagcuacaagccuuuccgugucuggcugagaccauacuauucugcuuagaagccucuguacacuuuaaaauuuguaccugaaggcaaauaauagugaaccugcaagccaaagauuauaguuuugaaagguauaucaauucugaaaauagagugguuucacugugguauuccaucucaagaguugaaucaagggggagaaaauacaaucacacuuccuauuucuuagacgaaggcgcauguucucuugccaacugacucauguuaucagauauacugaauacuaaaaauagaauuauugagagguagagauagggucugccucuugugcuguaagaucacucagaguucuauuuaguuaauguuacagcaauguucgugagcaacuuggcuuucuuucugaaagaaucaagguuguauuugacagggccucuguuaaugcauuuuaggaaauguaaagacauauugauuaucuuucaucaugcuaaaagaaaagaaguagugucguaaaggcaaucagaaaaagucaguauguuccacauuaacucauguaccgauuuauucauaggcucagguauuuuuaaagacagagaaguucuaagaaaauaauaaacauugacaaugaugagaaaacuuauugcuuaaacaguaaucaguaguguuaaugugcacaaaaagugcuuugaauagugaacuauucuaaaggaggaguaagagguacuauacuacagaugacacgguugugguaugguauguggugucuuauuauuuaacacggccaguauaaaauuauauaacaucauuaagauaauguucuucaggauuucaacauacauaugucuccagcuuuguaagguuuuuaaauaaguguagugcaaaaaaaaaaaaguacauuaguagcuguauaguacuuaacugucagaaugauuugcuacagggacuagauccuauugcaagcugucaaauuuguauauugcuguaauaccaaaccauaaaaucuuuugaguaaaauggaaaaugucagaugggcauggcuacaaauaauauacuuucugaaggcuguagaugucuauaggagaaaauguguaaaugcaugaaauguuaucuuguuacuauggauuuuucuuuaucuguugagagaaaaacugugagacaaaaggaaauugacuggagccuuuaaauuuucaguuuugaagucauuuuuuccugagggcuaauuuuaaaaacauuauuagacaggugggacuucagauaauucaugauuaaagaguauugugaaaaaguaaucuuauuuucuagcuugcauugacgaaugcuccauuuuuuucugaucuugucugugugaguagugauuacugacagaucuuuuaauugagugagugagccagguuggaguuucagagacagggucauuccuuucacucuaguacugccugggucaauaccaacaaacacaugccaaaccgaggcagcuguuagacagcucuaaacaaucuguaggguuuugcuuggucaacagugauugaaagcaagagagguuauaguuuuggaaagguacggucauuauuguguaacaaugaauucauuauucuuuguuuuucugagaagaagggggucaggaauuaguuacuuuucuuuguuucauauuuuaauauaaauuagguuauucauuuccucagaaggguggguuuuaaaaauccacaaagaaagcuuuuuguguaaagugagaacauuuucauacuuggaguuagaauuucacugugguauauuuuagguguggucccacaauuaagugaagucuuuaucuaacaugagcuccugguuagacacagauacuaggacuguuuuagccagccaugggcuggauuuauugaucucaauaucaaaguuucucugcauucaucuauaucaugcuuuagaucacauaauuauaagaagccucccuuagguugagauggagaguacaggcucuggguuaagacugccugagcccuguauccuccacuugggcaaccuuggcuaugcagauuaacccucugaagcucaucuguaaauuauggugauugugaggaugaaaugaaaaaguuaacagucugacacagaguuugcacucaaagaacguuagcaauauuagcuguuauucucuuaagugauuuuucccccuuuauuuuuauaacacuguuaagaacauaacuguauuuuaaacagccucugggcaauuuguaagcaacaggaauuuucuuugaauggaggccuguuaaacuggcguguucugucaucuccgagggagcagggcauagaagggcucuucugcaaacgucugagauuccaccaacuuccccugcaguuauugcugaaaaccguaagaugaauagguugauguucucuaaaacagaaguucagagauacagcucuugcuucauuuugagcacggacaucgcauguugaaaagcgaucuuguucaggacgguuuugcuaaaaaugccauuuccuugcaugguacagcugggagucuucagcaguuuggggccuagagaaugacuaugacccaugaguacuguuauuuaccaggauacccucucaucuauuucuggcuuuuucuccaccuucuuguagaggaaaugaauucgacaaucucucagaaggcauugggauucuuucaaagcacaggggccagcagucagaagaguucagucucugcuauggugucuuuuggcugagccauuuugccuuugggggauaaaucacuguuuggaacagagcugugguucucaaaaugugaucagcauacuguuuccaacccuuuucagacauccuaaggcauugaauuuuagacuaacgaugcaagugcaacggcugguaaagcuacugauguggcaguaaauaagaagcagcucuccuaggaaaggggaaaaaagccccucauuuguuguguuugcacauuucauugguugaaauauucucaccguguccaguuucaaacuaccaauauaaugugaaccaacucucaaaauucuugaagaucuagcagucgcucucaggagcuuguacaagcuugcugcagcucacuguugaaaauggcuggcacuuaccauacaucaaaccaaggcaucaaauugcacuaguaaccauuguauucuccaaugccaggcaucuggcauuaaaaaaaaagccaguuucacuuaagaagguccuugaaauuuaaaaugguuaauuauauuaagucuggauucuugaacaugugccuuguuuacauuccgugugauacgauaggaaauacuuagaaagcacuuccacugccugcuauaauacaucauggccuugagguaaaacauuuuagugauaguuugaguugcaugcuguacuaccaguuuuuucaugcaaccuuuuuuuuuuucuauaaugaaugccaagcaaucauuacuuugauuuguguauuuggcagacauuuucuaaaaagugaaugacaagauuuguugccugugaaagaauuugagcuuucuacaugaaaacuggaauuuuagaaaacuuguauccaucagugugauaauuucccaguacuuacaggcuuuuuaaaugagauuaguggugauauuaauuaauguagacuuugauauuuuguaauaaaaugugccaacauuuggaagauugguguaacucagugacaguauuuuguauuuuuuguuuguuuuuggagcagggucuugcucugucacccaggugggagugcaguggcgccaucauggcucauugcagccuguaucuccugggcuuaagcgauccucccaccucauuuuuaaauuuuuuugguaaagaugaggucugauuguguugcccaggguggucucgggcuucuggguucaagcaguccucccgccucgaccucccgaguagcugggauuacaggacuaagccaccgcgccuagcccucgagaguauuuucgaaaugaugaaugcaugauguuaccaaauuaugccugggcaaacuaucuguuacaaaugccugauagacuaguggauuuuaagcuacugcaguacaugguaugaaaaguucauuaccuuuaggaacuaccauugaaguuuuggugaaguaucaugaagaauguccaugauuaucuggaaagguuauuaaaauacaucuccuuuuccaaguauuuaugugugucaaaccacauagucuucauauacuucaaccaaacaacauauuacaacagaccaaaugcuaaagcagauaugagacucuaacucucuuuuauuaaacugggcagagauuggcaaaaauuuaaaacaacgccacucuucaagcuguuuucuuuuuguuuuagaaaauaugguuauuuucauaaaaauauuuuacuauguaauggguuuguuauuuuuaaaugaauucauaaauauauauuuuuaaaaauuuccauuuuuaauuucuaauguaaaaaauauuguuagauaaaacccacauaaauagaaguuuuuugugauccuuaauaacguuuaagaguauaaaagaguccggauaccaaaaaguuugaaaaccacuggaauagagagaggauccccucauaauauaguauccuuucuucuucaauccaguguucucacauuccuugcaaugauuuuguuuguuuauuauuuaugauauccuguaacuuaucagguggaagggaauaguucuguccuccaccauuuuaggcacauggccuuugcuuucucuuguuccuuauuuuaugucauugucauguuuuuuuuuuuuucuucuucuuacuggcaagaacguggagaacagaggagagggacagcuauugcauacugucuguguaccuuguuacauauuugaguuuauugauuucuaacugcuuccuaugaauuuaauuugaaacuguuaacuguucuucucccucucccuugacccaguagcuccuaggauaguaguguuaauacuaauucuaaaucagggaugacuuuuuagcaguauuguuguuauuauuauuauuauuauuauuauuauuauuauuauuauuauuuugagauggagucuuggucugucaccaggcuggagugcaguggugcgaucucgguucacugcaaccuccgcgucccggguucaagugauucuccugccucagccuccugaguagcugggacuacaggugcaugccaccaugcccagcuaauuuuuguguuuuuaguagagacaggguuucaccauguuggccaggauggucucaaacuccugaccucgugauccgccugccucggccucccaaagugcugggaucauaggugugagccacugugccuggccaggauuuuauuucuuaaaggaguagacuuuugauguagcaguugcgugggcaugcauauuuguuuuagauuguuuagagaugguuuacauugucaaguccuucugcagguuauaaugugaaagacagcuguuccucuuccccuacuguccuuacuucccuuuccucaaaggaaaccaaauucaaccaucuuugucugucuguaucucucaaucuguccgcccauccaucucuuuauugucauuugccucuaaagagcuaaauaauaugccuguauuuacuuuguuuuuuagucucaagcaugaccuaugacaccuuauuuuggagaggggaagauuuagcucaauuugcuucggucaguugcacuauacagauguguccuucuucucccuccaguaguguuccauguauuuuacauacagugguuggauagguaauugaggguuuauguuauuauugcuuuguaaacacaauuuauucauaguugagccaugcuuacaucuccucaagauauucagauacaccaggaugcauaucaauuucauguccuuugagaaaccugucccggaaucuucugucccguuacaguuuuugacugccugucaucuaccugauuugguguuuaccuuccaugaggcuguccuuggaugucugauaauccuugguugcuugcccauuuuuaauaacgggagcugagcagaagccuggugcugguggguugggucggauaguuaacuugaaauauuaugaucuggcugggcauuuuauugggaagagauacuggucagguucucuagagaagacucguccagucuccagacugaaggguaaaagccuggcugugggcuccucagagcccaaugaggcaggagggcagguggucucagugcuccuuagggaaaaggucaguaaguccacuuuuuucccaauaucgacucuacccucagcaauggcuaguguuccagagacccucuuuuacuggcucugagaguaaaccuucagguuuuuuucuuauuuuguggcaguggaguugccuaauuucauagacugaagaaggagucugggaaacuaaccucuuguucagcggcuuucagccaguucuccguacauuaccccucacccuaauuucagcacuuccagagacaccugguaucaccaguaucuuuggcaaguccuggaguaugaauggucugguucuggcuuuucuugagacagagucugucucuguugcccaggcuggagugcaguguugcgaucuuggcucacugcaagcuccgccucccagguucacgccauucuccuaccucagcgucccaaguagcugggacuacaggugccugccaccacacacuggccaauuuuuuguauuuuuaguagagacggggugucaccguguuagccaggauggucucgaccuccugaccuugugaucugccugccuuggccucccaaagugcugggauuacaggugugaaccacugugcccggccacuuuuggcuuuuuuauuuugccuucuuaggaugcagcuuucucaguuuugcugaaguugucacuugucuuacuuucuagcuuccaaaauuuucuuuacuuuguguuuucuuuccuuucuuuuuacuuguuuauuuuugagacagggccuugcucuguugcccaggcuggagugcaguggugcagucauggcucacugcagccuuuacuuccugggcuuaagugaucuucccacuucagccuucugaguagcugggaauacagguuugcacuacuauuuccagcuaauuuuuuuuuugucaggguggggucuuuccuucuugucuaagcuggucucaaacuccugggcugaagugauccuccuaccuuagccucccaaagugcugggauuauaggcaugcgccaccgugcccagcccccuuuuuuuuuuccccaccauuugaacuuacagaauuauucccuuuacuguuuuaagggaaucuguggaaggggugaaauuagauuuguguguuuaguuuugccuuuuaacccagaaauuccaugaagugaccauugauguuuuugauacggggacacaaugcuauugacuucuuuuuuuccacuuugaggaggaauugacuucugaaacuauuagaaauauaaacuaauuuuucccuuauuuuaggaguaauuacagaauauauaugaaaauuauggaaaacuagaccuaagaagcacaaacuuuaugaaacucuuaauuaaauuuuuguauaaauacacuuuaauuucuuaaaacuagagaaaauguuucuguuuauggauauaaauaauuauggaaaugaaauagcauuagcaaaaaauagaauuugccacauaucuuuaguaaaauaauguaucauaaccaugagauuuugguaccguauguaagagauaguuuuggggaccaaaguagacaaaaaaauucuaauugcuuucaguucuggauuuaguaaauuaaauauuuuaaauuaaauuaacugaaaauauugcuugcgagugaacauuuuugcugucucaacauuuugaugucuaacaauuuauggaagauaccagcuugacugugacugucacuuccccauaagaacaaagagguaaauucauugccgauggcuaaugaccaacaguucuuugcagcauaaauuccuauaagcucuuguuuggucugucaggaucagagcagauuaauguuuuuaaggagggagcagaauuccugguggucucucacuuguuuauucauuuauucaauaaauauuuauugaggacuuaauauguaguuaggugauaaaguuacuugcuuucuggucuuaacgauauuacaggguaauggaaguuauugaaauuuaaacagacaauugcacagcagugugaaaaguuuuauuauuguaaaaaugcaaaauguagugaaggaccuuacuagauuugggcaugagacuuagcagugugggacaguagaaaaacuuucuggaagaaacagugccuaauaaugccuaaucugagcccuggagagcuagcugggagggaggguucagaagaaugaacagcaugcucuguggccuggcaguggagagaacuguaaggucuaggaacugaaauuucaguagagcuggagcgugaagcaugaagagggagcucugagucucaagaaguucuagguucuaggaagccucccgucuuuuggagcugugcugucuguguggugacugcuggcugcuuacagcuacccugcgcuuggaaugugucaguguuacugaagaacugaauuucaaauuguauuuaacuuuaaauuugcuauguguaaaaucugaagcagcuacauuuaaaaacugaagcacuuuagauacaacuauaguuuugguaggccuaccuuucacauguaaccacccuuaaacauuuaguauccgaacugagauacguuauaaguguaaauacacagcagauuucaaagacuuaguaugaaaaaggauguaaaauaucucacugauuauuuuuauauugucaauaugauauuuuagauuuauaagauuaaaguaaaauguauuacuaaaaucaauuuugcccuuuucuuuaaaguuuuaaaaugagccuccuagaaaaauuuuaaaagaugcauaauguggaguaugguggcucaccauguuggcagcaaggucaguuucaauagucaggugaaagaugauuuuagcaugaaccuagguuggagagaaaugaauugauacgaggcaggguuggucaggcuuggugaauacucagucacguuauggagcacgacagaauaaagccaagguccuggcauaaacagcugggugauugguccugcaacgugcaaggcuccucaauacugggagaggcauaggguuuagugggaggaaguauauauuggacuuucuuaauuugagguccuuguagaccaucuggguguggcucagaagagcgauaugcuaggggguuagaaucuuacugcuccuagguauguaguuguuuaacagagugcucuuagguuaauagugacugaagguaugugauguucaguuauuauuaucaggggacagugaacaacugucuucuucuagguguccauuuggccagugaugauaauguaucuaucaccccauuccccuuuugaaguauaauaaucaagugagacgacguaaguucuugaagucucuuguauauucucucuuagaauaaagagacuuaaauaaauugaaaacaaacacaagaccagaaggaaguccaguguucuagugaaagauaaauguguccuacagucaaucaaaacauaaucuaacaccgggauuuuguugccaagauguguggccaccuaucaaagggaauuugcauuaagaacuacacagaauuuugucaaacccaugaaaaugaguuuauuucggaaucccuuuuaguuuuaaauugaagucuucuuuucacuaauaguuuucugaaaugaaacuuccuuaaaacaaaauuuuaaacuauggacuuuuuuuuucuguugggaauauaaaauauauuccaucuuucuuuaauaauaaaauguuuuacuuaaauaaauggaaaaaguagucaaauaaauugacuacuuuucauuacaggaauagcgcuuaagguuaauuaaaacuuucaaauuuuuuuuccuagagccaucuguugcuuauaauugaauuuagaaagucaucaguuuuaaacauuuauuugcuuuggacaaagcaaaaaaguauggucaugaaauauuuuuacuaaauagcagacauauuuccgcaaaaagaaucaugacauucuggcaaagguauaauuuuaauagacuaaugagcuuucugaccagagcugacugagcuucaucugauuuuuacaaugaugaauugaccgugucaaaauuugcaguguaguccagugaaauauuuuacuaugaaaguuuaauucucauuuuuuauuuaugaaagcagugguagugucagagcagcuuauaauaugcuggccauuugguaugauuuauuuuaauaagugucacuuguugaugcauuuagugauuguugacccauauuuaauucuaaaaacucuaaauagugugaaauguaauaagucagugacuguaguuugaaaaagcaaaagacaaaaaauugugauccgcaggucuuuuccuagcuuucacgaugucacaguucuauauuugacaccuguugcuuugcggacaauggagggguaacagcuuuaaaaaaaaaaaaaaaacuguaauugagauccgcauaaaaauauuucugucacaaagcauauauuugaaauauaauaaaaucaucuucauuacaucaguuggggauuccagcuugucaucauuuuaaugguuuugagaaaaauuauagaauaaaggucacuuuuuucuuucauucauuuaucaguuuuuuauuuaauaaauacauacagagcugaucaugguggcuugcauucaaugacaggggcauaagauggacaggucaucccucucaugggauuuacauuccagaaggauguaugguaucccccucuccaccccgcaaaggauuuagaugaagauuuuacagaacuuucaaggaugucauuuguucuuuugguaguuuuggaaggcacaagagaagggcuagaauaaagcccuuuuucucagguauuucuuuacagagauauaauaagcauuucuguuuccuaaugucaggauauuuacauaguauagaucauuuaaacaaauauacucuuccaaauagcaauaguguauguuuuucagauaugauggaauuauuuuaagaucauuuuagaaaugacaauaaacauguuaaaucaaaauuuuaauuuuuauagugguauuuguuaacauaaaauuuuaaauuauucagagcucagaggaaaaugaaauaucugugagucaugaaacacuaugcauuguaguacugcuccaaauacuaugaugucuuggaguuguuuuuuguaaauaaugcagggauuauauuguuguuacuuguuuuaauguacacaguaaaaggcauaaacugaguagugcugcagauauuugcuuuaaaguuucucuaggaagaagccauccagagauaauuaucuuuugauauuauccucuucuuacguuucucaaagcaauucauaaauauuuuuuguauaagaauaugaacauuacagagcuguuuauuuggcaggucaacuuaaaaacaagagggaaucaguggcccagauauuuuuggaaacaacaaggaaauuuauauauuucucuaagaauccuauuuuucauaauuagaaaaugaaggaaccagcaacacaaaaucacuccuuuuccuggcaguccuagcacugaauauaugugcauuuucaggcuucucaauuuagcugggcaaucaccauuuaauuucaaaacuccauuuaucuuagugauagccuuugaacuauugacucucuuuuuccuguguaugacaguaguaucacuuuugugcuuuuagccucaggcugauaugggggaccccuucuuccuauagcuguggugcauaacauaaccacaacguacguucugcauagauaaagcacaacaguuuuuguaacuucagcuugcuguacauguggcggguggcagcccaccugcauuggggaaagcaaacgagcaagcaagauguguuuguccuugauuacauucuauuucucugagaaauguuccacuuaaaugacagaccaagcucagaguuuagguuaucagccugagacauacaaggugcagggcaacuccaaaggagguaaggcucaguugcacuguuaacugugacuugcuuauuugagguuagaauucaaauauauagaucauguuaagacucuuggucuuuauuuuuauauuuuauuuucaaaggccuguuguuuuaguuacaaaaguaacaugcuuaucuucaaaauauuuuuaaaaaccgaaguguauaaaauccaaaaugaaagucgucuuuagcuccaugccacuucacagaaguaaucauuguuaacauauuggaguaaugauuuuugacuuuuuuuuuugagaugaagucuugcccuguugcccaggauggagugcaguggugcgaucuuggcucacugcaagcuccgucucccggguucaugccauucugcugccucagccucccgaguagcugggacuacaggcggccaccaccacgcauggcuaauuuuuuuguauuuuuaguagagacgggguuucaccauuuuagucaggauggucucgaucuccugaccucgugauccacccgccucggccucccaaagugcugggauuacaggcgugagccaccgcacccagcugauuuuugacuuuuuucuauggagaaaauaacuugggaggaugcagcauuuuaccaugcuguguuagauuuaggagucuuuaaauagcauacuauauuggucugauaugcugacacauauaugugaaucuguuuuauaaaaauaaucaacuuuuucuuaaggguaguuguauuuuuccuccuuuggucuuacuauaaacccacuagcaucaugacauuuuacauacauuugcuuauuuuccgcacuuagaaguuuuccaggcugcauuucaaagcuuuuauguauacaauuugaucaccucaauuuuacuaaagguagugccaacgguuucucagguguaugauuugcugcaaaguaugaaaauaugaauguaauaauaaugguuguaagcuuuggagucagacaaccuggguucaccugucaacucugccacaugcuaauuauuucagaacgugccagcugccuugaaacuuugucccugauuuuccugacaguuccauguuguguucuuuuucuuuggcuaccugguuuugguuucuuugcuggcuccuuuucuucugucuauuucauacauguuuaugaugcccuuucuuuuuuuuuuuuuuuuuuuuuuuuuuugaaacagaauuuugcucuugucgcccaggcuggagugcaauggugcaaucuuggcucacugcauccuccuucucccagguucaagcaagucuccugccucagccuucugaguagcugggauuacaggugugcaccaccacgcccagcuaguuuuuguauuuuuaguagagacggaguuucaucguguuggccagacuggucucgaacuccugaccucaggugauccaccugccucagccucccaaagugcugggauuacaggcgugagccaccgcgccuggccuaugaugcccuacuuucuauccgaaccuuucuucucacucuacauucucaguggagcauucguagaaucaaaaucaccauaauaguagcuuuuaacauuguucugaguggcaaguaagauucagcauagaguacuccaccagggccuggcuguauaagugcucaauaaauauuccuucuuauuguuauuaugauguauuacacuacuaauaccauuacaacagugaaaugauguuaaaauaaugaugaauauguagucuacauuuuaaaauaaaugauauuaggguuguuuuaaaguuaacuuuuaucacguggaacacauuuucucauacauagaauauuacgcauauuuaauugccaggaaaguuuauacauguuuauuuaacuuuuuaaacaaacuuuaaauuuuaggccaggugugugggaggauugcuugagccuaggagcucuagguuacagugagccaugauugcaccacugcacuccacccuaggcuacagagcaagacccuguuucuaaaagcaaaacaaaacaaaacaaaaaacuuuaaauuuuaaaauaauuacagauucgugggaaguugugacaguucuaaaguuuugucucucaauuuccucuauugguuacuucuuauguaauuauaguauaauauuaaaaccaggaaaguaacauugauacaacagguguauauaguuuuauguaauuuuaucacauggaaauguggcugucauuuuuuucacaaggaaaugugacucccuaaauggguaaagggaagguaaagucaaaauaguaguaauguauugugguuuauaggacaugugaaaauaaagugugugacaauuacaaugugagacaugagguggacuaauugagaauauauuaagguucucacaccagauuugaagugcuacaauauuauuugaagauagauuguaauuggguauuauaaaguguagugugacuaagaauauuuuuaaaagagagguacagauuuaagucauuaguggagauaaaugaaauaaaaauaaauuuagcuaaaucaaaagcaggcagaacagggggaaaagggaacaacaaacagacugacaaaaucaaacaaguaguuguuacaguuuggaaaccuaggugacauggacaaauuucuuauaagaaacaaaacaucaaaacucacccaacaagaaauagcuaaauaagaaauaguguuuuauuuauuaauggaguugaauuuguaaacaaaaaucuuucuagaauaaaacugcaggcccagaugcugucauugguguauuguaaauuucaguauuaugauguaaaauguuaaaggaagaaauuauagcaguucuaccuaaacacuuuuaaaaaauuagaagugaagggaacaccucccaauucauugcauagggccagcauaacccugauacucaacucuugcaaaggaaaacuguagacccauauucaucaugaauauacauuucaaaaaaucccaucauaauaauuaacaaacugaaucagcaguauauaaaaaacuuaauuggguuuauccugagaacauaaggcuuauuuaacuuuuuaaaaucaaucaauguaauuagcuauaguaacagacuaaagaaaagccauaugauuaauauacuggagaaaaaaacauuuaacuggauuuaacauugauucccaauaaaaacucacagcagacuauccacagaaagaacuuccucauucuaauaaagcauacuuacaaaaaaaccuacugcgaacauuagacauaauggugauacacugaauucuuuccugugacugugaacaagguaaugaauucaguucccaucacuccuauucaaccucauacugagugcagauccuagcuggugcuguaaggcaagaaaaaugaauucaaaucauacugauuggaggaggacaugauuauuuccauaaagucccaaagguuuacaaaaaaagcuaauaaaaccuaugaaugagugugucaaguuuucagggguacaagguuaaaaaauuucauuguauuuauguaugcuagcaaugaaaaauuugaaaguuaauaaaaauccauuuccauuaaugccaaaauaaugaaaugcguagauauaacaugaaagcauauaugcaaaaucuguauguugaaaacuauaaaacgcuaauaaaggaaaucaaagaauagcuaaauaaguagaaaguuacaccugauuggaagacacauuguuguuaaaauauuaauucuccaccaaauugaucauagauucaguguaauucuaaugaaauuuccagcaggauuuacuauagaaaaugauaaucgaauucuaaaauuuauguggaaagggaaagccaaaauaauuuggaaaagaacaacaaaauuggaugaaucucacuaccugauuucaaugcuuauuauaaagcuacaauuagcaaguuaauguggugaagggauagacauauguaacaauagaaaagaauagaaauuucaggacuagacacauacaccuauggucauguguuuuucaguaaaaguuccaaggcaauuaguuuguuauuuaagugauguuggaaaaauuuggaaaauaaauacauaaaauugaaucuugauccauacucauuuuauguacaaaaaugaacugaaauuggaucauaaacaaacaucaaaccagaaacuauaaaacuuauagaagaaaaucuuugugaucauggguuuuacgucacaaaagcccuaugagauuucuuagauaaauagaucaaaauuuugacccauuaaaacaauugaaaaauugagccccauaaaaauaauacacuucugcucuuugaaaaacacuuuuugagucuacggccauaccacccugaacacaccugaucucaucugaaagacacuguuugagaagccacagacugggacagaauauuugcacaacacacacuugauaaggaacuugucuccaggauauauaaagaacucuugacacucaacaauaaaagaaccuuauaaaaaacugcaaaauuuuaucuuacacuucacuagaggacauacauagacagcacauaaguacaugacaaaaugcuuaaugucauuaucuguuagguaaagcaaguagaaccacaaugauaugucacuacauaucaauggaauagucaguguuaagauaacugacagugucaaguagugaugcugacguuuagcaacuggaaugcuuauaaauugcuugugguaaugcaaaaugguauagccaucuuggaaaacagccuggcaguuucuuauaaaauuaaacuuacaauuuagcauaccauccagcaaucccacuucuaggaauuuacuuaagagaaaugaaaauuuauguuuacauauaucauaaucacccaaaaaauggaagcaacucaguguuuuucaacuggggaaugaauucucaaaacaugguaccuucauacaauauaaugcuacucagcacuaaaaaggaacaaacuagagauuucaucaaccauggaugaaucucagauucauuacccuaagugaaagaugccugacucaaaaggcuccguacuguugaauucaauuuaugucacauucuguaaaagcaaaacacacaaggacagaaaauggauuagugcugggccuuaugcauggguggagucacugacuacaaaggggcacaaagaauuuuugugcugauggcacugugguguaucuugauugugguggagguacacaacuguauuguuuuguggaaacuuacagaaguauacacacuaaaggaugaacuuuauguuauuuacguugcacuuugaaaauuaaauauaaaacccuauauguuuuuaaagauuucauuuacauuugauguacaaucauuguacauacuuaugggguacaaugugaucuuuugauacauguauacauuguguaaucaucaaaaccacauuuuuaauguuaguagauugacuguggaaaugacugauacuaaugauagcucagugauguagggagaaggacaaaguggugaagaaaaguaguaggagaaguagugagaggaaagaauguagaugaucagagaaggggaaguguuuugggagaugagagcuacaguccaugacagcaacauuccaccccaugcucaguguuuacucuccucuggacgacaugggacucucagggguggaaucuucuucuuagaaugcuuuuggcauagaucuaccuccauuuagaauguuccgaucuaacauagcuauuucuguagcuaaaauccuacugccagaaucauuaauuagauauuacaguuucuauugcuuuuucauugugauaauuuucucauugcagauuaaaugagauauaugcgauguuagcacaaugguuggcacugaguaaguuucaguaauuuacucaugaaguaauuaugacaacucuuauuuuauauguuauauagauaauaguugaagagcuguguaaauccuggacuccugacccaacucccauguucucucccacuaagcuauacucaccuuuguggugguagcuucccgauauucucagaggcugaaaacaaacauggagaugcagaaauuaauuguuuccaguauuuuccaagaaaacgauuaucucaguucaguuauacucccuguuuuuuguuuguuuuacuuuucauuucagaguacuuuaaaugugugcagugugauaaaacuauaucugcauuauuucagcccuugggagauauaggcugcaggugaaugggagaaauauucuuaaauuaaguuugaacauauccucacaugguaccauuagccuugcagggcccaucaaauuguaguucacucuugccuggugucagaucuguuggaaagcuuugacaaacaguuggucugucagagacagcuaaaagccucagagaggugcagagagacgcauacaucuaucaucuaauaaacuccacuuguggcaggugucucggaaaccuaacucauagugaugugggcacauggguuuuguuaaccagaaauaacauuuuagcauugacagcuuuuaaaaaagacaguucuagacaggaauuugcuaucuaaagaacagcaaacuaaucuucccuucaaauaaaaagauuguagugcaucuuacuuuauagagaaaaaggaugucaguauugagcuuauuuccuaacaucugaaucuuuuaagugcugagcaaauuuuuuuuuuuucuuucugaguuggaguuucgcucugucacccaggcuggagugcaguggcgcgaucucagcucacugcaaccgcugucucuuggguucaaacaauucuccugccucagcuucccagguagcuaggauuacaggcaugugccaacuugcauggcuaauuuuuuuguauauuuuaguagaaaugagguuucaccauguuggccagggugaucucgaacuccugaccucaaaugauccacccaccuuggucugccaaaguccugggauuacggguaugagccacugugcccagcauugcugagcaauuuuuauauaaucuauucuugaaucucaaucagaaugaaaacuuuuguuuagaaagucacguauaaaugauguuugaccacguuauuuuucagcuuauaaguaaguuuugaucaaguccacgugacugucuuuauauuauaaaggaaugcauauauuuuugcaauauuccaggcaucuuauuaaauucagauuuagcaauuuaccuauauacuauuugcaguuuucauuacuugcuauuaacccuaaaggacuagaucauugaauuaguuguuuugcugagccuuuuuggcugcuguauaggguaucacuaagauaaugagugagccuaccuacccauccagcauggacaugcugauacguuuuuauuucuguauaucugaaugcacauuuuacaugaaaagguauguauucuauuugaauacaucaugaauuuaggaguuuacaaaggucucaggaugucugacaagaucuccugccauacccagcgaauggaugauuuucauccuugagaaugaugaacucauuaauuuguauaugaagagcaauaaacagagucuccucuuucuugaacaaaaguagggauaugaaacaacuuucuccccaacuggaccccagcagaaagcaucccagcugugauggugggcaugauaugcagucagucagacaauucugcagucagguguuuuguucagcaucccccagaacggaucccagcgcauaauaccucuuuacauguaguaaaaugacugguaauccauucugucuaugcucgguuaaugguuuguuuuugguuuuguguuuugaaguucaacuguccuguuucaucuucuaugguuucaucacauguguuuugucucugccaaaauucauguugaaacucgaucccaguguggcaguguuggggggugcgaccuaguggagguuuuugagucucuggggugcuucccucaugaauggaugaaugcccuucuguauggguuaaguccucacugacggaauaaguuagcuccugagagaguuuguuguaaaaaagagucuggcuuccucgguuucucucucauacccucuuucaccaugugaucucuuugcacucccaccccacuucugcuuuccacagugaguugaagcagccugagguccucaccacaugcagaugcccaaucuugaaccuuccagccagcaaaaucuugagccaaauaaaccucuuuucuuuauaaacuacccaaucucagguauucuguuacagcaacacugcuuaucaggaaggacaagcuggugaagaaaagagggagacuccaucuccugggcauacucuuuaaucauucugaggauuuuuuuuuuuucuuuuuuugagacagaguuucacuccugucacccaggcuggagugcaguggugugauccauucugaggauuuuuauuugggugaaaauuuaaaucuugggugugauaauuuguuaguuuauucucaaaguaggucaacccucccuuuuccucagucauagaaaagaacagcaacacagcuuaugggauagaacgaacauuuauggcaugugagccuugcacugagugcuguaccuggugccaucacauguguuaucuuugugauccuccacacuacuguauauauuugguauuucagucucuucuuugccaggcccaguucuggccauccuacuguaauaaaccaacagcaagaacaacagaagaaaaaaaaacccaaaaucuuccucuugcgauacuuuaugcuaagcauaauuucaaaccauuuuuacuggaaacuuagaugauuuuuaaggaaacauaaaugguaaacaguuuauucaaggaauacauaugggaagugucugagcugggauuaaauuaguuugucucaugcuaaagcccaugcuauuuucacuauaauuuauuaaaaucuggcauauuggacuuuuaaaauuugcauuguguuuuucagggaaggcugggaaucuagacacagcaacaguaacaacaacaacaauaacaaugaaggcucacugugaaaacaucaauucauuaggaaaguuacauccccuccgccacuguuucagaugcuguuucucauucuccaugggagcagccagcaucguguuuaggauggggauacaauagccugagcuccugauugagucagacccuggacuuucccuuuuguaucugucauuuuccucuggauccucacaccuuuguguuuaauuuuuuuaaauuucauuuguugacuuccuaugugggguaaaaugacuuccuuugauuaauguacuuucuguauccuagaguuucccuuucccuuugugauuuaguccaacguguccuacuacagccucaaaaauugucauuggaaucaaaagcuuuccaaggugcaucagguuaaugauuuggaugcauccugagguugucuccuguagcauggaggcauuauaauaggagucucagaaguuacaccauuuuucuacagcacaucacaggcccagaggcuugaaucuaagagaauccacucuaugucugucagccugaauccuuccuucuugcugcacaacaaagcaacugaacguauuuugaguuuaggugaaaacuaucacucauucaucaaaguucuaucugggugauauaugcuaucgaaacagauguggacacugggcugacagauguugagaacggaccuguugcugaagcucauguuaucacacaugcugugggaagagaggucauuggcauucaagaugcaacaccuacaauauggugaauuaaagaugccauuugcauggaucuuggauuagugcuuguaauuugauuugcguauuuacauugcuuuggacauauaguugucauccuaugccccuccccucaacuacggcugaaaaaaaaguaaauaugaaauagaauagcaugcuauuuagcauuuaucuguaagcuauacuaauguuuuuguguugaauauucuuuuucauuuuggcagcucugcacuaggccagacauugucuaguaaucuuccaacaacucuuucauauugauaucuuuauucccauuuuauauuuuguaaaacuggggcuaagaagaguucaauaauuugagcucauacagccacuaagugacagaacugcucaaccauuuugcuggcuguacugccucuggaauaugguggagucaagagaagugggaggucuaugacucccaggaacaccuuuaagcugccucaucaauccugagucucaucaucauugccuggacuucacaauguaagucagcccaucaaggcaacacagugcaugcaccacauuuucaacuugcagaccagucagucuacagagaaagaugucuaucuaauuucuguauauuugucaaauaauggcaugucugagccauggcaggaaacacauggucacccucuuaccuuggguuucucagguguuuuggccagcagauauuuaggcucugggaucaaagaccuccagguuccacaugugaggaucuccagcacaauuaaaggaaaguugaucaacaugucuguuuaauuaauguuucuaauauuucuuuaaaaaucaaguuuugaugagaaaaaaauuaaagacaaauuauauccagaauguucccauuuauuuauuuauuuuuuaaugcauugggagaagacucaaggaauaugccauauugucguugucucuggaugacaggauauugggugcuuuuuaaaaaaauaauuuauacaugcugugguguaauuugcagcuuuucuguaggaacuuuuuuauagcuuguaaaaucaaugggaaaaaaguaaaauauuaaaucagauaaaauguuauuuaaacaccauaguuuuuuauauaacuuugccuagugaccccaguaggaaggacauggacacagcuuuuagcagagaaauuguuccuagguuuccuuuuuuuuuuugucuucaacacagagccucuggguuuucuuuucuuuuucuuucuuuaaaaugcuggacacauuuuucuuauuaauguucacaauuccauauucauguucuccuuaaugguucucuucaacauggaagguucucuucugauaucuuuaguaguaauuuucagagaauccuuguuuuacuugcuagccaagcccaaggucuguauuuuacauguuuuccauuauugucuugcauuuuaaagguccauaguuuaauuagcuugaguauaaauuaccuucauccuuuucuagaggucccauagccaaaacaauaacuuaaauacaaauaugcugaaauaucuauauuuacaauguucuuaaauaucuugaaaucaaucuauacuuaucuguuggauguaacuuacauguacacuggagguguccaugagcaaccccaugauuggaugauugacugggagaauucacaggauguaacauguaguuguacucacagcuaagauuuauugcagugaaaggauacaaagcaaaguuugcuuauacaucagugcccagguuuuuauugagggcugaucacauaggcacccucugccuagcauguaccaaaauuucagacucccagaagaaaagcagguuuacagauucagcauaaaccauauuguuaguacauuuuugguacagugagccauucuuaucaaugaaugguggcaagcuuccugaaauucaaguuccuguaugucugccaggggccaaccuuggaagcagaacuuucaaggcauaacaguuucaggccuguuguauuaacucuucuauucaacauguaauaaaaagccagaaauauucuuuagugccaaaggccaaaaugaguuuguugaaguaaagaauagccccauuauauacauuaaucucuacaagagugacuuuguuuuuuguuuguuuguuuugagauggagucucgcuguguugcccaggcuggaauguaguaguacgaucuuggcucacuacaaccccugccuccugguucaagcgauucuccugccucaaccucccaaguagcuaguacuacaggugcaugccaccacucccagcuaauauuuuauuuuuaguggagacaguguuucgccauguuggccaggcuggucuugaacuccugaccucaagugaucugcccaucuaagccucccaaagugcugggauuagaggcgugagccacggcacccagccugagagugacuuugaacaaacuacccuuuaccucacuuuucaccucuauaaauggcacuuacacucugcauagucgaauucugugauucuauguguuuuguaauacuuuauauaauagagauuccuaaacugggauccguguauuccaggguuaaaugaagacuuuccuagaaguacaaugcacugauaucucuuagagaauuaauuuucuggcccucaacuuuuaacauguacucuuucccaagcuugaucugcaugagagugaaccuuggaaggggcugcugguucuccuuucccacaacuucuuuugcuuuacagaauaaaugcaucacucccagguaaacagauaaagguacaggcuuugagggcaagucucaaaagagcaaaguagagauagauuagguaauaaauacugaaaaaaaaaaauggcacuucaucuaggccauggauuuauugcagaauuuauguaccuuauccacuaggcauucccucaaacccauggugucuucuugguccacaacuaguccacauaacccagccucccuuacugguaggagcacagccacagguauuggagcagaagugaaauauauuacucucagguuuggcuccuaaauaacccccauguauucuccuccuuacuguuuucugaaauggaguugaccugcaaagagacccuagagcccaaauguugagaucacagcacuuugucagccuaggccccuaaauggcuguggaggagagcuaccccacugaacuauuugccagcccaguacuguuaucugagcaagaagugagguucuguuguguuaaggccauuguauaguugggacugucuuuuacucacuguugauuguuucucuuagaauucagaagugaaaugcuugauaugggaauguguauuaauacaauuuauuugaauugcaaaaggaauucagacuuuuucagauaaaaaacaagucuguuuuggcagauugcuuugauaaugaggacugccuuugucuauuggguuuuauauuuggggcagacauuuuacauaaauuggaaucugcugucucaaaauuugacaaaaaauauaauuuaagcgcacauauaauuauauucuggaauucuaugcugggaaauaauguccuuuugcaucuauuucaccuuaaaguuaaaaacaguacaaccccauaaaucucaacuuuaacauucaaggcgcguuauagucuuccagaauucuucuggggaauuguaagcaaaaacguucacugaccacuaguuuauaaaagagggcuguuagcuaguaguuuaaauaagucuugguugaccugauuaauaaacaggcccuuagugauucacuuguguaaaugagcuaaaugugugggcaaaccuaaggcacacgacagagacuaaugcuacagcuugaacaacuucugcuauuguaagucuuuuuacaaauuacccucuuaaaauauuuguagauucacaucaggcaggugaaugggaaggcugaguaacugaucuuccuguaagaaaaguauguggagggggauuacuucacuuaauguugucaguaaaccugaaguuuuauuguuccaucuucuucccugaaucucuuuuaugugccacguagacacguagauaugggguggacuucaggaccugggccaaguguuugugggaaagaaauugaagaauaacuaggugccuaaagcgcuaagggaagaacuuagucugacugaaugcaauuuccuaauuuuaugauuuggcaaggcuggcgugcacagagcuuuaaauaacuuuagggaaguauuccuaccagugccccauccagcauaccaaacucaccgugugugaggaacagcagagggaagccugugcuguuguccugcaggugaaugagugaaaaucaucugaucucacagguagugcugccccauugacugaaaaugucuccaguaguguguuccuggcauuccacuuugaagauguuggcaaucauaaaugccagaaucacaccuggcauuucuuuggaaaaacauuaaacaccucacgagcccagagccuacagggauaauggggaaaucuggaaguacgauaauuacgcugcaugaggaaauguucguguugaugaauccuugggauuuccacuauuugcaaagcaugugucuaaagccuuggagaugaguucagaggggcuaaugguagaagauagaccaggugcugguacggaaaggcauguauuaccuccgaaauucaagggacaggaugaacauuauauaucucuugugcuugcuccuuuagaaauugaaucagagcaggaacccagagagcuaguugccggcuaauggacuuuuuagaaagguguuuugguggucgauaucuagauaucagguguuuuccacuuagccuggccuuugccccugugaaaagcaucaugguggcccugagaacaaaggcaucaaauaaaugcuucugaaaccaccuucucuagagauucugccgugccuccaggacaaagacucugacuuguuugugucacuacagccucacauggggccugaguuuauacucaggaaaggcuuaaauuaugaaugaauccuccuggaaugggcauuagaagguuucuuuccaccuuagcccaccagaaugguacagagagacucagaccagaaggcccauuaggaauaauguguguuccaccugaguuucguuucagaaucuuuagcaagugggauucagcgggaguuacacagagagcccaagcaggcauaauacugugaccaagguaaggcacuaggggugaaggcaccccguuaagaaugaugccacaaaccaucacuggauuuuccagagccuuucaguuuggguccucaccagggcugaugguggaagggauauggcuuuuucaguagccuuaugcagauacagagcucugauugcuucccauccgugagucucagggugccuucauggggcugcgggcaguccuuuuccugugagagucuugcuuuguucccucagcuggcauuugucugcugacuugacacuucaucucaagccuacuguguugucacgcguggcuccaaaucccacacugcuuuagagcugcuuccuugaaggcaggaagaucuacagggaauaaacaaugaagcagacaauuuugucaagcauuugcaguagcaaaacacagagcugacaaaagggacuuaugccuuuuguucaguagaauuaauaaucaaguuguaugcaaaaaaaaauugucagauuuaggagaaaugauaaaauauaguaccaaacauuaaggacuuuuucuuuguuuacuauugauauuaauagccauuguuuauaguucagccuccagcagggauggaccugcaguuucucuauuaucuauuuuuaugaagugcuugcauuuuuuaaauuauuuaucgaauaaguagaguucucuguguucauaagccuggauauacucaacaguucaggaacauuuccuccccauucugagucaguauuucaagucacacacauagacccauauacacauugagguugaguaucucuuauccaaaauucuuguuaccagaaguguuucagauuuuggauuuuguaauacuugcauuauauacuuacugguugauuguuccuaaucuguaaaucuaagaucugaaauacuccaaugggcauuucuguugaguguuuuguuggcauucaaaaauuucaaacuuuggaacauuuuggacuuugaacuuuuggauuagauauauucagugugcauugcuuaacaauggggaugcauucugagaagugcaucauuacgcaguuuugucugugugcaaacauagagugugccuaugcaaaccuugauggcauagacuacuacacaucuaggcuauaugguauagccuauugcuccuagccuucauggggcugcuacagcaugcuauuguacugaguaugguaggcaguuauaacacaaugcuaaguacuuguauaucuaaacauagaaaagauauagccaaaauuagguauuacaaucuuaugggaccaccaugggauaugccauuugucauugacugaaacgucccauguagcacaugacugaugugugugugugugugugugugugugugugugugugucaaggugauugcauuguuuaaacaguaaaauuguuggauagauuauguuccuucccuaucaucacuucuuucaaagguaagauagaagagguuguguccacuguaacucugugagaauuugauuugaauuccucaacggggauuuuucauuugggcaaagauccuaugaguaaaaacauuauauagagagaggacaaaaaagcuauggagaauuauagugugcagggcagaguuacucaaauuaucaucuuuggauccuuguaaucaaaugcugagggcagucaaggcucuggguaaccuaguguuugcugucuuagaacauuuuagugaaaauaaggaauuuaauggcguuaguuucuugcuucuaacugugcuggggagcuuaggaagaaaagaucaugagcucugggcuucuaacuuaacacagguguugacgaccugugccacuacucagcugaagcuuucggagccacuacauggugccaccaucucucuuuguuuucccauuugugagaauggcauaguucauauaggggcugcucucucagccuggguccuagcuuaagcaagaccuggagcagagccacaaccaagauucaacaugagcaagacaaacguuuuguuagccacugugguguuagagaugauuguuacuggaacaugaaugauagauagucuauuaugaagugcuuuuagaaaaugcccacauagugcccuagaauaggguccauuauguuaauaggccuucuccuuaauaacuuucaaagcauugauuauggcuuuguguaggucugcaugacuauucauaaggcugcuaucaucaaugauucccagugcuacauuguauauauuuuaaacaauccguccauuuaggagcugcaugaucuuaguguaguuuuugaacugcucuguggcucaguuucuucaucuguaacacaguaauaauacuauugcuuaccucaaugaauggaacauguaauacccucaaagcaauaucugacauguaguugauuauuuucauuaaguuuaucuacaaauauugaaugggcacuuaccauguuccaguuccugagcaguuccuuauaaagaugaacaagaacauauggguucaaguguucuugggccucauagaucuaugaagagagauacguuaaacaaaugauuaguuaugaagaaguguugugccaugagagugcccaucagggggccuggccuaauuuggagggucaagaguggauggcucugaaggaaugacauuuaagaacuaaaagaucaguagguguggccaagaugaagguaagguugggaaaacaguuacccagguaaaggaaggguguauucgaggacccugagguggaaaggcacucagcacagcagaguacugagagauggccagaguggcaaggcagaaugaaaccaggaaggggcauuggagcccuguggcagaggaggagcacacugggcuuugaaggggcauauuuggcucagggccauuguuguguggcagugaguaaacacuucuucggaccucaguuucuucaucucuaaaacaaaugauuuuuuuucaguugcagaauucccauucuaagauuuuucuugcuuuuucuuuuuccuuguuucaaagagccagugugcugugccaaaaguuguuucuaauaaaaucuaauuguuuagagagaacuaugaggaacaacaaagagggagaaaaacaggcuuuuuucaggucuguugguuaaccugacuuuuacacuguaaaauacggggucaugauggcugacccuggaacagcucuggucuaggaugacauuuaauuuugcuugaggauggcaucauauugaaaccugugagaggaaggcugguguuuagguuuaugguuccugccacuccuucccugcucauaggagcgagaggguuuuuuuauauuuuaauuuauuuuuucuguuguuauguuuaucuucucagacugcguggugggauaaucugagcauuuauagaaaacggagcuccccacugggccuaugcguuaaccccuccugaagugaauggagcaugcagucucagaggaacuuagauauuuuuucccuuuuucuuucuuuuuuauuuuucauuaaaaaaaaaauuauugggccaggugcgguggcucaugccuguaaucccagcacuuugggaggccgaggcagguggaucgccugaagucaggaguucgagaccagccuggccaacauggcaaaaucccgugucuacuaaaaaugcaaaaacauuagccaggcauaguggcaugcgccuguagucccagcuacucgggaggcugaggcaggagaauugcuugaacccaggaggcggagguugcagugagccgagaucaugccacugcacuccagccugagcgacagagccagaccccgucucaaaaaaaacaaaaacaguuauucuuuuccagcauauuugauccuagagcaaacaggaauuuuuuaauaucaucuaaaauugguagauauuucuguauuuuauaacuccacuggcccuaauuaugaauuucugaguuaggccaaacagcauuuuuguguguccccucucauauacagugauugccgcaacaccagcaucggaauaguuauuacucuguugaguaaauaugccgucugucacagaggcaaguaaucauccacacuuuaugcuguguuucucaaugggaucuuuuuuagaaaggugaggcuugugagaaaugggugaguccacauuggaauaggcuugcucuaagagagacgcccacccucauucucaguuccaguccaucugcuccuccuaccacacugcccuuagguaagugcugugcugggcaccacccuguucagccuuugauccugucuggauugccuugaguguguucucuggccuuugauuuucuccucagauaacugcuacgggguuaccagcagauuccugagaucauggacuaugcaugcaggaucaucuggccggggucuuccagcugauacauacacacacccauguacccuuuauaaagacaguuacaaggacaguucuuuucuauaucccaacucucaaacauacuuuuuucuaaaguugaucugccugagagccagccugcagucugcagggucuccuguccccucuccuucacagaguggggcagacaguuggucuuucugccaucuaucugugauccuccaugcgucucugagcucaccguuguacucugcccugugguugaagaccucuggcaugccagaugcaaaauacuggcucucauaaagcuggaaaagggaaugaaucaaguagguggacaacaagacuuuuuauugcaacuuacguggcucuuuuuuuuuuuuucacuuuugacagaauuaaaggaguacccaaaugaugucagcugauacacagugauggguucugaccagcgugcguuuaggcauauaacucagaaagaguucgcauauaacucagaaagagacauuacugcaacaaaaccccucaaaucccauuuaguuuuuaauaugaaggcuuuuuuuuuugaaaaaagaaaaauauaauuaaaaugacacagaaacaugccuuaacuccagcagucuguaacauacauucauaaaauaauuuuuaaaggcuucaucuaucugagauacauuuccaauaaaaauauacuuuuuucuuuaauaauuaccaauguuauaguacauguguagcuuugaucaguuauaaacugaaaauaaguauaauagccaaacuagagguuuuuuaaaacuuagagucuugucauaggaaauuuuuuaaaaaaauuaaacuucaauuaauaugcauauuuuuguuaaagaggauuaugguacagugauaacuaaaagaguuucaggcauaaaauuaucuuacauucaguuaaaauucuggagggaaaguggaauaggaguaauauaaauuuaaagggaauaaggaaugcuacaaaacgugaaagaagagccuguucuuuuauuuguuaaauggaugauggaguuaucaaaugacaaugguauuuagagauacauguuuuauuucuaaaugucaauauuuaauccacaagaaguauagcuucuacaauuauuuaaacuuaugaugagaaauuuuguguccacuuaaaauugugugagagggcacguaguuuuucaaaauucuaucuacauccaguuuauggagaacgccgauuuguaaucuuacagugauuuuuaaauguggcuuugcacuagaauugcuuugagguacuacuuaucaaaaauacagauuucugggcucccacuuagaucuaugaaucagaacuucugguggcggggcagagauggacagugucuuuagcaggauucucugauuccucgugauuuuggugcaaccaauccugagagcaguguuuggcucccccguauccacuugcuucuuccuccaggccuggaggcccugcuuugucugccucggaaggacccuuaaagugggcaggagccauggggccaaaaguacucguugauaugaacccuggaaugggaccuaggagaaaugcuguuuuguucauucacauuuaagggagcaucacauucucucuuuaauccagcucuuguugucuuauccuaaaauguggcauuuuuaaacucuccuuuaagaaauuacaguucuuuauuacauuuuucuauacuaguauugacccacaaucugcuuaggaucacucaaaaacauugauuucaaaacuauuugacuucuaaaauuugagucuguuaaaauucagaaguaguccaugauuuguagccagcuuucuggaucuuuuaaugauaaaauauuccuucaacauaugagggguggcuauuauuagauaauaugcaaucgucugaaagguuugucuuaauggauuacauuugcuacauauuacaggaggugcauugucuuccuguauuccguaugugagagauuugucgccauuuccugugucucaacaagauaaaugaacuaauuuaaaauauuuuccaugccucaucuguccacuccacaagcugucaaugggcuuggauuggaagcuugcaugccagcaguccugagccaggaguacuguuauuuuggaaaaaaaagaaaaagaaaaaaaaaagcuguuuccauagcagcuuggaacuccuuugcaagugugcuuucacauuuuuguaggaucugguaagaaagccgauauuuuguccagcuuucuuaaagcacauuugccugacuuaaaugaaaucauuacuuuuuaaaaauugaaguggugggggaaaauuuucaagaauugaugagaaaaaaaaucgagaugaguuaaaaaacaaaacaggaaggaaaaagaaaaauauuagagcugcuaaaauuuggaauuauaaaaaucaaaauuggaaagugccauuuuuuucuagguaaauguuucuaauuuaccauguuuuaauguauuuuguggguugaauaacguaaaaaaaucaaauuguagaauccucacagguguauuuuauuuuauuuuuuuugcagucacuugaagucaucauauguuccuccauagcacauguaagggaaaaauuauauacagagcaccauaguggcacacaacuuugaggcauuuucaucuuuugcagcaggaucgaguucuucacaguauugacucagugguauuuguagggaggcagagcaaaggaaauaauaaguuggaaagcauuuuuacuguuagacggguuccuuuuggauuuucugaauuuuucuacuuaauaauacauuuuaaugagucuuugggggaagucauaacuucacuucacugcuuaucgcugcagccugcucacaugacacaauacucuugugagguauaauaugaaaaucaucucugguuaaaaguggauuuuggcuuuuagccuaauaccgagcaaauaaccuuuccaguccaaguuacauguucccauaaacuccuuaaaaccaaauuuuccuugcuuaaaaaaagucacugcauguaauucccaaaggguggggguauggaagcacuuuaaauuagacuuaaaaaaacccagaaaaacaaaaccuugccauauuuugcuggcucggccuuuccuuugcucagauuuggugggugcugcuuugcuagagucaugagaggucagaguucucaugagggauuuugaauggccgucagcuggguuccauuccuaagcuugaacuguggcuuaaagcagaaugcagcugccugccugcccaugccagugcaucuucccuggggaaucacugcagaaucccccaagccuccucuuuguacuugauugugaccuuguugcuguccaaugcuugaaacccccagcccuuccagcucccucauuacacagagcuaggcuuucugugguuuccccaguaggucagccuuaagguagaugaaaauuugauagaugcacuuauaaccucuucagagcuuccuguuggaacuugacaagcagauucuuucuccuaaauauuuugacacacagccuuuaaaaugacauuuaccucuucuaggaccauuuuugacaguagcuuguaguagauuuauuuuuauuuuauuugaaaacaucauuugggguuuuguagaaaaaaauaaaauauuuaucuccacagcuuguuaucagcagggaggguaggcauucuuggagggaugggagguuuauugguagaaagauucaagaagcuauuuugugauaaaggauuucuuugcacuuuuuccucuagucaaguaaauugcuuguggguucuugcuaaaaaaaaauaauuccucuggugcuacuuuuaauuuggucagguuuaaaauguuuucagaaggguuaagcuuccuuugcauuagugccugguguggucaaaugaaggaaugacuuuggaauggacugcuuguguuuauaaaugaccuccccauagaagguucagaacugcagaauagucaaaaccguaacacuauuucuacaugucuguuagauguguggugucuccuccuucccucagcagguauaguuuucuaggcauguuuaucuuugacucacguuguaagaauauauguuuccugugauauguccaguguguccagcugucacuuucaaaaauaggcacacaccagaauaucaauccauuguuaugauuucucauaugugacuacugagaacuguacuuuucuugcaaggggaagaaugaauuguacauccuauucauguccauuauguguuuacaagugaaacuauuaauacuaguggagcauggaugcauuuuaugggcaggugggccagguugugaaaacaccauuauaaagccuaaaauuugaggaaaacccccccaaaaccuccauugcuugggggcucuauuuuuaaucugaucuucuguugaguucaugaauauuucaaaugaaccugaccaggugacucuuucuuucgaggcucucagaugguuuucaauggaaacuuucuuuugucacugucaugagauuggcuuuaacccaguacaagucuagaguggaggucugaauucacuugggagagagguaaaaacuguggaagauuuuggcaaacuggauaaacauaggcaauaaaagaaaaaaaaaaagauuucggcaaacuucacacaagucuaguaauagaguacaauacuuuuuccacuccacuacuauagaauuuuuuuucacuaaaacacuuuauacuuaaaaucauuuaaagaaagaguuuuucccucuaggaaaaggcagaaauacacauccccuauacuuuaagaaauauauuugggcacagaugucuaguuucuuaucuuuuguugagaguuagacagaugugugauuuuagugaauguauuuauaaaaaaauaauuuacuaaacauggcuacaagaacaaaauacuucaaaguccuggcugaaaacccugaaucugacaaggauuuuuuuucuuuccauaaaaauaaaucugagaaacauagacugagaauauugaguuaagccuuggccaucacacuugccaugaaaaugggaagcaaggguugaagaacgagcacaucagccugcgacugggaagacaugggcaggaaaagucacauggugcugaggcaggccugaccagggaaccugguagagauuagauugagaagaaggaagaagaguuggugaugcuuguccugacacaggucucagacccugggcucagcacaugcuucucugcgcuguuuccugaaguguuauuuguuuaacgucccuuacuuuuugucucuuuuucauauauaccccugauaacuggggugaucugauuuuuuugucccauguggaucuuauacccaagcucuuuggccuuuugcauuggcaaacugaaaagaacugauguauuauuacauucugcuguuucuuuuuucuucuucuucuucauccuugaaagaaaauaguaggaaugaccguguuugugaugccucuuuuuguuuauagagcacuucuguauccauuauuccauuaaucaccacaguaauccucugaaguacagcuguggaaccugaggcucagagggacaugguaaccugcaucuuagugggagagcugggacuccuaugcacucuccuuuacucugccagguggggguaaggguauugaguuagccugaaaaucugcuuugauggcaguaucaugaaccgcaaguguuaccuuuauuacaaaaaacuagaggccuugaacucuucuuucucuguccucauuuugcauuaaucugaccagggcuguuuggauaggauuccagagaaauauguuucucuucauaauuuaucauugaaaacuaccacuuuggccucacaguugaagcaguaaaauauauauguagcuacacuuagaggcacuuugucuuuuacugccgugaagcuugcugggcacuucuucugugggcuucuuauugauacauaggcacccauagagaaauggaggugcaggaauuccaggauggacuggguaaucuucaucuuucacaaaaguccuggaggugauagaagaccacacuuuaguuguaugauugccagugagccagaacauaagcgguacacgucuuuuagaguaugaacguguucuugcacacaucugcuuggguaacugacuguucuguuugaagagaucucacagaaauggaauuuuuaaauauugagaagauuccauuaagaaauagagggagaauggaaagugcauuauaaaagccaugccaagaauagguaaaguguggccuagcauccacaaaauauuuacuuuuaauugaacuuuuagaaguuaacguucucacucuuuggcuaaagaguuaauugcugggcuuguccaauaucuguuuggagucagucauccaauuuuucaugacagaaaaagaacauuuuagguaauguagauggggugguguuacuuccaugaagaaaaugugcauguuugaauuuaccuuacuccucuguuguggccaccccucuuuugaggaccuguuaauggcuaacaggaaacacaggaaaaugaaggguggagcaugguguuguugauucauugugagagugaaucugccaguucugagucugaaacaauacgacgaauaaaauagcucuaaagauaaucaggguuuaugcuccaucuuuuuucauuauuauuauaaaaauaauaaaauaacaacacgaaaaaagaaaacggaaaacucaagccuccccuaauuacaccaugauguucuucauuuuugcuuauucauuuuaucucuguucacaugugugcgugguuauuguuacuguauucauguaacuuauaauccaggcuucucacuuggcauuggaugguccgcauuuuucauuguucuucaucuggguuuuuuuguguguguguccuggacuccuuuggcaguuuuugguaaagcguauggaccucuugucagaaaaauacuuuuuaguauuuaaaauauacaggauuacagaggagacaauuuuguuaaaguacaguuauuaaaauacuauaaacaucaguuuguacuauagcaaucuauuaaugcauuaaguacuuaguuguauaaugucuaaguaauuauaagcauaaauauuuugaaacugucucuggaucugaagguagaggggagggaaguugaggaauuucauuccccgugacugguauuaucuaggugaaggaagaggcacgacugucuuuagaaugugaggacuuugguucugguugaagagagguaauguuuuaaaacagauuuauugaaggauaaggguagcauuauuuaccuuuuacuguguaucagguacugugcuaaaccucuuacguaugcuaucuuuuuaagggcagcuucaugaggaauaggugcuguuaccaucuuuaccuauccagugaagcaacuaagcuuggagaagugacccauuguucuaaucacaaauagaucacugcagaaauauugaccauuuacuuguccucaaaggaagucggccugaauaauccggaagcaguauccugaugaguaauacagugcaaagccacaugguggcaggguuaggauucaggcuuuaacagugccuguuuuacuaccuuuuguccauuccuuaaguugggaaagguaaaaggaauuucuuuuuuuuuauuuuauuuuauuauuauuauacuuuaaguuuuaggguacaugugcacaacaaugagaacacauggacacaggaaggguaaaaggaauuucuaagugaccuuaagggccacuugagauuggaaaccccaaauuuaucucaucuagaagacgaaucuacaaacucacugcugcgugauuuuucucuuguagcaaccaucugagauacuuacguaggggaagguggugguugggggcuacaggagaagggaugggcucuggacuggacagccaguguccaugcggaggaacccuauacugaguuaacucuucucacagcugcaguugucuccccugaaaaggugcuuccucugaaaggucacccgggacaugucugcacugcauugacuuuauagcuuuucaucacuguuuccucaguuuuauuuggagacacaguguguggguauuucaacucaaucauaaauuuccucaaugugggcugcugcuagcauaauugaaagacaagaggcaaagagguuguggcaggucacagacagaacaauucaugggugacaguuucuaauaagggucagaugcacucaggggccuugggauagcuucugguguucagaaaaggaagacuaccccagcguagcagcuuguguaguuaucaaaggaaaaugaugagaucuuuuuauuguuccguuucccaaccacucuaaccaagguaaguauauauagcaggaauaucuacaaagguucaucuaaacuguuaaaaaaugccugggggaaguuggacaggauagaggugcuugaaacucacuugugggacacaauuucuucauugcacauccgugaaucagagauaccuuuacuguuccaccccgguccucauaaaugcauguguuucaguaaacauacaugaaacagagauuugaggaacuauacacuacucucugaaaaaacgucagcaaaccacagcugcaaccuuucaugcuguuggauauuuguacugcccaagaacaaaucuugcuaaggauaauuaguucuuauuuuugauuuauccuguuguuuuuuuucucagauaccuuuaggccuucaggcccaaggccaaaaaugaauagaaaauguguacuaguccuugcuuccauaaugccaauagcaaaucauaccugauauucauaauaaacaaagaucuuuuuuuuuuuuugcuuguucuuggagcaauagagagcuuguaagccagccuuccuaaauugugccauaugggaaaauuauguguccuuuaauuuaacuaaugugaauucaaucauuaaaauauuauaguuuccaacauuaauucagagagaucuaaaacuggguaaguugaauagaguuaaggaguucuucuaaguaauaaguaauuaaacgaaucuggguagauuuuuauaggguggagagcauacacaucagugacucuagcaggguacaguuguaucagaagggacggugacuuuuguuaaccaaauaauucaguaauucugaguucaacuaauaaaugcuuuauccaaugagaguaaggauuuguguaaacaguaauuucaaauaauggaauuuccuuuaggaaauaggugcucuuuaauacgaacauaaaaagaaauaaaaaugcaaauacagaaguacuuagaaaacaccuauuuugugguuuaggaggcuuucuuuccccacccaucagcugaaagauguuugguggcacuuaauaaguauucagaauaaagcucucuguauguuauaauugugugccccuuuugcccuuuaaauuugaaauaaaggauggaacccaaacaggcuaugagagaaauaaaaaugguaagugauugauuuuuuuucaacauacauaacaauugcuuauuuugugauucaucagcaaaugcugcugugugcuaucagcgaagugcuucuuucaacaugagauuguaauguugccuuuaauauuuaauuucuuuguaaaugcugcuuuuaugugugcguuuucugcacagcacagguaguuaagugcagaggggaagcacuauuuucugcuaagaggggucuaggaaaaaagggcaggaagcauccagaggcuggcuuguuucacccacagccuucucacccguucacuucuaucuguuugggccauguuaguuuugcaguuucagugacuugcccuuauuccugugccaagcuagaauucccaaccaggucagacugugaagucagacagacaacuaugaaauacuacauauucccuaccugggagacuagaggaguauggcaguuggucaagguacuccccagacacuuagcucguauacugugacaggugccuuuaauaaaaaggcagcuuagaauucguccaacuguaaaggagcaaaagauggacaaagagaugugccugaccaacaggcauuuccacuaaagaucaugcugauuuucuggguggucuggucuguagaauugcuugauugccugagguuuaacccagagccccucagagaauuguaauaaaaugguaguccuaauuuccaccuaaaaauuagcugcuacuacuaagcgaucgugagucucucaccugggcaagugaaguuugugccagaguacaguccaaggccuuucaggaucccaccuuuucagccugccaucccuuggcugugcuccuacuuccugacuccauuuugcucauguuuuuucaccucugagcuuuauuacuuccaucuagaauguuuuuccuccuucuucaucccacucccacaugcaguggcugaagccugcuaguccuucaggguaagcucacagucuacuucuucuuaguggcuuucuuauuccuuuaaaacccugcuggguagcuucucugagccaugaggcaggcccugggucccuguggcugcaggcucagccagcgugcagcaugucugccaauaagccuccagugcagagucugaucuggugcugacgcacugcacauagcaucuaaacuccgagaaauuaauuacagaaaacuuugagagaaacccuguuuuugcuuuauugugcauucuugggagccaucagguuggaacucauccagcugugucuggucucgguaacucuuggccuucaguucagaguggugcagaggugagcugccuacacucuccugccacaucaugggcuccuccaugaccugagucaucaaaguagagucauaccugcuuccuuguccuguauuuggugccccgcagguagcugucaugaaguucauccucuccugccccucuucuagaucugcucaguagaaugguuugagggcuggguggagguagguaaccaggucaggcucacaugcugccucgccuugcccugccaguccaaucgucucuuaaaucuaguagugcuuuaucuuuccuauugugauuauggcuguaaagcuuuuguuauagcuguuuuuuauaccaaauuaaguuccuuaaauacaaggauuguauaucuuuuucauuuuuucaucugccuuugcauuuugcaaaaugaucuuacauagaagauauuuaguaaguauugaaaugggugaaagaaugaauuaauacauuauacgcauuaagggaacauucauaugguuaauggcuguuuauguguucagucaguguucugcuacuuggcuuaaaaggugcuuccgcaaggauucuuacuugaucuuccuuguaauguaucuguugauccaaaauaaaacaaaguaugacugugcuguugguguaguacuuuucacaaaucauuuguuaauuugucuguuugugucugaaaugccuuggccuuuccaguucuagaauucuuuugugauuuuuauuuaacauuuuaucagugccaacagugacucauuagccuuauuuugaauacauguaaccuuauaucugaucccuggccaccucuguccauuuuuuuuagcucugucucuugaccuagcugagcucaucccacuggccuuucccugcuacuugacuuuucuuagcuuucucaccuuuugcagggugaaucucaccaaacaaaaagccaugagauaaauggcuucugauaccuuauuuaugauaaggauuuaauucaacacacuuggcauuaugagccauuuauuuuaaugcucugaacuuggagugcauaagaaauaacuuuuggggaagagagacagaggacuuaucauguuaugaccaguugcccaaguaaacaggauuuguuuuaucguaucacucauaugugggugaggcugcauauuaauugcugccucucacaaaacagcccaaacccuguggugucagugcacuggggacuuugcuuuucaguguccuccauuuccuucccuccccagccacucuuuagcugacuagauaaauugauuucucuuuauuaaucuacucucucuucuccuucugaaucucacucucaaauggcaguuguuccauucugcauuuuauuguggcuagacuauccucuuuacuguagaacucagacuucccccagugcuagccaguauugacacaugagugauugacuuaaugaauaauaaugagcagaacauaaaucuuacagguaggguuaaaaaucaaaggauucuauuacgaacccuguauuuaaggacuuggagcaaacugaagguuuuagccucgauccucugacuugccugcagcaauagugauguccguugagccaaacauuguucccuguuugagcugggaguguuaacuugcuguguggugcuuagaaaaaguguccuuagggggcaaaaggagaaagaaauuagcuaauguaucauuaucauuagccugugacuuaaucaggaaacaacaauuaaaaagcauucacaccuauuuuggaauaccugccuguuuguggaagaaaaaaacaucauaaaacuagcaaaacaaaacaauaaaaaaucagaaaucauauuaacaggaaaaagggggaaggagaugugcuuugaaccuccagcuccuucacaguucaucauuucuugaugcccuuugccaggcuggaugcucaaggaaaucuaaugauauacaaagccucauugccagauacuucauuacuuccucaauccauuaguagccuuaauggccuaugccacuggaauaaguauggaaauccagucccccaagaaaguacagugcucuauaaaucacaccugccugaggauucucucagcccuugacacugaagaauaggugaaaaaaaaucauugcacuuccuuaacucccuuguacuagaagcugucggcaugagugacaccuuuucacuuuuuaacccuguagccucuugguucucaaagugugagcuguggaucaacaguaucaguaucacugggaacuuguuagaaaugcaaauucaguggccccgccaagaugugcuggaauccuggggcggaagagagccacuucuguucuugucaucagccuugccagaacuguccugucagagauacccacuaacagcuuuuggcugggugaucagcucccuggaguccagugcucucuaaccuucuuucauuccccucccugcagaacauacacuuuucaauuuucaauuuuuucaauuuuauuuuuuaauuuaauuuaauuuuuuauuuuuuaauauauauuuuuauacagaaacuccauuuaucuugaggaguuuggggguugauucaagguuuuuucuacuucccucucuagccuugacucucagaugagacaggagcucugcccuggcauauuauuuacuuuaauuuucuaguaauucucauggcuuuauucugaaggcaaaaucaaggccgguuguggcgugauggcucaugccuguaaucccaacacuuuggaaggccaaagcaggcaaauugcuugagcucaggauuuugagccuaggcagcauggcaaaacccugucucuaauauaaaauuuacaaagaauugucagugucucaguagguuagggauacagaaaacauuaacuagccuaccuaaccuacaguaguguuuaucaaaucucaguaugcauaaagauuuuuuuuuccuuuuuuugagacagagucucacucuguuacccaggcuggagugcaaugccgugauuuuggcuuacugcaaccucugccuccuggguucaagcgacucuccugccucagccgcccgaguagcugggauuacaggugcucaccacaacuccuggcuaauuuuuguauuuuuaguagagaugggguuuugccguguuggccaggcuggucuugaacuccugaccucaggugauccaccugccucagccucccaaaguacugggauuauaggcaugagccaccacucucagccuaaagaucuuuagaaacaucauguuaaaaacauucugaguggcacuguuuuuaaaauaauuaccucauguugacccaggguuucugcugcuuuuaauuauggauucuuccuuuuuuucuuucuuuuuucuuuucuuuucuuuucuuuuuuuuauuguggauacuugguuugggguggcucugaggcuuuggggcugagaauuauucuuacuccuuugguauccuuugccuaaaggauauucuuugccaaacacuuauuuugcauuaguucuuaucuacuuugguuucucuguucguuuaguuccaccuguuucccauggucuaggaauuccauacauguucugguccucugauggcacugucucuuguuugucauugcuguuuuggcuucauccuuuuuccuauauaguuacguagggguugggccuggauagaugguagcagggauugaucuugauccaguucgucuuugcuuuucuuaaagcuuucuucccucuguuguccccaggcaugauucauuaauuguagcaugccuauucauguuauucuagugccagguagcauuucguucacuucuuucauagcauguauuucguuguaacauucuuaagugcacauagaugucuuuaaccuacuagauuccauucuguagcccagguaucuuuaggcaucaaauuccagagauuuuucugccagggaggaaaaaaaaccauuuuagcaacaaacaaaugaaaaugggggucugaaauacugcguuaacugucuuacaggaugcauucgcaauggcuccccucauagguuuuaugggguucucugucucugcaagaaccugugugauguuuaaguguucucaacucugaauaaacaucuugcaaagcauugaguuauaauaguuuacuguuagguuuacuuccuaaggaaacugugauucuguccuuagaaguccccacuucugguccuccuggaauagggcaagucccuccuuagguuccaaagauugaauccucucugggcuugaguguauucugucuucuuacgccuuuuuagugagucucaguuuaaugaaguuaauggugauggagguugggagauaccaaugcuuuaauuagcuaagucacaacacuguccuacucuuaaaagaucuuaagaaaauaagacauaauuucaccuuucauauaccugucaauaucuuaacuuauucaaacacugaccucuauguuguauaauuagauucuugaaagauugaaaaugcccggggcuccugauaggaguuuuugcuuuuguaucugccaucacauuucaaauaauuggaacugacaaaaagauaccaaaauacuaaaaauuacaaaaaauguaaugaaacugauagcauggauugucaaagagauaccaagacagaauauuaaauaaugcucuuaggcagauuaugaugucuuuuuaguuuuaugguucuguguauuuguguguguauauaugugugugauuuuuuaaucaguuaagccacauccucaaccuccacuuaaaaaugcuuaauuguacauugaaucuagauguauaaggaaaucacauaaguaccuaauguauaggguccuuauggggacuagugagaaguaacacuuagaccaugaagggccuuuuacaaacuuggcucuugcaccucaugguuuucccuuuuuuuuuuuuuuuuuuuuuuuuggagugacuuggagauaaagagaaaccuuuaauuauaugaaggauauuaaguacgaugguggugacaugagauucguguuguaaagaaucacucgggcagcuuuggggaagacaaauggagauagaaugaaauaaaggauggagauacacauugggaauccauuaugaugcugggcaagacaccgugggcggaggcaguggcaguugguauagaugguaggcagagaucagaguaagacugagggacagaaucuaaaagauuaagucaccgaucagaugugaggacacgaagaguuagaaguuaaaugcacauugauucuugcacgucucugauaaaauauuagucuucaaaagggcuugaguuuaaguaccuuuauugucccagaaaagaaaaucuaccuauaaaagaagagcaccaacauuugaucagauuucagauccuuuuuacucuucagaaugaaaauuugagcuuuugaucauuguuucuucugcuuuccagaccuaacccuauguuuuuccacaaccauuuuuuccuaacccucaaguauuaguucacaacuuacauuuagugaaguuguuuuucucuaucucucauaacaaauguacugauaauguuuagggcuaauuguaugcaauuuacuuuucgaauugugguaaucauuauugcuguuuuuauuuucaucuucucuuccccaggcaucaucagcuauagauauucaaccaaauuaugcccuuuggggugauuuucaauuuucucacuuugggaggcauauuuuuuuugucagucaugaaggguucagauuuggauuauuaaacgcuaguuuccacauuggaccauuuaacacuuuacauuuccuugucuuuggaaaacuuaacuugccccuaugcuguuuggguguuuuugaagaccacaucuaauuuaggaaagaaugaccuguccuccaaacccauauucuacuucuugaugcacagaaagaccugucaugcaggagggcaaaacagaaguagcuucaacauucauggauuauuuauaggagcaccucuggggucuuuucccgagcucugugccugcaggaguaugugcgaaaguguuuggcuuuccuugcuacaagaaauaguuaaacauaugucuggcagucugugaccguagcaguguguuuccuuuaaagaaaguagauuacauugccacagaugcugucaccacuagggccccuggaggggucaggacuuguugauguaaucaguuguuuuuuuuuuuuuuucuucucuaguagcuauuguucuguaaauugugggaacugacuggguuacagaaugugaauugauguucuucucuguuuuaaccuuccagaaaugcaucuucugcagacaccggguuaagagggucucuggagccugcauccaguguuccuacggucgcugcccggccuccuuccaugucacuugugcccaugcugcugggguacugauggagccugaugacuggccuuauguggugaacauuacaugcuuucgacauaaggucaaccccaacgugguaagaugugcccucccuuccucagugcuaagaccgugucuggauuuucuccuguuuuagacuaccucccagacauaaugugcuuuauucuguaauaugacucauuguugacaugucuagaccgugaguuccuugagggcagggauugcgcacuguuauuuccugguauuugccuaggaccugucaagugccuggugcacgcuaggcacaauaaaucugucugaguugaaugagugaaugaacagaugcaugcagaaaacucuccaugccuguucugguguuggaucuguacacagggcugcugagcuugguuguacacauugugcacugcacauauccaggaugagagugagaccauuucugcgaggggaucaccaccugagauuauguagugaacagucuaugaaacuguacacuguggucuugggcuguuauuuuaucuccuuuagaagaaacaaagagcagcagcacaguaaaggaagagguaggauggccaggagcuuuugggacuuugcugccuaaaauggcauaugugagggacagccuggggcccuggaaggagugaggauaaucucauagaaaaaaauagaaaaguagaggagaaauauagagaacaauuuuuuugagcuuauuucugggaaaaguguuugcaaccaaauaauaugaauuuagccauauuucuguugaccuguccuugucaaaugaaaucuuuccuguguuuuaaaugcuuagaaauauuaugacagcguagagauaguugauaugucuuuguuagcuuuccaguucaccaugauuguuucuggcuaccaaauaggaggcuaaagcauugucuagaugcucagcucugcuaacuugccgcacuuuguuuucccugagagacuuggccacaggcuauuagcagccuaacaugcuucuccuaugucccuaauaaccucuugugagcagccugccaagucgucagcauuggcuuguggagucacacacagcaaaucucccagcucuuuguaaugcuuucagcaauuuccauugacaucuugagagauauuugauguuugugggcuggggaucugggcagaugugagugaaugcuuaaauguacaaaaugaugucaccaacugucacaucuauuuuauuugucuuauuuuuucauuguuucagguuccaaguugcauauucauucaugccuuuuccauaguuucuugaguugauguccuuuugcuaagaauaguauuauguauccaguagaaaauacauuuuagcaacuuuuaaaaauaccuaguaauaacaccuuacaugacuguggugccuugcccuuaacagugugcagucaauaggauuaccucauuagaggauguauaugaaugcguuuugagaugugaacaaggucgugaccucugaagucagaguaguugguguucacacuuagauucugccaguaacagauugugcaacccugugcaaguucuuauuucugagccucagcuuccucaucuauaaaacaugguaucccaccucaccauguuguuuucaguucacagcacagaguaagcacucaaaaaaugaaaguuguauugcuacuacuacuucugcugcugcugcuggugcuacaaucuuaugugaacugggccacgugaguaguguuuuuccuguuucgaggauaagaaaccuaaguucagagagguuuaauuccuugcccaaauagaugcagauaaugaguggcaggugcuggaauguaaaugccuuuuuagcucauacucuauuauuuggugaauuccaaaccccaaaccucaaauggugcuagagguguucaucugaagcuuugcuugggaucauacauuaccguuuuaauauuccaaagcccugugguuacugaugacuauauugaaguugcuauuaaagagauccagguguuuaaucaggaccucauuccucuuaacucucaugugugguucagucaaguuuagguuacuaauguguuuccuaaaugaugaugaaaaagaaaauagaugaguuugaggugauuuagaaacuacugucuccuacagauccacuuucagcuugguauacuuuguaaagacuggggaaaagaucauauaauuuacaacaucacgugaggcagcuuuuccugaugagggaacaauuuuaguguucuuaaauugccuuugcuacauuuucuagguggaagcacuguuagcacuguauuucccaaguauauuucuaguagcuguuacuuauccauucuucuuccauucgacuccaaguacggauuccuccccaaaguguuugggaacuaaccaguaggaauuuauagaaucuggcaacuuugguuaagaacauugugauuugccccuauugcuuuaaauguucuuuccuuaucaagcauagaaaaguucagauucaaucaaauauuucucuuuguguaaacuaucaaugcuaagagguaugcuucuuagagcagaaacuguaguuugucuguguucucaaccaugcauugauuauuugaaaguaauaggcaauugccgaaucauagcagugaaaacuguaaaauaaaguucaggcuaacuuggcagccuggcccaguuguuuuacagaauaauggaggaugccuguaugauuuaggugaaaugaaguauaaaccuacuguugcuucaauagagucuccauuuuuacucacuuuaggguuuuugauucccuuauuuuuuuauuucucccaauuauuugcuauaaagcauccaaaaggaccauuuuaaggaaaauucaacuauuccauuagugucauaaauuauuauuuuguaauuaauauauuuuuaaaauaguucucauuauguuguacaggcuggucucaaacucuugagcucaagagauccuuuagccucagccucccaaagugccggaguuguaggugugauccaccgugcccagcuaauuauuuuaaauauaugagcuuauucauuguuuguugagcuuuggauguaaaauuauuuugaauaauuguauaaaauucaucugauuuguuaauacauuauuccaucaagcaguaagcagaguuuauaauuagaauaggcagugcuugaaaaaaauaggguaaaacuuccuaaagauggaaaaaagugugucacaggaaguacacagcugaucccuguuauuucaaccuaaauuuuuagcauguguuugccagcguuuuuguugaacaccuuuguugaaugucacugcuguguuucagauguaaggucuccuucaugugugcacaugagugugugcucaucugucgguguguguagucaugcuguccgcuucaccacccugugccaugauucauuauaaccuaguuucuggcuguauuuccaaagguuccacuuggauauauuccuaacccaguuaucugaauguugcacagauguuuguaaggaaaagacaacacaauaaauaguaguuaugaaacuggaagucuuggaaauguauuuuuucuucaaacaaauagucagcuaccuauacacuauauacuucugcaaaauauagcaccacagggccaucucacacuugaguaaacuagacagaugcccuguggaagggaugccugaauaacagaggugagaaaauggcaugcaauguuuuuuccuggcaaguuacuuaguaaacuuucauauuagguuagaauaaucugcauauuuaguguagcagcaccagaaucacuugcacuuuguuaauucacugcaaugaacauggccucuuuauacaucuuauaugagguacauaguguuuuuucuuaauauucuuuccucuagaaaagugugacauuuaaguuguauucauagcuuuagaaaccuuagaagucguggcuguuaacauggagacagauaccuauuuaaaagagaggaagaacuuuuauagagaaaacgcuguauugguuaauuuaugugauuuuguguauuuuuccuuuaguauuauuguagcuaggucauaaggacagaaaguauuuguuguuguuguuguuguuguugucuuuuuauuucuaucaacuagcacuuggcuauccauaggagcagcuugguauaaauuuguuaaaauaauuauccgaugcuagggagugggauuaguggagaagaacgagaacuuguauuuauugagcaucuuuuaugucaaguguguguuagguauuucacauaugcaccuuauucagagcaguguuuuuugugugcauaauggaaagcaggguggguaggguggcuucuguuuuggcagcucccguucuagaaacuugucuaggaucuuguuauuccaccaucuggcccucuuccaugugucuucuaacucucaucucaguaauacaacugaguccuugcucagcacuuacugaaugcuuuuuuguuuuuuauuuuuuuuugggacagggucuuacucuguuacccaggcuggagcgcaguggcaugaucucgacucacugcaaccucugcuuccugggcucaagugauccucccaccuuugccucccaaguagcugggacuacaggugugcgcccccauguccugcuaauuuuuguauuauuuauagagacuggguuguaccauguugcccaggcuggucuugaacuuuuggacucgagcgauccaacugccuuggccucccaaagugcugggauuacaggcaugagccacugcgcccagccugaaugcuuuuuccagccucugggucuuuaggccagcucccaggccaguuuuauugcaacuccuuccuguccucaugaggcaugggcuuaggacaggagaggacaccacaauacacagaaucuggugaagggcucaaagcaagggcucuguggguuaaccuaugacuauauaacuaaucuuggggugaugauggaaugggcuaccucucauugcuaacaacagugaaacauucuaggccucaacaauguggaaagauggauguuugaggcucccaaauucuauacccuagaauaguaguucuuauccuguauuguauuguauagcauauuauucuuuuagugucuguuauugagaaaauacuuaaugaaaaaaauaagaaucaguacacuuuuaugugaauuuauuaauuguaaaagggcaggcaguauuucagguugauuauggauugacagggagagacuccaaaacauucacucccacuguaacauucucuuuuaauuagccaaggaugcagaauuguaguagaaguggauuugguaaauaggguagaagugaaugcagccuaucauaacaaaacuucccccuggguccuguuucccuaaugggcauaugcagugguauguguguaggcuguugccagaucugaaacuaaagauauauuuuugcuguaccacaggauuuuauacuugggucucauucaggaaaacugauuauccaugcuucucauuuuaauaaaauuuuuauaaacaugaagaugcccuaguucuuaaaccaaaaucaaggucaacaguacuauauaaucaacuaggggaaaaaaguaguucuguucccagauggggaccugaacaauaucucucuccaacuuucuagaauuuuuagaaagccuguuuccuccagagccuaccccugauucugguuuauacauuucaauccaauucguuccaacaggauuuuuauuuggaaggccagaauuacauuucagcauauacgcauuucacuauauuguugugccccuuggauguaagacggguggucagaugauuguguuuuuguaauuaagcagcauucagcuaauuuauaucaguggguaggacuucgcuuagcuuacuuuauguuacuugacucuuuuaaacaucaucaugguuuguagcuuuuuaugagcccauugcguaccaguugaccaaaauuuucuucuugauguucuugcuccccuuggaccuuuuggagccucuucuaggugacugcuuuauuucuaauuuuaaaccacuuuuaaaugguuuggcuguguccccacccaaaaucucaucuugaauuauaacccccaugugucaagggcaguccagguagagguaauuggaucaugguggcaguuugucucacaagaucugauggcuuuauaaagggcuuuccccuucacucagcacucauucucucuccugcuguccugugaggaggugccuucugccugaggccuccccagccauguggaacuaugaggcaauuaaaccucuuuccuuuguaaauuaccuagucucaggcgguucuuuauagcagcaugagaauggacuaauccacacuucuagacaucuuugaaacuaucuuuguuuuuuucgcagugggaaaugccaaaguuaucuugguuucuauuguaccaaacugggaaucagugauucaucaaagagcccugguucuuuuuuaugggagcucuacuagagaccaaauuugccaugaaaggugcacauuaccauguuuuguuucauuugagugcuggcuaauuuaggacuagagccacuuuagugacagagcagauaaauagcauuuuuuuucaaaugguucaggguucauguugauauauccaauucuccuggcuuuaauaaauuuauuuuuauauuguucuaacuugagggcuuauuaaugcaauuucuccuuuccuaagugaugccuaaagauuuggaccuguuuuucuaaaauucucuuaacucuuccuagguuuguaugguuuagugggugggaaugagguauggguugggccuaccaccuccucauccucuacgcgcuuggauccacagccugauuauggugcacauacucuuccacagggggccucugcuuuucuggucucuuucuuuaagagcaaaguuuacaguuccuuugaagacaguuucccgcauuugaaaauauuuuaaaccuauugaagaagggaugaaagugggguagaaaucucagaaacugacuucaucccaagauuuuuaaaccgaccugaaaccaaggaaaauacagccacuuuucuaagacuugcaguauuggagagaaacugauaacuaauauggcaacuauacugcuugcuuucccuuucuuaucccagcacuuguuuagccagaucaucaaaaauauggcuuagcacaaaaguuaguuauggagaacuuuagacugccuuaaaacuguucaguucaauauauguagggaccaugaagcauccuggaaguaaacguaaccuuuuuucuuuaaacuucuccauccgacuucauucuugcugaccagaccucauucacacaagugugucaagcaaacauuuuuguuuuuuuuuugaugagacaguggugggaaacauuuauuuaauacaaugugauaagcugcguucuaaaggcuuuucagauauuaacuuauuuaaucuucagugucccauucaugguagguauagguugagcauccaaauccaaaaugcuccaaaaucugaaacuuuuugaguaccaacaugacacacaaaggaaaugcucauuuaagcauuucagaauucacaauuuaagauuugggaaacuaaaucagugaguauaaugcagacacucugaaauucgaaaaauucugaaauaauucugcucccaagcauuuuggaugagagaugugcaaccuguacuauuauuaucuuuuuauuuuuuuuuaacagaugaggaaauggaaacagagugaguuuacguuuauauaacuugcuguaaguuauacagguaguagguggaagagccaggauacaaagccaggcaaucugacucagaguccaggguguucuaagcacagggaauagugugugcacaaacuuccucaaaggccugguauaucugaggaaggcugaagaguucaguguuacuggcucuaagacaugucagguuuacgggggagucaggauggaguggugagugggaaguugaagcuggugaaguagauugggugaucagaaugugaagacugucuuucauaaaaagugaaaccccguuuuuauauaucccugaauuaaaauuuuaaaaaucucucaucuucaaguuagggaaauguucuuggcuaaacaaggaucuguuuuuagggacgaggugagggacaggaaggauuauccuuucuagaggagaugggucauggugaggagaagauuguuuuggggaggcuuccugggagcaagacccacagguacucaguucaccccuugguggggugcaaacguguuacccaauagcugucucucacaugcgcccacaugcacaaagugggucaugcugagaucaggcaggagaggcuauuauuuaucuuguuucaagaguuccucaaaguagggaagauuaaaaagaaagaagaguuucucauuuaggcauuacucuugcgacuuuccuucauccauguuccccgggggauuccuugaacuccuuugccacugcuucaggcaaauuuaggggaguucugcuuuauucuacaguggauggucccaugcgagguuuauguguggggcaguauuaggaagcucaaucuugaggccaagugggaguggauuagagaguagaagggauugauuagagacaggaagcugaugcuccagagagggugagaagaaacagagaccuggauuuccaccauggccaugucccaggaugaggagaagggucuugauuaugaggacacuuuggagguggaauuauaggccuugguaaaucagauguaguggggaagggagagagaagaccccaagggacaacuaguuaauuuagaacugauuaugaggaagaauuuugccuacugucacuuucagugugcccaucuaaugccagugagcuugcccuggcccccacagggcugauacaucauauguagcuauggguugaaucuauccuuucaguuuccuuuuuauuuucccucacuucgucuggagcucacuuccauggcuugauacugucuuccuuuaguuucugcuuucuccuuuucauaaagugaaccagaauuuagcuaacacuuaucucacagugaucugaauggugucauuuccacaaauccucauagugucucuaagauccugggugucuuuauguuuugccgaugauagaauuguuuuuccuuuaacaauuuggauauugcaaacuaaaauucuguuuaacaaaguuuguuuugaccagcuauacucuuuuuuuuuccuuagacuucuacauaaucaucuuguuuuuguauaugauuuguuucuucuacauaagcuuuuuaacaaauggccugcugaauuugcaguguuauuauugacaaagagagauuucugaccaaagcaaagggauggaguaaugagaauucuuagcaaggauuuaaaaaaauacuauagcgauucaaaccugaaucugaucgauauuccuaaaucuaacacacauuuuuuaaaagaaaucccucaccuuucuaucaauagaaggguuuuguugagcucucucuccacuuaucccagaugauagaaagugaagguuagauuugccuggaaggaggaauauuuagcacagaccuuuuagaauauugacauucagaaccuaucuuucucuuauucacauuaucagguaaagccagagaagauaaaauuuuucuuaauuuugcuaggaaauuuaaauauaucccauuaaacauuuuugaacccuauucagaacccccuaauuuguuuucccacugcugaucuuuugccauuuccauaggaagggcugggucagugagcaucaugcuucucucccugugcuuucuguugauagagcaagggcuugaggagagccacugcaaacucccaugcucacaacagccucagcauacucuacgaaagaaggcaagagaguuuaacgugaucuuggaaagauuacucuaaaaaugguugaacucuaggcuauucuucgugcuaaugaaaaauaauuucucgagcauuugaugagcuccuauuauguugaucaaucuucaaagucugggaaaugagcuucagaggacugguacuucucagaauucuggauucaugaaggcucgugcuggagagcaucaggaguugccagcaucuaggagugugguguauucaaaacaaucuugacuccaggcaguccugcauucagguuccugcucugcuucuuuacugcuugccacuuagaaccaugcugaagucccguugagagacuuacccauaucuuaaagcccugauaaaaauacugaugugaggccaaaugguacaucccaggaugaacauaugaaauugcuguuuuauagguuaaaacugguuuaauaccagcaauuucauauuauuugauguaaaacauauucagaggagaggggcugcuaccauacuacuccuuauucuguuuucuggggagagauccuuuaggccugguucaugguaguuaacaucuuguaguuugggaagcaccuguaaaaucucucugcagcuauacuacucggcuuuauucuggaaauagcugacauugugccugucagcuaggaauucauguuccugagucuagucacccucagggacaaaaacacaaaauuuuaucuguucugauauguauauggguacauugagaaauuaauaacaauugauaacauuuuaaacuuaauuagaaugaagggaauuagcaccuauuuaguuaugaauaaucacagcaauguauucgcauuuucauuaguaaaacuuaauagcuuucaucucucucaaaauacgguuuuaguucuguguggaauaaugugguuucaggagaaauauuuaccuaaauuuuuuauucuguccuuauaaaacugcaaauugacccugauuuuuaaaaaauucaagacaaaggcauuuugguguagguguuugguuuuuaucacaaaagcagacccaucagaaugcuuaggugaaacuugucagugcucuguuuuaugcuuggcucugucauuuccaccacagagugcaccguggaaccagggagccccuuagcagaccuagaccccacggugggggcaccugcauucagaaauacuuacauggggcuaggugcaguggcucccaccuguagucccagcacuuugggaggccgaggcgauaucagccugggcaacacaacaaaaacccaucucuaccaaaaauacuaaaauuagcuggucgugguggugugcgccuauggucccagcuacuugggaggcugaggcuauaggaucacuugagcccaggagguaaagauugcagugagccaagauugcgccacugcacugcaauacagccugggugacagagcaagaccuccaucucaaaaaaacaaaacaaacagacaaaaagaaauaauuuacaugggacacuugauacuugacaacuucaagggccaacuuacugaggaaaaucaacucuuccauuccaaggaccauuuauuugguuauuuauuuauuuuuuucguagauaagguguauuuucaugcaaaaugcuugcuugcuuuuugcacagaauuaauauuucuccguucccaggaaauuuuaagcuuuucaacaauuuguacuuuuuuaaaaaaauaauuaaggcacgcagaaucgucugauagcuuguuaagaaaauuaaguagugacacuaaucucauauuuuaauauugguauuagagucaagcaucauagauacaguagaaaaauauaaauggaaugugucaacagacacacaacagcaaaggguauuugacauuccaacaucuuguaacacauaagagguaggauauucaauuccuucauguagaaaacaguaauuagaugccauagccguaaugaaaaccuuagauacugacaaaauguaaugaaaguauauuuuuaagacuauuaacugcaagcaauagaaaaggcaauuaaaugaaauaacuuccaauauuucuaacuaaaaggcuacucuccaagccuugauuguauguccacuuucaacaaauaugauacacaaaagucuggauuagcucaaaaggccuccugaagccucuuggcaggaagccagugauuccagaggaaugccuuaucuucuuugucauguccuuccauggaauauuggagcauccugggcucugcacauuucucacauacaagucaauacgucuuuucuuuccagggaaaauggguaguuucuucaccauugccagucagaaguuggcaucuuuucaucuugaagugucacauguccuuucuugucuucucauccuacacugguguagugggucacugaaauuauaaugucugaagaaacguaagaaauuccuguuucuucugaaaugauguucugaaauaucauuuuggcucucuuagccauuccugggcagaccuggcacucggacgcuuuugcuuggagcaggagacauggagaagugaaacuuucuucuuugcaagcaucagauaccuuaaugaguuauuuuccauuuuguuugucccucgagugggccuuuuaguuaaguuuguucaccuuuccccauacauuucucaggaauuagaagaaaaugcaaaauuuggaaauccuuaaauucaacaacuuuuaauuauaccuuaaaaaugucauguuuauuacauauuuggagaacagagcaguguccuuacuguaucugagaaaguaacuuuaauugagguuauauggaccuuaggugaucaagaacaggagggccacaggcaggaaacuaggaaggaugcaguuaccauuagagcaccccaguucuuucccauccugcccccacgugaaccccauaacauaccucucuuucaugcacagugcuggguacguggguccacucaguuaacacuagacaaucugacagauggauuuaguuugcugauuaauacuggacuuuaaacaguuuguggauuuaucccuuuugaguaacauuggcgagguaggcagaaucugcacuccugccguggaugugauggacauuagaaagcuuuuggcugacuucccuuucaccguaccuuuaguugcuucuccugaaguccagagaaaccuaggaaguuuguguuuucucuuucucugucauucucuccucauguaagcagugugucuuuauaggcacaguuaccucuuccucucuaauuuugucucccgcucaaaaugaccacccaucuuuguuggggacaguguaucaauguagauaagaguuacaaaaguauaauaauaacuaacauuuguauagugucuuuuauaguuacacguaguacauuaugucauuugauguucauaguaaacuugugugugguacauauuaugauuauacccaugugacagguuaugaaauugaauuucagagagguucaacagucuucaaaaguuauagaacauucagguugucagaaucagagcacauggcauuucauuuggauugugcuguuuuaguagucauuuuucuaauuugagacuaugacuuggauuuguuuacaugguauuaagauuuaccuggacuuccuucuuggugguacagaaaaucuguuaaacuauuuaauuagucuguuuugcuuuggguuaccuuguucaauaacaaaauauuugcaucuguuuuaguguguuuaacccauucaccaacuguaauugagagucagaaaucguuauaggcaggaguuaccacugagugauacccugugucgcuugcuucucucauuugaaagugucccaucagacgucauuuaaaggaaauauuaccuuauuguugaguaaaugcuuuccuucucauuuuauucucuccaaauuguaauuccuccaacuuuguuauuuuauuuucaacauugcuuugaguauuuucgguucuucacauuuuuguauacauuuuagaaucaucuuguuaauuucuacacacacacacacacacacacacacacacacacacacacacugcuguuaaugauugagauugugggaauauauugcucuuccuaaauuauauuguuggcacccaagaagccugaagaacuccugaaauaaaaaagcccaaggcagagcuucuagggucuagcaucugggaacucacugauucucuagcaacaguaaugaaauuggaugugacuguaggcgaagcucaugccagguuuuagcuuagcaguggcccacuaccagcuccaccugucuaacuaaugugaacucucaucucuguucuuuaugaauuaaauugcuuacucuuuagaauacguagcaagcaggugguauguuccuguugagagguuuacacauuaacacagugaggcaaagauucugcuauagcuaaagaugguucucucuucccaguucucuucacuuaccaaacagggccacuaccuccgaggugagcucaugauucagauggaaaaaaauuaguuuuuucucagcaucuaaugcagccuguuguuugugcuucuacagacauuaaagugaauaagaccuuaaaucugcugggaaacugcuuaccaccauuucccacuguauuauauguuuguaauuaaaaacccaugagaaauaaaaguacacgugaacauacacacauguggaaaauuaaauacuugugacguuuugaugagucauauguguauuugugcuguaagaacaaguauuucuucaugaagccccagggauuuagguuuuucugggcagaggauuuuuaccuagcucuuguaauuuacaaagaaagcuuucacuaugacaaggcaaguuuagaugagugguuccugcugcauaccuuugguaaacgaagaauaguuuguauugauuuauuuauugcaauccuuguagaaauuuuuaucagauggauacuuugaaaaaauacaauaauaauauuucacagguuauuaauucauagaaauuaaggauaaauaacaaaguugagauggugaaagggucauugcguacaaauggaaaccugcucuuuggccuguacgucggcuaaguuacuuacuuugguuucuucaccuguucagccuugcuggugcuguggguuucuacauacauuauugcauuuggauuuacgcccuuuauuaacaucauauguagauagagaacccaguuggggauuuucccaaggugacaucuccgcccaugacucauccugcuagaugaugggugacccuccuuccagauguaaacacaggucagccuugccaggucugauaagagacuaccuauacggccaaagcaaagaaucuucccucauucuaccucacaaaagcccuucccccugugcucuugcccuagagauuaacuguuuucucucuggucucugucaaaaacucaguggggagaaaugauauuuaagaaugcagugcauauguccacuugaguauuuaaguuagauucccgugucagguuaggccaccaagaaauuaccuauuuuagcuuccauaacuuaacccuuuauaaggugccuucauugaguuucauuucauuacugugucuuuuuagugacaguauauacaagcaccauuauauaaauagcauuguugccauuuucccaagucuacuguuaaaagauuggcugcugcgucauuaaauaucccaggugauaaaaucuuuuuaauaauuaugaagaaaaauuugugucuuagaaaaugggaaaagauacuauuuucuuucauuaauucuagcacaaauuuaacaguucugucaaucuugagcauaggcagagacugcauuaacaguuuuuguaacugucuacaauggaaaucauauuaccauuuuaacagaaauuuaaaaaauauuauuuaugcucaucaacaacuuuguaaucaggauauuaauaguuguuagaccuaccuuuagauauuaguauuuaaugcauuauuuuaaaagcauauuuguuuuuccuuuccggucagggaaccaaaaaggaaaaagaaaaaaaaaaagaaagaaaaacaaguuuauuuuucuaauauaauuauuuguuuguaaucuucuguguuuauuuuaugcauuugaaaacauaguucugaguagggcuucacaaaguagccagagaggucccuggcacauacuccaacagccuuccuggggcauguguacuuccuggcagccucccuccugguucagauguuuaccugcauuuucuuuucuggagggccucuuccuucccugaucugagcucucuuaauaccuugcauuaugaucagccaugucugucucucuuacuaguaugugagcuauuugagagaagggacucucucauuauuuuauuuuuauucuuagcaccuaggaaugugccuuauuuuuagugagccauuaguaauuaaaugccacuuuuuuuaaaccccaucccauucuaguauugcucuuccucguggcauugauugacagguuguucuuggcauuuuggcucagaguucacugcuguagaaugcucaucaggcaaggaaugaugauuuuuuuuuuucauuggauuuucucaaugcuaacuuuaaauuuuuuuaagucagccuuuuggauguuguugugccuuugaugaagcaguccagguauuaggaacauacuuuccuccuucuucagguuguaaucauugguaguuagcugucuuuuguuugaaauuuggcuauuuauuucaacauugguagucuuaggaaagcuagagaguuuucuuauaagggccuguauaauuuccaaguucacacuugauugaaggcagcaugguaucaguggagagaaaacucuucuacauuugaacaauuggaucuuauuauuagugcugucccuuagagguggcuuaguaugaugggaaggacaggaauaguaaugaauuccaaaaagaccugauuaguuuuuuucuuaauacagccccaaaccugagaaugaaauuauuuauuugauugaaacaacaugucuuuggaaucaguggugauuauuaaaaacaguaaaagugcaauuuuuuucuuauaucacauuugccuuaaauaugagauguagguaagucagaugaaauuuuaugaccaaauuuuuaucauuucacuuuacaaaguguucguucucucaagucuuucuuacaucauauuuacugaacugaagaauaaauguuggagaugguguuuucuuccuaacucacuuggucagcuguuuuucauuuuuguuuucagcauaucaguugaauaguucugacuauacaugggcuggcugauauuuaaggaauuuuuaaaaauuggaaggacucuuaguuuuuuauauguaguauuucagaaauuauuaaauauauaauccaugaaaaauacagagaaacacauaaagaaguacuaaauaaaucccauuacccagaguuauacaucacuaacauuuuaguauguauuuucucaguguuccuuuuuucuaggcauacauaucugugugagugacacaucaucacaagauuuagcgguuuaaaccagugauaacuauuuagcucaugauucuguggguuaucaauuuaggcuaggcuuggcugagggguucuucuggucuaagcuaugcugccucaugcaucuguggucagcugcagaauagcuugucugaucuuggcuggguucucucacagguuuauggccuguggucagugugaucucucaucuccaacaggguaacuugggcuuguucacaccccagagucugagguucuuagagagaaagcagaaguguucaagcccucuugaacgaaggacuaugaaucuguguaccauuacuucugcuauauucuuuuggccagugcaagcuaagccacagucuaggccagauucaaagggugggaaauaaacuucaguccuugauaggaggaucuacaaagucguaugcacaggauguggaaacggggaggagugaagauuuuugggcaguuuggaaauuuaccacaguguacacguguguuuacauauguguacguagaugaaaagugagagcauauacauucugcauuuuuaucaccagacaugcuccaaauccaaguuacuaauccaacccuguggauauauuggggaaaguaaguaaaucuuaaaugggaagugccucaacaaguaucuagaacaauaccuuccauucaaucaauggaaggcuuaaaaaaaaaaaaggaaauguaauuucuuuaggccacugcuugaauucuauugguguuacuuccugguuggcuuuauuuccuugcucauguuuuucuauguuuacuuccugguugguuuuauuucuucacucauuuuuucccaugcuuauuuucugguugguuuuauuuccuuuucuuuccauguuuauucuuuugguugauggucuggagcaccuauguuguguuagucuauuuucgcauugcuaugaagaacuaccugagacuggguaauuuauaaagagaagagguuuaauugacuuaugguucugcaggcuguauaggaagcauggauggggaggccucagaaaaccuacaaucauggcagaaggcaaaggggaagcagcucaucuuauauggucugagcaggaggaagagauagcagugggagaugccacacacacacacacacacacacacacucucucucucucucucucuuaaacagccagauccugugagaacucuaucacaagacagcacuagggagauggugcuaaaccauuagaaaccacccccgugauccagucaccucccaccaggccccaccuccaauauuggggauuccaauucaacaugagcuuuggguggggacacagagccaaaccauaucaccugucaugggagagcacugcucuagacuacuucuaaacuguucugagaucuuggaaaagucacuugacuuugucaagaguaucaguagauguuacaucaucuauuuagucaaaauaaaaacuaccucacaaaauuauugggagaauuuaauuaccucaugaauauggacauaugcuggaaacuagauguguuaucguuccuaggaauuauuuaugcuuuuauggaaugucuguaacguuuuuuuacuuaacauuuuggccauguccccagcaucucuaacuggcccuaccauuuuuuaaaaugacguguauauuuuuuuaagccacuguugguucauuucugcuuaguucauauuaaagaaaauucaaguuuuacagccuuagcuuacacacuaaucuucagaacaccauagccauuucuuuaaucugauggaugcccucgcaugaugccugucuucucugaucagaaaugacauucuuaacaucaauagauucuuagacuuuucugacaggaaauauuuuugaggauauguaaucaguuaugggguaugcuugucaauacauuuuuccugcaaaaauaaaucagaaauccuaucaaaauagcauuaugaaagaauccauuucccuuaauacuccucaugaaauggucaugccugaaguuucugagaauuuuuauuuagaugaagguuguguauuuaauuuauauacuggccauuuuucuaaccagccaaucugcauaaauuucauauccuaagcaggaagaaaaugguugugaucuggagccagccucuuccuuauaaagccugcaucaccuuccuuuucccuuggcuagccucuucuacuuuccagacccugugaguuucaccauaaaccuucuuuauucccuuccgcuacccacauacaugcacaccuagccaaagaaagagaaaccaaagaaacagaaccuguagggauaaauagggauaucacucuacagugccccuuugcuucucuuugcccuuuucuggacaggagcagauagaauucauuccucuuccauuuugaaaguuugucugugccuauucacuuacccacucauuuauccauccauucauucauucacuguucaucugucaggaacaguguuacagacaccgugcuggguucuguggauaaaaagacaaguucuggcacugauucguagaguuuacccugucauuaaagggaugguaacugaaagagucauguggccagggucuuaagagaguuguuaacaaaggcuuugggagcccuggggauggagaggagaccacauuaugccuuccuuccuggggacaauagccaugugccugaauuugacaagaguagagucggaggcuacuggagcgggugaggugaagggugggugccuggauuguuuuccuggcagugauuuggggcuggacugauccuugucagugagaagucagggugcugcccacucauccaugccaaugacucagauaccauaggaaagugguugacucaccugagcugaaggucucaguauguucuucauuuccuagaugaagccgguuaggauuugcugagagucugcucccaaugaggcugggccuccuuugugcuucauccuguuucauagcaccccuuugauuuagguguaauuucuuccacagaugaccaaacugaggcugacgaggguuauguaacacccccaagaucauccagcuaguaagaguaaucagcuuauaaugcaaauccccacacauuguccccuuggagggcaaacaauuuuuauucaacuuccaauuuuaacaaaauauacacuaaauaacuaauaucauaauaaaauacaaugcuuguaaugcugacaaugacuguuuuucaguuugacagagagggcaacaucugcaagaaaguucugccaagaugaagcugugugugucccuaauccacaucacucagggccacugucuguggccacacagguugugaauguggccuccuagaguuaguuguaaccuguaagaaguagcugucacaggcccaaucuuggagucaacaucagucugcaugcugugccuccacucauauuaauuacuacauccaagucacucucuuacuuuaaaagguuggauauauuuaaaggggaugaauggggguaaagucguaaacugcguaauuauuucaguauauguuauauacugucaccuagcuguuaaagauuucuacuucaaguauagugcaauuaaaucgggcuucuuacuguugugcuuugucaaauguuuacauaccuaccgacaccuaaagguacagaaaauuuucccaagcaacccaguaaucacuggggaaugauuucaggaaggaaagaagggaaauauccuuuuguucugucaggugugugggacacuagaugacagagaugguuagagacccuuacgaagauguuugcugggagggggcuuuccccuuuguccaaaucaugagcauucuuguccgcaguuccuuucuucagacccucaucucccacuauacugucgcacuaagcuccaccagccccuugucuauggccauacagaccuggaucaccugucuucuacaucuaaaccccucaguggcuuccuagguucacagaauaacauuuagauucccuaggauggcauaagaacuguucucccccacccccagugcccugaccccugcuccccgggccauuucucuaguuucuccuacuuugcacaccauagcaagaccucuugcauuccccacaacagaauggcuguuuccugcuucugggccuuuggucaugccugucacucugucuguccuugauuguguucuuccccuaauucugacugcugcaagcccaggaaugaggaguccugcuguagauggcaugcuagaauguguuccaucagucuucucucacgccaccugugagauggcuucauggcacauaccuguguaggccuguuccaggaaacaguaauauagccuuagugguuuuguguauuugacucuccaacaucagauguggugcccacuggcuagcuacaaaugacuguugaggaaauuagugaaugaaugacucucugggaaugucuuuguuugguuucuagaagaaaaagauaagcauaacacucuguacacuacaagguguuuuagcuuuuuugaaauucacgggggaaacaaaagcaaagccucugauugacuagugauucuggaugaugauaaacuguauuucccaggaguguucuaaauauccaugcaagaaaagacugggguuuaaugagucccugcuuucuguagguacagaugacaugucaggcuaauuuuggucccuuggggauuaugaaggccuggaccuucccaugagcuugguucagggccuucccagcaggucagagcucaugacaucaaacaaaucagaguugauaccugagcuuuugaggcugguauaaagaagauccagucuugagagcagacuuuggcauuagauguuggcugcagucucuuccuaguagguacaggcuuuguaggaguuccugaaaggggaacggggacuauagccuuaucuugaaaaucaaaacaaacaacccaaaugacaacaaacuaacauuucuagagcacuuaauaugugccaaucacucugcagaguauuucugagagaagucauuuauucuuaagucuuguuuccuuagcaugauguauauacccugaggccuacacaugguuuuuuaggaugccaggaauauguguggaaggagaagagggggagggagaaaaugaaauaaagauggagucuacaauucaugcccauauucuuagguaaggacugcaacccagcuguugucaguaugagcugguaauugaacuugagucuuaauucuuaauuuaaaaauaaaaugaauugucauuuguguuaguuuuucuagucuaaaacuauuaauacagcucuucuacaggucuuaaaaauuacuuggguguauuuagggauugagcaaaugaguaaauggguuuauauuguagaagccaagguuuucacugaaaaaggaugaagauacaaauauggaauagagggaggcaagaaagaaccugcagggaugaauagggauaucacucugaacuggugauuuccaauauauguguguuuguggcaaauugauauacgcauguguguauuuaugcacauauaugugcacauguuaaaugcauguauuucauuguuccaucuacuggaaagguugagaaucaaagauacuccucuaauaagagcauaccuaagcaccuguaucugaguuucuaaugucacugccccucuaaacugaaccauacuccuggaauggcuaauuucaggacuggugcaagaugauccugaaacaucuuaucagacaagauaguaaagaacugcuguuaaaaaaaaaagaaaagaaaaagaaagaaagaaagaucacaagaaccaguacgaaggggcucuuauuggucaaaucugggacaguuugaacaccaaaauaauaaaguaaaguaugaacuauaaacaacuggggaggaggaauucaucagcccauaaugacaauggguggauagaaggaaagauggauggauggauugauggauggaugguuggauggauggaugggugcagggaaauauggaagacuccugcuuaccaaaugucaacuaaguaauaaauguggaugggugauagagcaggaaaaaucagcauacaccaccauugcaguaaagauuaugcacaaaacucaacggacacuaauuccaaacagagauuuaagaggaacaggacauuuacauacugaugaaauugucuuucacagauugcuuuaguauaauagaaaaauaguaauuaaguggagaaauugaacuauacuuugaucaggaucaaaauuaacauuaucauugagggguaagcaaacaucaugugccuucagaauauccugagaacaagagaacaucaccuauuugggauucuggccaaaaauguauaaccugaaucuaaucaugaggaaacuuaagacacaugcuuuauuaaaaagcaggaagaggaagaauuguauccuuccaaaguagcacuaccauaaacaaagacagaggaaaugguccugauuaaagaagccuaaagagguguggcaacuaaaugcaauacuugacucuagacuggauucugugcuugggaguuugaggguagggaaggugaauaccauaauggccauuauuggaucauuugaccaacuggaguauagauggagauuaaaguauccuaucaguguucaguguccugaaguugauauauuugcauauacacauacacguguguauauauauacauacauauuguuuucucucucucuuuguauaugcauacacacacaaaaccaauggaugaaccuggguaaagaguguuaguauaaacaaguaguguuuauacuauuugucuucuugcaacuuuucuguaaguuugaaauuauucuucaauauuaaguuaaaaauuuuuuuuuuaaaucuuggccaaauaaaugauuguuuuucaaaugaauauuuuuuauuuuacguccuuucuuuuccuguucucuuacuucuuuucuuccuuuuuugugucccuucuuuuagaaguccaaggcuugcgagaaggucauuuccgugggucaaacggucaucacgaagcaucggaacacccgguauuacaguugcagagugauggcugugacaucgcagaccuucuaugaggucauguuugaugauggcuccuuuagcagagacacauuuccugaggauaucgugguaaguaggcuuccuugagugccugcuacccagaguaauuuaaaaaaaaaaaccaaaguaacugagcccuucagaauuuuucuuuuggcuuuuugaguagcucauucacuugguucauagacuuuaucauucuaaauaauauccaggugaacuuagacugaucuucccacauucuuuuuuuggccaaacguuauuuggccaagaaauaagggagcagcccucacgaccuaaucaccucuuaaagguccaccuguuaauacuaucacauuggcaacaccugaauuuuggaugggaccuauucaaaccauagcagauaugaauccaccuauucuuuccuguuacaagaugugaacaaauuugaauucuuuuaugacuuucuuuucuuuaugcuuaacuagagaauguggcuuugauuaaucugacucgacaguguauuuaaaucuuuggauauuccacaugggaguaacaaaagucacacagaagaaaggcuguggcauuuaaguaguuucguuacuguggcggagacuagaacucugugugugugugugcgugcgcgugugugugugucuggcugucuuguuggucugucuccaucuccuccuuccucuguccccucagcaaacaccuuggggcucauucugaggaacuagugaacgugugccaggguaaugacugacuuuguuucagggcuugcuuuuuagaaggguguuuucacaagaagagcacuuuccacagaggguuuuuuuugacaccgaaaucaaaucucgugacugagaggagagugaguuagucuggugcugauccuguuaucccuucuccuuucggggggugugugaguuuggggagcugacccuuaauaauguagucaucacuucugccucauucugggucucuguugaugcuuugcuuuuguuuguauuuggaaagauauuuucagcgacuuuuuaauagucauaauuguguauuaugugcacuugaaaauuaaauguaaccuuuugaaauugcuaaagacaguuucuaggauuuuggucuccagguguugaagaaacauugauucaguuaguuuuguuauacuuaccucucucuaugcugguaagaauggcaaguauauaaacaaaagugaccuuauuugaaagauuuuaaagcaaaugaauguaaguuauuuaaaaaucccagaacagugaauuguguuucuuaccaggguucuagcuggaguuucccuuuacugcauugccacuguuauucauaaacagcaucccuuaggugacauacuccccuuguuagaauuagucaucccuucaagcacucaaucugcauucacugaauaccugcugugugucacuuacuuaccacacuaggugcuggaaacauaaagagaaagaagauguaauccuugcucagucuuggugggagguaggcggguaaauggaugcuuucucuaccguggacccaugucuagaacccaugugguucuauacuugaacuacaagcaaucuaccaccuguuggggcuggaagaauaaguaacacuuacugacauuuaccauguuccaggcacugcuccaagaacuggaaccaugaacucaguucauccucauaacccuacacacuaggcacuauaauuuuucacauuuugcuguugaggaaacugaggcacaacauggugaauaauugucucaaggucacacauaauuaagaaguuucagaaacaguauuugauuacauguaauccgucucuagaacuuccacucuuaacccuggggaagaaaggacauuuaaagcaauaggagaagggauaugcaggagcaagagaggcaugaaaagccauugguagaaugaggccccuggacuuucaccagcccugugcaggcuacauaguuguuucagaauuagccuucucuugugaagacugugaauauugagcuggcaaaagacagaagaccuuuuggugaggaacacugugguggugggaugaaagacuucugagcacuaauuucaaaaccugagcacaguuaaacagguaaaacagugaggucuuuagccaugauaggaauuaaugaacccuaaauucucuuuuacaucauaagccuauacacaccaugccaguuugaggcuuuccuggaaugucuuuacauuggaaaagaaugucugugauccuguaauguuugaaauccugcaagucuuuccuuugacacccuccauuuccuuccucugugaaccagaacaaauaugauuuuaaguacacuugaguguugugagaagaacacagaagcuaacccgcagaagaguuuucuggagcgcaugccauuuaaaucaaugagaaugaaaaagcaaaacucuuuacagcuugguuagcugucacuuagcauuuuugauaaggauuugaggcuuaacagcaguugcauaugcccauguggccacaacuguugcccuggaggggggcagguaccauggaguggcaugaauucacauagauuggaaaggacgcaucuaucuaaaugugggugaauaguaaugucuuuuuuuucuuuuuucuuuuuugagacagggccucauuuugucgccuaggcuggagggcaguggugugaucacagcucacugcagccuugugcuccugggcuccggugauccucucgccucagccucuugaguagcugggaccacagcccugugccaccaugccuggcuaauuuuuuuuuuuuuuuaauuuuuuuguagagauggugucgaacugcguugcccgggcuggucucaaacucuugggcucaagugauccucccgccucggcaucccaaagugcugggauuacaguugugagccacugccauuggccuaauaacuucuucaggaaaaaaacaaaacaaaaacugaauucaucuuugugcaggucuucucuauuuugucugaucuuuccuccuuuugugcuccccacugcaauauccuaaucucuugccuucuugguuccccguuccaggcuccuaguaggaauaauucaaucguguuguguuucaaguuccauauacuuucuaacagugucaccguuguuagcugcuguagccucuucccucucuuacuuuggugaugaaugaggcuuccucagcucacuauugcugacucuauaggggaaguuuuuuuccccuuauaauauuguauuaggcaggguucuccagagaagcggaaccaauaggagauacacuuguagaaagagaugauaaggaauuggcucugugauuauggaggcugagaagucccaagauauuuuuguagagauggggucucaccauguugcccaggcuggucuugaacucccgggcucaacuuaaucuucugccucagccucccaaagugcugggauuacaggcaugagccacggugcccagccccacacaccauuauuuaagucauggauuuaauugcuaagaucaucccacuuccacuuuugauaauucaucuacaucagaacuguugucugggagauggguacccugcucaguacccuaauggaaaguuucaucaggacguaaaaaaaaaauguaaucagguuuguuucugucucaguaucuugaagaucguggcagaauaauuauauggugaaaacacuaacuacauuucacauuccucagagaaaucuuguuuucauuaggugauauaccuguagcaugagcaacuggugguagaaaaugauguuuuucuucuguuuguccaaaaacucucuaauccacacaaugugcauaucagaugugagugccacugggaagaauuauucaucaaauuauucaucaaauguagugugaccccaauguuacuggcuacugaagaacuaguucucuaagccucagguacugguuaacuagaacugcuuuaaggguacagugcaauuucaguuuccuaugaaaaucaaauuuaggauaucaaguuuaaucaucccaagcuauuuaucuauguaugacacaaauagagucccuuauggagccugaugcuuuaguaaagaaaguuacauucccauauuuauagaguugaugauuacaaaucauuucauaaacccaacagaugagaauccuuuaaugcaggcuggccuauccauguuugagaauuuuggcaggcguuaaaaaugcuuacguuagcguuaugugacuggagagagcauuuggagcaguaaggagaaacgcucuuugaacuaucaggaaaugucuuucccuaccuagguacuuuauuucugugcuagccagaaaaaaugugcaaaaaauucuuucucaacaaugcaccugcaaaauguguguaucagcccaguuaaacuccacaugcaaucuguagcugucaagggaaguaauaaaagguguauuauuacacaccuccaucugucagucuaugaaauugggacacacuucugaugaauuuuuuugccuuccacuauuuugaugggcaugaaaguugcccaccugaaaguacucaaugagcauaaagauuccagggucucuguuagccucugccaaaaccugggauccucuagcaugcaccuguuuacaguagagugaugacugcuuccuuuccucugaacuuugagcucacuuugagggaggagaaugguacgguggacacuugaguucucacuuaacauucaccacugggcaugagaagagaaacaggaccauuuagaaauuugauagcaggaguccaucacugaaauuuccaugaggacuggcuacauuuuucagcuuugguugaaaugugaaagaagcaugaaaacaauacucuucaagauucugggggugaguaguuauggccuuuaguuuugagggcugugcaaugcaaacugagguucuugcagccaauguuuuuuucucacauaaaggcaguuugcuuaaauuuuccagccccaguuuuuuuccccuacuaauuugaaaggagcaaauaaacuaaaugccugacauauaguaggaaaaguccaauuuuuuagaauauuaacuuuaguauguagaacuuuuuuuuucuuuuuccuucccaucuaguuuauacuaaccuuuucuggucuugaaauuuggaguuagaagauguguccucagaacuucaugccuacuugucagauuagaugagaaccuguacuugugagauuuugcuggguccauuuaucauucccacuugcuauaagguagucccagcaucuuuuagacuuuauaauagccuaguucccuacauuuaugcuuguguuuucugaguguauuuuuucaguguuauuucaguggcuuucuguaacaaacccugcuccagaguaaguucacacucauuucacagacguguuacuugccaagucgcacaaaagcuccucaaaauacacggugacagagguagguccugauugcagguuaguccccuuguuccauugcuuauugccuuagaaguucugcucuuuguggcuuagugcagcugagguagaagacgcugugccugcucuaagggaaaacacagauccaguaggacaugguguaaaacccguuucaguguugagccccgcacaagcccucgcuuggcaagcauagguguaggagagaucuggguauuccagaggcaaaagaaaauauccaaguggguuugagaaacuagaacagaguuguucccagaaacguucucuacugugggaucccgggaaacauuguuggaucccucuugccuccuagauuuugagguguccuagauguucaggucagguagccaugcauauauggcauuggcagauaccccuugucagugagcucaccucagcuuuggaagcccugucccaucccagaccauuuguguuaugugugcuccagagggcugcccuucuccucuucccucucccccucccugccaggaaguucugguucuuuuggaaucaguggacauuugccagagaaggcuuuggaaacuuucuuugguuuagaggucugcaggcauggcccacauggccuuucacucuuuaggguucucucgcuuuucuaucuugacuguggaguugggaauccgugagaugaaaggcuucaccaaauuccaguuaauuuuuaguuacgagggaaaccuuuuauacauguaaaagagugucuaaauuuacuuuucuaaauguuuaaauuuaucugacaaauuuuauuuauaaaucuaauauuugcauaaaaaaagaacaaacucauuuguuccuugauuaauguucacaugaugcauaaaucaaauccuaaccguuauguuuauguagccaaauuuccuuggacauuuuaacuaugauuauaaauuuaauauauacauuucucacaaaugucacaauuuuucuaggcauuuaaugcccauaacuuuaauaaaucagacauuaguuagcuugaauucuccuauuucagacauuuucaaaaacaguauguaaaccaguauaauauuuacagaacacagaugcaccuuuauaaacacaauuuacauaagaucgauagauaaguagauagacuuugcccaaucaaggggaaacaauauuaccauauuggcuaggagucuacuaagaagaaauaaucauagaaucugaaggccauuuuagaggcauagaaucugguuaugccuuugaagaauaaaccugcaguuauugggcaggggcuccuaauuaaggucagguuucauuugauucaucaacucuguaaaccuugugccuuucacugggguccugacuagucuuacaaguuucgugaacugucucugaaguccauggaggugguacuucccagguccuagaauuuuauuuccuuuuguguaacucauaugacuuuuuacauuacagccuuggacauaggaaugaaauguugaagccuuuacucaaguugcaguugcaucuuguuccuuuguuuuacgaauugugugugucucacugaccccaauucuguaggcaucauagcgacaguuuccacucaucacuggggauccucuggagaaaguaugucguugcccugaugucccaugcaggagauucaguaguugccacaaagacagacugacaguuacguuuuucuucaaauauauaccucccucacuugaggguauuucucuuauuuucugugcuggcaguuaucucaaggugauuggcauugggaacuuauucccaaaggacagguuccuggcacuuccuucccacuuuuuucuuuccaggagagacucagguauagcauuucaucuucagccuaaagaaucaaaauaacuaccuugaacuugagagcaguguuauuaauuuccaggacuucaucaucuuuucucagugcugaauauucaugggugagccugcuuaaacccaugggcagcgggcaccaugagccaaauccacuccauguuugggaguauccagugauguuguccguucugagcuauguguugaacacuguguuaggcaucaugggggauucagagauguguaaacacagauguaggaggagugacauggauguucuggaggcaaaauacaauacccaaggaaguuggaaagacuaagaaaaaagccauucccagaaacuuuuucagcuaugggaucuugggaagcaauuuuggaucuucgucggugucuacacuuugaggugcucuggaguuuugggccaaguggccaagacaguggcagacaucucucaucagugagcccaucucagcuuugggaagucacaucccaucccagcccacugauguauuaugcugcuccacacugaugcaguuauacucccucaccaccaccaggagcucaucugaaauauuuuacaagaaaaacacccaguggagguuauugacaguaaauucggggaaugaagcaauugugaugggccagaguguuuaaagaagucacguugaggaagagagaugucaacuggguuacugacuuagaagaguuuuuuguguauucuagauacaaguccuuuuucagacgcuuugcaauguuuacucccugucugcauaaugucccauuuuauaguaugaauauaacacauuuuguuuauccauucaccaguugauggacauuuggauuauuuccuguuuggggcuauuauaaauaauucugccgugaaauuugcuuucaaggcuuuguauggacauguguuuucauuucucuuggguaaagacuuaggagugagauuacuaaguuauaugguaaguguguguucaacuuuauaggaaacugccaaacuguuuuccaaaguggcugugccauuuuaucuucccaccagcaacauuugagguuacaguuucuucacauccucaccaacaccuguguugucagucuuuuggacaauaaccauuguaguggauguauaguguuauuucacgguauuguaauuuauguuucccuauugacuaaugauuugagcaucuuuucaagugcuuauuagccauucaucugucuucuacgaugaaaagccuauucaaaccaguaauauauuuuacauuuuauugaguuuucuuauauugaguugugggaauuuuuuaaauagucuguacauauccuuuaucagaucuuugauuuacaaacacuuucuccugguucgugucuuguuuugucacuuucuuaauaguguauaaagagcaaaaguuauacauuuugaugaagcccaauuugucaacuuuuucuuaauggaucaugugcuuuaaaauuugaguucaugaaguuucauguccuuucuagguaaagaauauuuuuuccucagagcucuagcaagcagcuccagggaaaacucaagccuucaauguuuuagcuuucuugugagauuuauuuauuuuuuaaauaaaucagaaaccucucuuucuauagauaugugaacuuucuuuaaacgaggagaucucuggcccugaaaaacuuugaaaccacugguucaggugaagucgaucauuaccugcuauuucacugccaugagagugagaagucugucgugagagaggguuaagggagucagggcauuggcgcaccugcugguccccugugccagccugagagcagaacuguugggaaaugucuccaguggccuuggcaggcuuacccaugaauguucagcaccaaauuaugaauauccaugacaucauaucuaaauguuaggguagggcugaaucaacuuccauuuaauacaaaauauaaacauuaugaaaauucuuuguuucuucuaauaacuaacguggccagaugucacuaucacuucacaucguaauaucagauugucaccauucauuauugacccuucgauuacucuuuaaaugaaaaugguacguuagcugccuaugaugcaaaauuuuacacuuuuaaaucguuucuugcuguaauuuuauuuuuaucucaaaucuagauaccaugacuaaguguaguauaaucagguugcuauaugcauguuucagaaaugucugaaauuuuccagagcugaccuuuccuguagcgcauuuguaagcacagcuuucugcauacaauuucugaaauauauggcgaauggcaagagcuuccugaggcgaguugucaacagggagcugccuguuuacaagccauuaucuuucaccucuauccaaccccaggugcuaacaccccaggauauagcacauaaauuggugacacaucccagaagauaugaggcccauaaaucaaugaagaguuuauguuccuuuucgaccaugggauuuaaauuauuuuggcaauagagugaacuuagauucuuauucgauagauauauccagaagaagucaguacuaucuacuuauugaugagcaacauuaccuucauuuuauuauuuccuuuuuguaccuuauuuaaaagaaguuaguuaauuuucaugggugagaaagaaccaguaauaaaucuugccuuuugcauuauuaaauaaauuauaauuuugaggucagaguaugugggcaaauggagaagaggaaugauagaagaaaaggcagagagaauggagugaguguauuuuuguccuucaguuucuaaucuucccuacagagaguguucuaugcuaagaagugagugaaaugcuuggaagcuauugccugcuauaaugcuuguugguuguguguguuucugcaaaucaauuucccucuaucaucuaauuuuuugccuuuuauaaaauggaggauauauuugaaagucuucugugcuuuagauguuuuauccaauaccauuauagaauuuuauauuuguauaauguuuaauuucuucuaaagguuaaaauaguacaauauguugaauaauguuauaugcauaguuuucagaucaaaguagauuuuuccacgaguaauuaaagcuggugugaucugugccugaaaaagaucucuuuugggccaggcacgguggcucacaccugaaaucccagcgcuuuggggcaccaaagcaggaggauuauuugaguccaggaguuugagaccagccugggcaacauagaaagaccucuucuuuacaaaaaaauuuaaaaaaauuuagccaggcauggugacguguaccuguaguccuagcuccuugggagacugaggcaggaggaacccuuaagcccaggaaguuugagguuacagugggcuaugaucacaccauugcauuccugccugggugacagagccaaacccugucucuaaaaaaaauaaaauaaaagaugccuuuuguagauuuaugacuaacaaaucagcaaaaagggaagggguaguuaaauuaugcauacuuccaguagcauaguuauauuuguagguuauguuuuuaaaacaugcuagauauuuacucuuucuagccuuuaauuaauaaucuaggccaggcgcaguggcugacaccuggaaucccagcaccuugggaguucgaggcaggcagauggcuugagcucaagaguuugauaccagccugggcaacauggcaaaaacccaucucuacaaaaaaauuucaaaaaauuagccaggcauggugguaugcaucuuuagucccagguacucaggaggcugaggugggaggaucacuugagccugggaggccgagguugcaaugagcugagauucugccgcugcucuccagucugggugacaggaccagacccugucuuaaaagaaaacaaaaaaauaaauaaucugacccaaugauugccuuauguguuauauuaucauucuuuuccccugaguaacagauaauauugaaucaucuaaagcagcuucuuugauuuacaccauaaaagaaagugacuggcacaaaacaagccaggcuuuaguccuuauguucuaagcagccaacaccugaagucauguugaaauacagacuauaagagaacuauggaaagaauguggaugugagugccauugauauuaagugagacucuaaaauuauauguauauauauuguaaagacugucucaucacacuauaacccuuagaccaggcugcaaguggccacacuagacccuguaacuuuuccuauuuuguucccuacaugaauuuugaaauaauuuauguaucgcauaugaauuuaauauuuuccuuacaguuuuaaaauguauuucaauacuaguaaaaccuuuuuucuauauuauuuaugcuggaacuuuaucucauaucauuauguaagcagugguaguugucuguaugagucugcagcaaccucaauucuugcugccucagaagacaauaauuugacucaggggcauaaggcagaaggagagacugaggcaaguuuuagagcaagaguuaaaguuaauuaaaaagcuuuagagcaguaaugaaaggaaggaaaggacacuuggaagagggccaagcaggugacuugagagaccacaugggcagcuucaccucuugacuugggaucuuauacacugacauacuucuggggcauugcauuccuucucgucacuccugagaucuuauccagaagcugcugcucaccaguuucagguguuucccauguauuaggagacagccuuucccuggugccagcugugaccaauuauuaguuuagcgagacaguuaacaaccugaccaucaccugauggucgcccuacacuccugguguauguggcaggggcugaggaggccucuuccgcccugcucauaccugacugacuauguacuguaacaacuaguuguguuuguacagggcuuuauguuuguuuugcuuuuuuguuguuggguuuuuuuguuuuuguuuuuuguuuugcaugaaauuaaaagggcaaaaauguaaccagugucuaagaguagguucccuccaggagaaaucuaaugaggaugaggaaauaguauguguggugcucaaguccucuuucuucuuagaguuggggacucauaaagauggggaaggcuaaugcuucccaugaaggcccuucuuuugguagauagggaauuccugcagggcuggccuugauaagccgcaucuggguaccugcauauggucauacauggauucucuagucaagaaauaccuuauccuuccaugaugguagccuuaugcccccaaguuuucuuacagugagcaccuacuacaugccacccaucaugcuggguucugggaaaaugauagcaguaaaauucgaaugguuuuugaucucauggaguuuacaaucuagugggagagagugacauacgcagcauguauaaaagaugugcuucgaauugagagaaguccugggaugacaggaauaugauccaguaagagcauguaacuagaaauaaacaucuuaucuagaugggugaucagugcgaccugaaugaagaucuguaaggugaguucacuaaacacagggcagagggaaggcaagugcagcugcuggaggagguaaaucaugagccuggagaagaaggaaagggccagacuggguggggccuugaggccaucuuauaggguugggguuuuauucuaaaagcaggaggaagcccccuuggacuaucuugagcagaagucaaagagauuuguuaugaaguagguuuuuuuuggcucuagugaaaaagaauuggaaaguccacagggguguccaaagaagagaauacagucauggguucuuaguuucuauuucugguuaggccaguagaaccccuuucucaucccucuuuucccauuaucacuagagagaaacuaaaaaggauggcuucaggcugcuaaaauacagacuauaagagacuauaaaagccuaaaaacaaaacaaaacagaacaacaacaacaacaacauaagguggguuggacaagcuugccugaauacugggaggccaguuaggagaauguugcaguaaaucagaggagaaaugaugguaauuuggacuaauuuaggaucugaaauauauuuagaagguaaaaucaagaguaccaggugauggauugauaaugggggccaaggaagaaagaugugucaaauauaacucccaggauucuggcuugcucagccaaguggaaggugacaccugucauugagauagggaacuucggaagaagcccagacuuccaggcccaggaugaugaguucagacuugguuguguuggaguuucuucccuucugcucuguuuuauacaccuagagcaguuaccauaauuuagggccauuccaagcccccugguuugcaaagcauaguuuuuguuguuauuagguuuuuuuuuuuucuuuuucuuuuacauagaauguaagggaugcugagugaaaagucccaugccucaaugugagaagagacaucucauguuuuagaagugacgugaccaggcacuucaucucuaaauggaugugucaucacacacacauaaaccccauuaacuaacuuucacccauuugauaaaauagucauuuugcccaagaaauucuucaguaugaaaauauauuuacccuuuauggggcuuccaucuugacacacgaacauuuaaauugagcauuuaucccucuugaauuuggcuguuuuaaaaauaaauaaauaaauugagcauaugauuacacauauguagacuuggccucacuauauagcugauucuaacgucucuuaauccuuagcucucuucaguacucauuuguguuguuuuguuuccaacccuuuauucugugcaugcagccuugugugcucuaccccggaacuuuuaaucccccuguuuccuuuuuaaaauuuucauagagauggggucuuucgcuauccaagcuguucuggaacuccuaaagcaauccuuccacuuuggccucccaaaaugcugggauuacaggugugagccaccacaaccagccuaguuucccuuucuauucaguggcuuugccuccccuccccugggcucccucaucaugaaccaguguagaggcugaugcaucugcuauguugcccugagaagagcugucauuuucugaaggagauggacuacaugacuuaccgagucuugaacaucucucauuuugagauucauuuaccuuuuuuaaagggaaagaauagaugacuaacuuugguagauaaaaugugugugguuagugguaauaauaauaauuagcaacuaauauuuaauaauuguagauguacaauguuuugcauaacauacccauggcuggcuaaagucccaagaaauacagaaggauuuaagaugaaaagugcauuccugcaccucccacaucuggaaaucaccgucucaccugcuucucauauauccucccaggauuuuaaaaaugcucauacaggcuguguguguguguguguguguacacacaauguauucauuugaaugcaccuggcaucauauuaacaugcuaaaagcuaggaauuacauccuguauauuguuaaugucauaguuacuguuaauuggaugauguuuaaaguuugcaagcaggcccaucuccuuuuauccuuuaucuuccucuaccuccuuaccuacuuguuuuaucacugaagucccacucccuccccucccagcuuacucuauaaaagcuagucucagcuguuccaguaccagcaucgcuuauacugaccccacuuucaggugcccacuuacccugggagccccaacacuuuggcauguuuugguuuccaguugccucuauacgcagaucuauaucagugggugucuguuucaaggaaaguaacugaggaugcuaacuaaccuuguuacuuuuuuaguagauugaaaaaagauaucacaauugaaauauuaauugaccaacuauucaguguucauuaagcaaaucagauguuagcaagaaucagccuucaaaugaagacuaauaucuggugugaaaagaauagaaaagcucuuacuucagagguucauuaacugucagaaaaagggcaugacauaauccuugaugugauucugaaccgggcauuccacaguugcgugcaucaguaaagcgaaauuuaccacccuccuuuuauguguuuuuaagccuugguggauuaaaagcucuuguuuggauaaaucuaacaaugguguguuaucuacauauuauuuucauucuccuugccugggaaucuacaaacagcaaaauucuucuuaauuucacauuaagaauauuuugauuugacagguuuucaacaacacaagaaucauuugggggaguuucugacuucccuuuaagcauaauaauguugacuaaauagauugauucauuauccacuccuuaaccaucuuagcuaucugucugucauuuuugacagaguagucucuguugaaaugcugguaguaauuacacauaucccugucugcauaagucaguguauaaugagcaugauugguuaacuuuaugcauuuacauuuaaucuaaaaggaaggacauguuaaacucacagagauagaagcuguagcuuaugugaaaaguauuucuagaauggcauugcucacauuuuuuuacugugcucaggaacacauuuccagcuuugaggauauccugaauuacuucauuuuugcauguauacucauuacuccucuuuuuguuuuuuuuuuguuuuuguuuuuguuuuuuuugugugacuaggucuugcuguguuguccagacuggucucaaacuauugggcucaagcgauacgcucaccucggccucccaaacucaaacuuugggaggccaaggugagagagauuacaggcaugagcuaccaugcccggccacuccucaguuucugaauaccaugagcugauauuuucugacaaaucauauucuuacagguucuuugguuggucgucaccuggcucugcuuuuuaauccccuaguuaaaauucuccccaaguguuacccauuugcucaaaaccuugcacugcugggcugugaaaugcaagguuaaauuauaggcagcucuuggggacuugugacugugcaagucauuucauuauucagcccuucccuuucaacuggggacauuggccuaggggaucucucaggucucuucccauucucguaggggagaacagccauaggugaucucuagucaucucugacuauaaacauuggaauguggccccuggccccaccauuccacucauccgcauauacauuucuuuccccuuucccggauuccuggcguggagcaccaccuguguggugaaugugacaggaguacaugcucagucagcuugggugaaguggagagugaaaaugcuguucauguggacacagccuccacacuguaagacguggcaugccacuuguaucagaauauuacauggagucaaagggagcuaagcuauucuuaggucucagcccaggagugagcaaucuuugacguauuuuuaggcaccgugaugucuuugcaguuguagcuuuaccacagaagcuuugugaaagcuuuuucuaccacaguggcugagacccacacaccuguugccuucauccuuucuaugcauuuugcuucaccccuuugcgcaucaccuggcugauugaguuaaaccagccucccucugggcccaccagagaauaagguggugcugcauuaacaggccuccuccucggguguugauccucaaaggaugcuccucuccuuugaccaaagaggaagcugacauuauagaguuaaaggugcguggccagaggguggcgggggagaaagcuaacuacgugucugcguuugauuuuuuuccugccauccuuuugcauauucucuaugcuuuggugaaggaggaggaucacuagaaugggacuugaaaauuuagaaaccguagucucagccuugcccauacuucuaaugagaguuggacaggccauugaauggcuggaaguucugagucgcugugucucaguucaggggugcugcguaggugagacaggcugauggggggcgcacuccccucucaccucaucccuuaacuguucauucuuacccccacucugcugugcucuauuuuucccccaacuccuccagaacucccacccacagccagacaucuccucugccauaccucuggugaggaguuuucagauccauucuggaacgcugcaaaugacaggagcucacucucaauuuuugcugcaauuguuaggaagcaagggcuucuuucugugaagucuaacugcugccucuucggaacacccaggagccuuccuaguucucgaucucuagagcaaaacugaauaaacacacucucuuucgcuuaaguuucuuaacauguuuguggagaggucucaagucccugcuaagucuucucaaauccaaacaauacaguccucauuucucagucauggggcaggaaugaaggauuuaauaaacagaaagugguuccugaaugcucuuccuccaggacacucugaggaugaaauuuucuuggacagugucccacugaagauguugcucucagguguggaaacacagugccccaaacacaaucuggcuagugcaagcaugacggcucuuuguuccuuugaucuggacauugaacacuuaccagugcagccaggaggaagguuaaaugaauuauuuaugcagccauuaaaaucauguuuucaaaggauauuuaaugaugcaauauaauaaauggaaaaaucaggcacaaaauuguauguacaguaagaucccaauuauguauaaaaauauaaauaugcaagggaaaaauccucaaaggaaauacaucaaaauguuacugauuaucuuuggagaguguaaucauaggugauuaugauuuucaacuuuaucaccuucuuauaguuuccauaugaacguguuuuauuuuuauaaucagaaaaaguuuuuuuaaaaaagaucuuaacccuucugagaacuacuuauauccuuacucuuuuccccuaauuuuccuuaucuagaucuuuacagauugcuuugucaaaauuucauuuuugaucucuagcucuuguggcaucuugaagcucucuggaauauaggaaccauauaguugccaauaaucugucaaaugcuucugcuuuacacuguuauuccuuauguaggaguucuuauacuuaauuuuuuuuaagucaaugccugcauuuuccaaugaagcaguuucuaugaaguaaaaaacuauaucuguuuaacucacuacucauuccuuuguucccuaaaacacgagaugcuugaaaauucccagguaagugagugacagccccacccaucuacuuauuagcccuguggccucaggcgagucacucuucucuaccagugcuggaggauguugacgcuugccugccuacccuaccaggcuguuucagauuccaaugaggauaacaaacacgauuguccucuguaguucuguguucuguuguagccuccuuucucucguagucaggguucuuggcuucucaguguuuccuucacuauuuuuaaucccaaagguggccucccaaggguuuugucuccucccuauccucuagguauauuccuguugaugggaauuaaaucuagaugugauucacucaauauucacuagcugccaggaauuggguuuugcuuuucuguucucuucucucauucucccugcaagauugcauuaauaucgccauuugauuaaugagaaaaccaggacauaagguuuauuaaugagaaaaccaggacauaaggugguugaguagcuuaugcacaguaauggguuuucuuugacugugaguggccugaccccagaucuuggaagcaguacaugcaucacuucagugugaagcguccuggguaggucaagcugugcucccagaaguagaacaaacauugcagagcagagccagagccuuggaaagccggacauauaaacacagggcagccuucucuccccugcgugccuauccuuagcuuuccuuucaucuuucuuuuuuuagcuuuuggaacugacauguauuuuuagaaaccacuacagagaaauucaccccaagccugucuuucuccauuuugcaacauaaauuuuuauugacauaguaaaauauuuuauuccccucauacauuuuagucccugccaacaacaauaaaaaaggggagaaaaucuuuccuauauagauggagcuuuuuuccccguguuugggggugagaaguuaaaguccugggguguucuacaggaggacacagugagcccuggggcagucaucagggccgauguuggcucucuuacccagguaggaagagcuacauguguggcaggcagacccagggugcuccuugcucugcuaauuagcugugcaaccaggcaagggaguugacaccaguuaccuuaucuguaaauuggagauaguaaugucacaggagccuuaggguguugcuuugccagcuggaaaccucuguggcugguggcgccucugcuugaguuuugcucaugcccgcuaggcucguuccguccacucagcccagcaggcugugcucggcucaugcuacuggcccggaucccgugccugccaagggcaagccaggcuuggagcggcgagguugugugugagcacagggccaggccacugcacacagcaaggcaugccagcuguugugguggggugggcagcuccaggugccggcuccaugugaggcuguggcuggaccagauauacgacaagcagcuucugcuguggauaucagcauccggacaaggggaacaugguggcgcccaaaagcuuggagacgccaggaagugcagagccccagagaggauguuacaguguguuacagcccuggcuuggggaaccugaaggucugggcucccagaagagcugcagcuuuucucuccuccuugcccacagugcggugagccggggggccauguuucagcccauuuguguuacagcucuuucaguaccaccaccccacuucagcuugcagcucaugggcuggccuggccccacagcucuuucccguuguguggggcagcugcccaguagcaguggagaacaggagggcuguaguguuacggcagcucuggcucagggaauuccaaggucugggcacccagaaggguuggcacucuucacugccacugucugggaguguaucacugccuacagcuuggugaggcagccaggaacguguuacaacccauuucacucccaccauuuggcaggucccaaguucuuguccugcguccaggaagaaugagauuauguggacaauuggagggugagcaagacagagaaaggcuuuauuggaugaccgaacaccucuuaguggagaggagaccugaaguggguagcuccuauccacaggcagguagucccaaggagugucugaguccagcugagucugggguuuuuauggggucagaauggaggaagugcuugcugauugguccauggaugggccuggaaaaagcaccacuugauuggcuaaaacuucaucaaggaaguucucacucccuguugcagacuucacccggaauuggcagcccagccccaggcuucaggccaucccuggcuugaaggugggguuucaccagggaucccucccaucccuccuaauaaccugucugccuuuugccgucaucaacugccacuuauggcacccagguuuucugcaccaaggggcacuugcaugcccaugccgagccgcccucaggccccuuggccucacucccgugcuccucagcacccaaaaugucagccucagaacuaguuucuggaggugcugagacagucuggggucugguguguuagugccauccugagcaugcacacgcccggcugggucgcuacagugccugggcucagcuaucaagacacgauggcaacuuuguuccacugcagagugcauaccaggagcggggagaagccagggaguggaagcaggcacuuccgagccugccggggcaggggccuuccugggacccugagagcacagggaugcccggguccagagccacggcugggcagcugcagcugcaccugggagcaugggcucccgcccugccagcucaguagggcacggggcucccacugggaucaccuguucccagcccccaugugcagccuuggccaugccucccucgcugcagcuggcauccucacaguggcugcuucagacaggccgccgccaccaguaguaaugaauacuggaauuuguguugggauuauugaaacguaaugcauaaagcaguuaguguggugcccagcacauaguaaacaaaugcagguaguguuuguggcugugguggcaguggugauuauggucgaugguggcagccaguaauuuuuggucagcucauuggucagagagucccuaagcacaagauuucuagaaacauuuuuucacccuacaucuuccauaccuuuaaauaaagaagagguuacugaaagaaggaucuaagaggaagugucagaaagcuuuacacguauaaauuccuuauuuaaguaguuuuuauauuuggagcuuucaggaguugaacuuggaagauuuccuauuuuggcuccugguaugguggggcacagcccugagaucacgagugggaucauuccagaauacuguagaaagggagaggaaggggucagggcuacaacucugucuccuguuuggcuacaccacucaacacggucagugggauagacugaccagcuaugcgagcccaaacgaaaucagguugacaaugccggagccccaaacagugguccccacagagugccgcaggagccgcccucuggcuucucccuuucaccucuuucuuuaaggccuguauuauugcucucaccacaacuuguccugagagaggugucuauaauuagcucaguuugugugcaggguggcuuaacguggaggaaguggcaugaggaacuuugguuaaucuuaagaggaaaguccugaacacaguugauguccugggagggcgggucacagacacagaguucccaccucuuugccuaacuaccuacagucacacacagugccuuguauugcagauauucauguguguauuugaguccccagcuggaucugaauccuuggagagaaaugucuccgagagggcugggucuuuuuugucucuguuuucucagugcugagcucagucccuggcccagaggacacacucagagggaaggagaaggcaggaaugcagagaaucucuuaccaguggguuagaacugcugcucuugugcccacauugccuuccuggucccuccccugcaggcccuuuuggguguggucaaccccgcagugucaacccuguuucuaguuauuggcguuuguuaugcuuccucacuucaaaggaaccagaaaaauaauuuccaaaaacagcugccuuuguacuuucuaggccuuuuaagguuuuugcaugccagaaucucaccuauuucuaauaucauaaagauguggcugcuuuggaaaauauaccucugaggcuuaaugcuauaauaacuuccagaauaauaaaacaaccuccgucucugggaccucaguaccuuaaccaagcaucguguccacuuugggcucaucauuggagggaaaguacguacuaacaaagcagcggaccaggcacuguggcucacaccuguaaucccagcacuuugggaggcugaagcaggaggaccuuuugagggcaggaguucaagaccagccuugccaacauagugagaccuugucucuauaaaaagcaacaaccacaaaaaacuagauggccuucaggaauucaccaaauaaguuuuagugcuuuuauuuuugugaaaauaacagaccuaucuuuuagaaaauagguauagcuguguaugaggacauuggccaagugugacugguggaaaaaaaaaaauuggcuguuugaguaagcaagaugggcuucauuucagcuuaagggacaaccacagcaucuuggaguucagaaaggguguguauguguccuuuagaaacaaacaaggccaggcgugcuggcucacaccuguaaucccagcacuucgggaggcggaagugguugugcccagcuauguugcugggcaacauagcaagaccucaucucuacuuuuaaaaaaaaauuagccaagcaugguggcacgcaccuguauucucagcuauuugggaggcugaggugggagaaucaccugagcccgggaagccaaggcugcagugagcugugauagugccacugcagucacuccggccugggcgacaggagugagacccugugucaaaacuauuaaaaagggaaaguggacaguagacuuggauagacuuggaguuucccagaaugauuagugucaguauagaagcagcuuggcuugaaucgauuaacccagagccugaaauuacaggggucuagaaccagcacagaacacgcuuagauacagauaccucaguguggaagcauuccacauuuucuucuaagcauguuagaaagcucucacucugaaaaagacgcagucagaagaaggggcacagaauugguucuuucguuauacacagaauguauaguuuaggcugcgagauaaccuccuagaacagcaguucccacccugcugagcaugagauugccuggaaaggcauuuggcuuggaccagcugaaucagaaauuucucuggugguuaacauuagauuuauuuacugcacuagagaaaugagucugauguugaauuuuucaaagcugaugaaacuaaguuuauaaauaguuuauaugccuuuuuaccaaguaacucuuauucuaggagucuaagaauagagucaguaauucagacaaagauuuaugauaacaaauauacaauagcauuauguaugauaggggaaaauugcagugaccuaaauauuuaauaaaggaguggcuaaauuaguugugguucaucuauacuguugcauauauuuggcaaguaaaacagaguuuuuaaaagauaauuaauagcuaacaaaaugcucaugauguaaucguagguggcaaauagcaagguacaaaauuauauauguccacgaaagaaauauuguaggauuucgcuuacaugagguaccuagaauagucaaauucucagagacagaaaggagaauggugauugccaggggcugaugagagagagaaugaggaguuaguguuuaaugagugcagaguuucuguuugggaagauaaaguucugaagauggagaguggugaugaagucacaacacuuugaacuuaaugucacugaaauuuacaauugaaugugguuaaaaugguaaauuuaguguuauggguauuuuaccccaauaaaaaagaaagggccuccaccccaaaaugcuguggaaggaggcgaaggaacauggcaugaacucaguuccaagcucuugacaaauagcuuuagagacagaucagcuguauucuaacaugaaagaaaauaaaggcuggaccggcugcaggggaaagauugugcauguauaggauguccuaauucuuaaagaaaagagcacagagaaaaauucuuuaaauuaguuuuaaaaauuagaaguacagggaaaaaacuccaaauguggugacagugaucacuugugauagaaauaugagguuuuaaaauuuuuuccuaucuuuaagaaauuuuacaguuucucccuaaugaauauauagaagcucagaauuacucauaaaaauacuuuuucuucuuuuuuguuuuauagagauggggucuugcuauguugcccaggcuggucuugaacuccugagcucaagugauccuuccaccuuggccgcccaaagugcugggauuacacuuugggugagccaccaugcccagccuuaaaaauaauuuuuaaguguuugcauucuuugcuaaucucuacaugaagggugcuuaugacauguuuaacaagcaguccaaagugguguauccccaucagaguagcccccuugagaggccauugcuaagagcuggccauuccuccggugcuuggugacuuuauugucuggaauacauucuuguggauauccucagagagcgcacauccuuacacugggggguauugaaaacuugggagacugcugccggucaucuaggaccaagccuugugaacagguagaugcuuccaucaauaugcucccuucuuuuugaggaggaugguuuugcagcugggccuuugcauggugugggaaguccuccaguuuuauauuccauuguuaagugagagguuucuuuccauuuugugggaggagggaucugucaucaugcaaacuagcgguuacuuaucaggguuguuaauggcaaccaacagaaacugacauugauuuagccuguacagaaauuuagugaaagguuauuggggagcuuccagaaucuccaggaaugcagaagaacaaaggucagaaaauaggcaagaacaaaaaggaggcuguucagcugcagcuaugggcaagaccagaccacagaugccauccaggaaggacacacugccuccccuuauguggugagacuggaccuaaccucugcuguaggccugugggugcugcugcugcugcugcugucugagagaauucucucuucuacuuguuucucugcaucucugaucacagguucuaaauccugggcuggugcagcccacuggccaggccgcuguaguugucuuugcugugagggaagcuggggaagggagugucuggcaguguucagugacugugaugucaggccagcucagcccccauuagacuggggagaaggggguuccaaagcugggcagccgaacagaugacagauagccacuaugauacuuacguggcugucugucagucuuguuaaucccugccaggguccaguaaugagcaggugauuaucucuggaaacgauagcagcuguuggcauuucgccccaggucaccuaagcauucuccccaagggggacugccagaggagccaaacuauaugccgauuaacuacugggaacacaugugccacgucuucaucuggugcaacucugcucacagauggggcuaccugcucugugguuuauacacguaaggaguagugauggggguggggauagggcuaaggcaacauuugaggacagcagcuucuagggaucccuuuagaagggucucguaagaguuccaagaacucagugacuucagaauucagguaaucagacuggcagaugaauuuuuccuuuuaguugauggagcaaguauaggaguuuggcccugacuuuggcaggaauguaaugacaccauccucuugcccuagguugaguacuccuaucaguccuugaaguaacugaucacagccaaaaggccacucuucaccgugauuaugauuucugucuuuaauuuucacaucaucuauuuaguacugcagcuacgggcuuacuggcagcuccagacaccaguguccuugugaacaaggcucugguagauuucaggcgaguuuacacaucccuagaggcaguacagcaaacggcaaacagcuauuuauguuaggugaagauggacugcuucaaagagucuggacagcaacugagaaaaaugcauuugucaagguuuuaaugcauauaauuuuccagcaaagguguuuacuuacuccaguaacauacuaaguaaacugcauuaggaaaagccucuuuaguauuuuacauccuuuucuauaauugaccuuagauucuagauugcuuaaaagaagucgcccaagucagagagagcuuuggggauaccuggaauucucauuuuuaaugugugccccaggguugggaacacgcuuugagaagcugugcucuagugccugguuccuggugcugaacccaaggauaugugaaccagcuggagaccuguaagagggagggcagaccacucaaguuguugcauuucauaaauuaaaucccuucauuuuuagaccuuuugauauacuuaauuuuuuucagaccuuuuauuuauuauuuuuuuuuaaauuauacuuuaaguucuaggguacaugugcacaaugugcagguuugauacauagguauacaugugccauguugguuugcugcacccaucaacucgucauuuacauuacguauuucuccuaaggcuaucccucccgcauccccccaccccucaacaggccccggugugugauguucccugcccuguguccgugugaucucauuguucaguucccaccuaugagugagaacaugcaguguuuggguuucuguccuugcgauaguuugcugagaaugaugguuucuagcuucauccaugucccuucaaaggacaugaacucauccuuuuuuauggcugacaugguauuccaugguguauaugugccacauuuucuuaauccagucuaacauugauggacauuuguguugguuccaagucuuugcuauugugaauaguguggcaauaaacauacaugugcaugugucuuuauaguagcaugauuuauaauccuuugggaauauacccaguaaugggguugcugagucaaaugguauuucuaguucuagauccgugagcaaucgccauacugucuuccacaaugguugaacuaauuuacacucccaccaacaguguaaaagcguuccuauuucuccacauccucuccagcaucuguuguuuccugacuuuuuaaugaucaccauucuaacuggugugagaugguaucuugugguuuugauuugcauuucucugaugaccagucaugaugagcauuuuuucaugugucuguuggcugcauaagugucuucuuuugagaagggucuguucauaucccuugcccacuuuuugaugagguuguuuguucuuuuucuuguaaauuugaguucuuuguagauucuggauaucagcccuuugucagguggguagauugcaaaaauuuucucccauucuguagguugccuguucacucuaaugguaguuucuuuugcugugcagaagcucuuuaguuuaauuucaugccauuugucaauuuuggcuuuuguugccauugauuuuggugcuuuagucaugaaguccuuggccaugccuguguccugaaugguauugccuagguuuucuucuaggguuuuuaugguuuuaggucuaacauuuaagucuuaauccaucuugaguuaauuuuuauauaagguguaaggaagggauccaguuucagcuuucuacauauggcuagccaguuuucccagcaccauuuauuaaauagggaauccuuuccccauuucuuguuuuugucagguuugucaaagaucagaugguuuuagaugugugguguuauuucugaggccuguguucuguuccauuggucuauaucucuguuuugguaccaguaccaugcuguuuugguuacuguagccuuguaguauaguuugaagucagauagcgugaugucuccagcuuuguucuuuuggcuuaggauugucuuggcaauguggguucuuuuuugguuccauaugaacuuuaaaguaguuuuuuccaauucugugaagaaagucauugguagcuugauggggauggcauugaaucuauaaauuaccuugggcaguguagccauuugcacaauauugauucuuccuauccaugagcauggaauguucuuccauuuguuugcguccucuuuuauuuuguugagcagugguuuguaguucuccuugaagagguccuucacaucccuuguaaguuggauuccuagguauuuuauuuucuuuguagcaguugugaaugggaguucacccaugauuuggcucucuguuugucuguucuugguguauaggaaugcuugugauuuuugcacauugauuuuguauccugagacuuugcugaaguugcuuaucagcuuaaggagauuuugggcugagaugauagguuuuucuaaauauacaauuaugucaugugcagacagggacaauuugacuuccucuuuuccuaauugaauacccauuauuucuuucucuugccugauugcccuggccagaacuuccaauacuaucuugaauaggaguggugagggagggcauccuugucuugugccgcuuuuuaaagggaaugcuuccaguuuuuguccauucauuaugauauuggcuguggguuugucauagauagcucuuauuauuuugagauacaugccaucaguaccuaguuuauugagaguuuuuagcaugaagugcuguugaauuuugucgaaggccuuuucugcaucuauugagauaaucgugugguuuuugucauugguucuguuuaugugauggauuacauuuauugauuugcguauguugaaccagccuugcaucccagggaugaagccaacuugaucaugguggguaagcuuuuugaugagcugcuggauucgguuugccaguauuuuauugaggauuuuugcaucagugcucaucagggauauuggucaaaaauucucuuuuuuuuguugugucucugccaggcuuugguaucaggaugaugcuggccucauaaaaugaguuagggaggagucccucuuuuucuguugauuggaauaguuucagaaagaaugggaccagcuccacuuuguaccucugauagaauucggcugugaauccgucugguccuggacuuuuuuugguugguaggcuauuaauuauugccccaauuucagagccuguuauuggucuauucagugauuuaacuucuuccugguuuagucuuaggagaaucuuuguguccaggaauuuauccauuucuucuagauuuucuaguuuauuugcauagagguguuuauauuauucucugaugguaguauucucugugggaucaguggugauauccccuuuuucauuuuuuauugcaucuaugugauucuucucucuuuucuucuuuacuauucuugcuagcggucuaucaauuuuguugaucuuuucaaaaaaccagcuccuggauucauugauuuuuuuuuuuuuaaggguuuuuugugucucuaucucuuucaguucugcucuggucuuaguuauuucuugucuuccaguagcucuugcuucucuaguucuuuuaauugugauguuagggugucgauuuuuagaucuuuccugcuuucucuugugggcauuuagugcuauaaauuacccucuacacacugcuuaaaugugucccagagauucugguauguugucuuuguucucacugguuucagagaacaucuuuaugucugccuucauuucguuguuuacccaguagucauucaggagcagguuguucaguuuccauguaguugagcgguuuugagugaguuucuuuauccugaguucuaauuugauugcacuguggucugagagacaguuuacagugauuucugugcuuuuacauuugcugaggagugcuuuacuuccaacuauguggucaauuuuagaauaagugcaaugugguguugggaagaguguauauucuguugauuugggguggagaguccuguagaugucuuuuaggucugcuuggugcagagcugaguucaaguccuggauauccuuguuaaccuucugucucguugaucugucuaauauugacagugggguguuaaagucucccauuauuauugugugggagucuaagucucuuuguagucucuaaggacuugcuuuaugaaucugggugcuccuguauugggugcauauauauuuaggagaguuagcucuuuuuguugaauugaucccuuuaccauuauguaauggccuucuuugucucuuuugauuuuguugguuugaagucuguuuaaccaggauugcaaucccugcuuuuuuugcuuuccauuugcuugguagaucuuccuccauuccuuuauuuuguaccugugugugucucugcacaugagcugggucuuccgaauacagcacacugaugggucuugauucuuuauccaguuugccagucugugucuuucaauuggggcauuuagcccauuuacauuuaagguuaauauuguuaugugugaauuugauccugucauuauguuguuagcugguuauuuugccuguuaguugaugcaguuucuucauagcauugguggucuuuacaauuucucauguuuuugcaguggcugcuaccgguuguuucuuuccauguguggugcuucccucaggagcucuuguaaggcaggccugguggugacaaaaucucucagcauuugcuugucuguaaaggauuuuauuucuccuucauuuaugaagcuuaguuuggcuggauaugaaauucuggcuugaaaauucuuuucuuuaggaauguugaauauuggcccccacuuucuucuggcuuguaggguuucugcugagagaucugcuguuagucugaugggcuucccuuuguggguaacccuaucuuucucuuggcugcccuuaacacuuuuuccuucauuucaaccuuggugaaucugccaauuaugugucuugggguugcucuucucaaggaguaucuuugugguguucucuguauuuccugaauuugaauguuggacucgcuugcuagguuggggacguucuccuggauacuauccugacgaguguuuuccaacuugguucuauucuccccaucacuuucagguacaccaaucaaaugcagauuuggucuuuucacauagacccauauuucuuggggcuuuguucguuucuuuucacucuuuuuucucugaccuugucuucucacuuaauuucauuauuuugaucuucaaucacugauacccuuucuuccacuugaucgaguuggcuguugaagcuugugcgugcgucacaaaguucucgugccaugguuuucagcucugucaggucauuuaaggucuucuccacacuguuuauucuaguuagccauuugucuaaucuuuuuucaagguuuuuagcuuccuugcgauggguuugaacaugccucuuuagcuuggagaaguuuguuauuaccgaccuucugaagccuauucugucaacucgucaaagucauucucccuccagcuuuguuccguugcuggcgaggagcugugauccuuuggagaagaggugcucugauuuuuagaauuuucagcuuuucugcucugguuucuccacaucuuugugguuuuaucuaccuuuggucuuugauguuggugaccuacagaucggguuuuggcguggaugucuuuuuugucgauguugaugcuauucccuuccgguuguuaguuuuccuucuaacagucaggucauucagcugcaggucuguuggaguuugcuggagguccacuccagacccuguuugccuggggaucaccauuggaggcagaacagcaaauauugcugccugauccuuccucuggaagcuucgucccagaaggggagccaccuauaugaggugucuguuuaccucuacugggaguugucucccaguuaggcuacaugggagucagggacccaccugaggaggcagugugcccuuccucagagauuaaaugccucacugggagaaccacugcugucuucagagcugucagacagggaaguuuaagucugcagaaguugucugcugucuuuuguucagcuaugcccugcccacagagcuggagucuagaggcagugggccuuguugagcugcggugggcuccacccaguucaagcuucccagccgcuuuguuuaccuacucaagccucagcaauggcagacgccucucccccaaccaggcugccaccucgcacuucagucucagacugcugcgcuagcagugagcaaggcuccauggccacgggacccaccgagccaggcacgggagagaaucuccuuucugcugguugcuaagaccuugagaaaagugcaguauuggggcaggcgugucccauuuuuccaaguacagucugucaaggcuucccuuggcuaggaauuggaaauccccugacuccuuguacuucccagcugaggugaugccccacccugcuucagcuugcccucugugggcugcacccacuguccaaccagucccaaugagaugaaccagguaucucaguuggaaaugcagagaucacccgucuuuugcaucaaucacgcugagagcugcagacgggagcuguuccuauuuggccaucuuccagaccuuuuauuuuuaaaagaaacuucucuaccccgaaugaaaucuuacucagaaaccuuauuuguaaauaaaaucaaaguucuacucugaagcccucauagaucuccccccuugcaaggacccugaagaccugcaccccacagagccaugggguuuagugugacaggccucacgugugggugcaaugcccucugucugucccuggcuugggcugcugggcuuuauugccuccuagugucucacacacauuagguggucaguaaauagguuuugaauuagugauugaaacaauuuuggggacacccaccagcuucuacuuuggagagaucagagaagccuaaauaucaaaccuuucaacuucuuuucaucagcucacaugcuucuagucucauucuuguuuaaauuuauaccccacauagucauaggaaguugcuggcaaacucaaaaugugaaacagcugaugaauugacacuauuucuuuauggaugaaaguagauguuacagaaauaagcucuuuuauguuuuacuccgagcuaccuuaacuucauuuggaaaguagcuaaggaguaaauacugaauuuuacauacuaaauaaaguuauaugcuaaucaaaauauauguccuuccagcugaaugaccuggugcagggugagaaaggagcuguuauggaugagaaucgugcccccugguuuuggaggugggggaggcacagaauaacuuaucuuguuacauaguugguuuguuauuuuucuucuucuauaaguaaagaaaaagaguucugaaagcaagaagauugagaaagcaaacugaaaugucuucuugaguuuggcaugaaagauuaugaauuuuaucuuuguggcugauagagagcaacauuaggauacagagcaacguuaggaggaggcugagcaguaagugguuaguugaggucaggcacugccaaugcuggauuaagauuuccugugagugaaaggugaauuuacaauuaguaauaaaagauaucuaacuaucucaggcauuguuuccaaaagguuuuugaaaaaagaauugucacuuaguaaaguucaucuauucaguuuguuaauaaaacuauguuuuuaggauuaaacugcucgaaugcaauuuaugcuuguccaguccacguuuccaugucccucagcucuccuuggugauaugguaccuaaaauugcaagucaggauuuauuuugagggauuuuauuuuaaagguuaauaaaguucugcugaagggcaaaucuguaaaauuaaggaccuaaaugauaaagaaggggaggccguaacucuccugcuugaaaguuguuugugguggguaagaaagugcaggguacagccucauguauuuccugaggcguugacuugccucuguugggauucgagaaggacccaauaaauagcaugucucgcccugccugaggaaaagcgagacaaaggagucaggauuuggagauguaaaguaucaccuuuaugagugauaaagcagauauugaggaguguggcuuauaucuguuggcaaacagguuucaaauacuggacccuggaauuagacaggcuuaccuagugaugggccgugcaggaaagugcaggcuccucuccguggaaggagcagagcagagugcagguucucugucugcaugauggcuccagagagaaagggaaggagcugagcuagaggucaccaaacuuucuuggcuugcaggcacccuuaguaccucagcaugcuuuuuauagugccucucagucaaaagaaguaccuaacaguucuauguguuaaguaaauuagguccaaauaacucaucaguauuaguaagcuaggugccucacaagugucaccgugcuucucuugaauguaucccacagggucccugugaguuugcuguagcacugcagagcaccauggcacauaguuugggaaauacagucuccuucagaauucaaaaauaaaauuaagucguaacuaauccucuuguaaaaggcuaagagggggugaagaugagccagauguauuacccaaguggagaucccuccacaugggagacaucuuuagcagcaggagaagcauaugccaccuccugccgccacacuuaccccagcaccugggcuucagcucagaggaauccagagcugaugcgacucucuaaccucggagacugacgcauguaaucaguuuguacucagaagcuauaccuuccaguguucucgguaccgcauaaaucuugggaagggaaauggagagaaaggugauaaccccaugggaauacauugaguacaucuccacagccuacccuuucaauuccacaugcccugaggucaaguccuaugagggccaaggauagacuuacuuucauuuggcuaaguuagaugcauauugucaguucuguagagccuccgagcaaacuauuuuuuucuuugcuuuagcuccaauggaagcauagccugcaguuagaaaaaugaacagccgggccuuccauguauacuccuaacccagcaaucaaauggccacuccuuuauaaggcacaauuucuauuaguaauaagaaauaguacaugguagauuuccaaucauaaacaacuaaauacuuccuguguaugccucucauuuaaaccacagaauaugcccagucugcauuuauagcuugauuggucaagugugcauuucauucagauuguccucaucaguaaaauaccaguauuagcaaaucaugaauugcuaaaugugcaaaaauaaaaauuaccauagucaaguauuuaauucccuuguauuaaaauuguauuguguccuacucaauacauacaaauuuaaaaguuugcaaacuaugucugaacaaauguuuaaauguuuuacuaacuucccugucccccugccacgccuuaaaaaaacaaaaagcaccuuucaggauuaaucaccuggggaguuugcucugaauuacugccuugggagguggcaauaugaaacagaagaucugaaaugaaaagauucugguuaugggugccaccaugauuaccugcagaaaaaggugggcucgucaauuaacaggagaugcuggcagaagcacauuuauguagggggguccagggugucuuuagaagggccgugcuaaacaggacacacccacccagcuccacccgccgugcugcaggugcuccuguuuucccuucucugcuuuauuggcaaguccuaccggcuucaaucgcacgccauuuguccccugcuccacuuccaccugggugucuuuuagucucccauagcuucacuccuccagagauccuggcaacuuaaagccucgcaggagucucaguuuccuugucaguaaaauggggauaauuaauagucucuuucuaugucauggggugauuauaagaucacaugagauguaugcugaagcauuuuguuaacugcaaaaugcuauauaaaugucagguguuauaaaucauuagcuggucuauuccucagcuaaagcgguuucuaugcauauuuuaguuacccccuaaacaauucuuuuucaaauagcaaauguaaaugcugcuguuuuuuucugcuuggauuaugguggcuccuuugcaacuuuaugauguaggcugaaucuuuaaauacuccuuuggcucauaucucuuccccugaacacccaugcgagaucauaauccauaaaacacagaggcaauaacuccuuuuaauugccaggaguucaucauuugcuaaguucuaaaugcagucacuuaggcacuccuuuugaaaagccugucucuguuuauucugcagagccgagacugucugaagcugggcccaccugcugagggagaagucguccaagucaaguggcccgauggcaaacucuauggagcaaaauauuuuggaucaaauauugcccacauguaccagguggguucuuccuucucugugaugcuugcuaagauugacaugauaagucagaaggagauaguaucucaagugugcugcugaacaauaagccacaugaauuugggacaccucuuauuuuaugcaggaggcaaagauucaauguguaaugacccaggucgaaacccuggaguuuuauuaccaaguuggacacugggaaacucuuaacagcauuugaugaaugguuuaauuguaaggaauaugguucugccagaaagauaagugacuagaagacaggcugccucccacuguuucuguuguauggggaacgacuaguuggccgauucaucuaaccuucagccaagacagcgauggccacucuucaaccagcagccccugaagugguggcuuuugcugagagacauagucuccccacuccccgcuaucucagcaaagcuagacaacagugcauugacauagauguggccaguuaaugucacaaggagcugaugguuaucauccacccaagcuuaaaggaaugcuuguuuaaaugaaaaguacagcuaucaguuggacguucuguucaccagggaacccuacguaguauuaaagaguauauauacaauuuuaaaaugaauuacuuuuauuucacccagaaaugagaaugaguuaagcuuuaauaagggaaacaacauggauagcacgugcacauuuauauuccuucagaaagguuuuaaaaggggacauuuagagccaauacauuguagaauuuucaguaacacugugucagaaaucaagauucucaggcuaaacuguagagugaaaacaagaagguugaaguaaaaggagaaaaagcaagaagguucaggccuguugaaaaacagcuugagaaugauaagacugucaguuucaacagagaaauuguucaaagacugauaaggagcaagagcuuaaauggaagagugcauuguaagauacugcgucaggaccuggagcacaguguaauuaaagguguucaaagaaguuugaaaaacuuaggagagaguguuuuucauggucuagaaaaaccuaaggggaauggauaggggaggauguauacacauacauuguguguguauguguguaugugugucuguguguguaaaggccauuucccccuuugcauaugguauuggugacagucucaagauacaaauucaaguuauuuauaauaguaaagguacuggagcuucauugcauuagaaugaccagaauuaggcaaaaauugcaagacaggcuauaauaccggaggauccuggaaaagaagcauuacuacauaaugcaaaauaaaauaauuacauuuaauuaaauaauaagugcaaaagcaaagcuucuuacauguagcaaagccauuugcuacaugaaaagaaucacauaaugagaauauguugaaauucaggcuaauuaguaaucaguguguuaacuucaguugaauuuaugauggucuaucaacauaaaacuaugagcauauuuauagacucaaugaaaaaguuaagacuaauauuaaaauugucucucaagcacaaguaguuuaaaauuccucauuaagccaaguggccuuuugagaucuuuuuguguuuugugucuaauuauucaacuucaccaucaaauaaacaaagacaguuuuaaaaauagauaugacagauaaauaaauaccugcugcacagugcuuaauauccuaggcauaugcguuuuuugacccucagaguaguccuacaaaauagauguuauugacuccugucuuacaaaugagggaagaaaggcugugaacaaaauuuuuaaugauuuaagaauaauuuuuuaauaauuuguccgagagcacgcagcugguaaagagagggccaaaauucucucucagcucugcccuaacuaggguggacaaccaucccugcuugccugggaccaucccugauuuuaguacugaaaauaacuacaucccaagggacccuugagucccaggcgaacuaggacgguugguuacccuaguccuagcacagcauacucccuucuagguuuguaauugccuuuuugucuuuucgauguuuuaaguggucuaaaacaaaugaaaguaggcacaggugguucuagcuaugcuaucaacuaaguuggguaaaucagaugacacuauggccuaguucaauguuaaagaaauguuucugcucaaacaaggccaggaagaaaacccuucccauuguuagcccucccggaagugacagcaaggguucucaugugacuggcaccuaauuccacuguauuguuuagcuuauucaaaaugcuaacaguacguggauaauaauacguucaauuguauguuugaucuuuauuaagaccgugguggauguucaucaaccagaauugguaacuugugccugagagacauacccaccugggugucucagcaaagcuagaccaaugcauuggcacagauguggccaguuaauauuaucauccacucaagagaguguuugcuuagugcaaagugcagcgauauaucaguuggacauucugugaauuaaacaauaaguguagcugggcacaguggcucaugccuguaaucccagcacuuuggaaggccgaggcaggcagaucaucugaggucaggaguucgagaccagccucgccaacguggugcaaccccgucucuacuaaaaaaauguauaaaaauuagccaggcaugguuggcggcaugcuuauaauuacagcuacuugagaggcugaggcagaagaaucacuugaacccaggaggcagagguugcagugagccgagaucgcgccguugcacuccagccuaggcaacaagagcgaaacuccgucucaagagaaaaccaaaaaccaaaaaaaaauuaguguaaauuuuuuucaaacucuagauuuuuuuuuuauuaacauggcacagcugugugguuuaacuuaccuuuugacuagaaguauaagcauauuuucauuucuuuaaaaaauucagacaaaauuuagggacuucaaaaauaccaugugguucagaguuagaacauauuaaguauucuaccugauuacauccguuuuguuuccugcuagauuaguucauguuguauuaaaccuaaaccaaucuaaaccuaggugcucuagguuucuguuagcugguguuauuuaccuuuucuuugacaaaaucuuuuaaaauguuaaaaacaauugguuaugaaauuauuugcuuccauuugguuagugcgagaaaaguuuuaaacauuuuguuuuagaugaugauguauuuucacacauugaugagguuuacauguuaggagguugagaaacagauuuucccagcuccuuugauggcauuugauugaauuugacacgugaauuuugaaaguucaagcucuguaagaaaugcauaaauuauuuuaucugggaggauuauuauauaagaguaaacaggccgggcaugguggcugacaccuguaaucccaacacuuugggaggccaaggugggagaauugcuugagucuagucagaccuuaucucuacuaaaaaacuacaauaaaauaaaauagcugggcguuguggcacacagcuaugguuccagcuucucaggaggcagaggugggaggauugcuugagccugggagguugagguugcagugagcugagaucaggccacugcacucuagccugagcaacagggcaaggcccugucucaauuuaaaaaaaaaaaaaaaaaaaggaaauauauuaucuuuucuuucacagagagaaacaauucuccuuguuacguugucagagccucuuaaagaaaugaaccgugcugacagacccaacccauuuuaaugcugaauuucccacagucucauguuuugugauuuccauuugaucagcagcuacuuuucuuuguuguugcuucgccagauaaaguuuucauauccuguauuccaagacacucauuuccaagaauuuuggccuguuuugaaauguauuuuguauuuaguuuauuuauuuauuuuuuuguuuugagacggagucuuacucugucaccaggcuggagugcaguggugcgaucucagcucacuacaaccucugccucccagcuucaagcgggucuccugccucagccuccugaguagcugggacuacaggcaugcgccaccaugccuggcuaauuuuuguauuuuuguuagacaggguuucaccauguuggccaggauggucucgaucuccugaccuugggaucugccugccucagccucccaaagugcugggauuacaggcgugagccaccaugcccggccucuacuuaauaagggaaauaacucuucuuacuuccuugguuguuggcugguucccuuguuuguucuguuugaguccuuuucaucuuuucauguaguuaauuggagccuuuaaaaauggucagugcuguuuuuuuaauauguaucauguuauauuaucuuucauuagguugaguuugaagauggaucccagauagcaaugaagagagaggacaucuacacuuuagaugaagaguuacccaagagagugaaagcucgauuuguaagugcuggcagaugccacuuggggaccugccaagugaauuccuuguccucaccucauguuucccaagcccagcaggaaacauacuugggcuuuuggauuaauucuaaaaaaagccaaugcaacauuuuccuuaguggaaccuauugaaugcaaacuucaaauucaaccaaaaucggggaaauuaaugcaugugcuuuacuuuucuucuaaugaagucacaugaugcuucuuuguguugacauuuauuggugcacaaaaauacuuacugaaugugugcucuguguaaaacaccaggagcaaacaaagauaccaucaaggcauuugcaaucuuguuaguagaagcaacauuaaaaguauucaggaguagaucaaaggggacucggcauaauugaaugucugucuauucuuuuauagguuuuucauggauugacuaccuucugucucagaaaguuacugauguuugugucaguucaucauuaagcuaaacucugacuuucauaauaaaagggauaaacaaagccuaaaugcuaguugugggaauacuaaagcaguuuuuuaaaaaggaaauaguaguuucaugcccucacauaccauuaaaagaugaacaaacauggacaaauauucaaaacugcagucauugaaaaauauaauucacaauaauuuagacuucauauuauuguaucauaaaauauucaguggacccugaaaugaagucaguuuuauucauuuagaauuauaucuauugugucugugaaaugauaaauccuaaauagagaaauuugaauggaugggguuuuucugacuaaaaugaaauuuuuuuucugaauaauucaguuuagugagugcuuaugauauacuugucugcagugauagagucacuauagauuauuugguuauuuuggaaaaaccaaggguuuucuuaaaucagggauguccaaucuuuuugcaucccugggccauacuugaagaagaagaauugucuuuggccucacauaaacuacacuaacaauagcugaugagcuacuaa

SEQ ID NO: 191379 - RNA, 38846 nt, Homo sapiens
cgcucgccggccgggcgccccaagcaacuacaacuuccaucacgcucugcgaggccuugaucugcaggcuuuugcaggggaaggaguggggcgaacauggcugaaggaagccgagguggcccuacguguagcgggguggguggcaggcaggacccagucuccggcaguggcggcugcaacuuuccagaguaugagcuucccgagcuaaauacgcgcgcuuuccaugugggcgccuuuggggagcuguggcggggccgucugcgcggggccggggacuugucgcugagggagccgccggcauccgcucugccugggagccaggcagcugacuccgaccgggaggaugccgcgguggccagggaucuggacugcagccuggaggcggcggcugagcugagggcggugugcgggugagugcggagcaaaggggcucuugcagcuuggggucaaacagggugcagccuugcucgugcgcuccucugggacucaucccugagaagggccugugguuuagaccugggcuaggaguauuacccuuuaaagcuuucaacccgcuggagccuuccugggacaccaggagaaguccugggacccgaaugcacaguuucuacgaguuggagcaaagggacaagacagcugcaucaaagacuaguuuuuccauuugcuuauucuaagagugcuuguuaauaaagaaaagcaaucagggcaacagcgacguguaccugccauugacagacacuuugacaauggaggaaccugaguaauggugaagcugcgggagacuucaucagaggaguguuaaaaccccgacuaacugguuucuuuuggggaccuuccggguauucuguuacugaaauauuucuuaaaagugccuuauuuggggaugaaaauauaaaaauaacuuuaaucucuuucuccauuuaacaguacuggcugccuucaucggccuuuucauuauaaaauauaaucacagaaaucguugucuuaaguucuggccucucugagccgccugcuggauuuuaucugacuucguaauucaguaauguauuuaggaaaacaacccuaacucgcugugaaccagaugcagagucgaccuuaaaguauugcuuuuccuuuuuguuuuagccuugauaaacugaaaugccuugaggacggugaggauccagaagucauuccggagaauacugaccuggugacuuugggguauggaggacuugguuuuuaugaccuauuuauuuaaacauuuuuucaacauuauguuuugaaaaguugaaagugcaguauugauuguugucuguauacccaccccuuaaauucagcuguucuuaauauuugaccauauuuacuuuagccguguguaugggaugccugcuguguguuuuuucauuuugcuaucccccauucaguaaguuagacaugauaauuuacccguaaauacauaagcauauagcuucuaaaaguaucauucuccuacauaauuauugugguauuauuauaccuaagaaaaccguaaauacauaaucuauaauauucaguccauauucaaacuuguguuuauuuuuuaauauuuuugaauguuuguuuauagagguaaucuacuuagaucuggggggcaaccuaaauacucugacaguguuuuucaaacuauuugugguaaaggacaguucuuguuuuuaaaaauuuuuaaucuuugacagauuuaugcuuugauaaaauacuauaaaaagaauuacuagaaaaauggaauuaaaaaagacaaacacaauauaaguucaaauuuuuaauuaaauucaauagacaaaauuauucaaugauaauggaaguuucuaaaugcuuacugucauuuucuguacagauugguuaacaaauaggucauagaugaauucuggucugccuaccacucuuugagaggcacuguuguaugauaauauagagaaauugugcauguaauagugaaauuuauaauuuccaauuuauaguccacuuauuucauacuaccucagcuauguucugucguucuugauccuacgcuauuaucccccucaaauauucaggcagucauuucaacucuacuuggguuuucuuucauaauaacugcuaaaucuguuccccuggucccuacugcugacuuuuacagcagcaacaccuggagcacugugcaagguucuuaagugucuuugauaaguacagucauuucucccacugauuuauccaucaugcugucgccugagcaagccauuuugcuuaaaaauggucuauggcccuacaucuccuauauggaaaaauuucaaacuccuuagcuagacauuugaagccuuccacauauaucccaaauuugccuuuccagauuuauuuucaaccacuuucucuuucagauggcucaggaugcauguggccucucucccaucugaaacauaccacuucuauguuauguuauguuacguuauuuuuuugagaugcagucucacucuguugcccaggcuggagugcaguggcgugaucucugcucacugcaacuucugccuccggguucaagcgauucuccugccucagccuccggaguagcugggauuaccggugccugcacccucggcugccuaacuuuuuugcauuuuuuguagagacggguuucaccauguuggccaggcugguuucaacuccugaccucaugugaucugcccaacucguucucccaaagugcuaggauuacaugcgugagccgccacaccuugcccauaccacuuuuuuaaaagcccaaagauuccuuuccagauuaccacaacccaucuuucccuuaggaaacagaugcauuuauacugccuuaaacucuuaacauuucuaaaguccuugaaggcucaaugagaguccaaacucccaucuguguauuguucucaagccuacuauacugccuugcuccaauuggugcucuguaacuauuguugauugauuaguuguauuugucuaaaaugcacaucugauugucacucccuugccuaaaaccuuuugaugucccuuaggcugaaguccugagucuguaguggcucacaaaggccucuaaggaguggaccuugcuguuuucauuuuguuuuguuuuugagauggaauuucacucuuguugcccaggccugagugcaauggugcgaucccggcucacggcaaccuccgccuccuagguucaagugauucuccugccucagccucccaaguagcugggauuacaggcaugugccaccacgcuuaauuuuguauuuuuaguagggacggaguuucuccauguuggucaggcuccauguuggccaaccucucgugauccacccaccucggccucccaaaguguugggauuacagauaugagccaccgcaccuggcccgaccuugcugauuuuuuuuaagcuuucucucugcaguguuccagccacacugcacuguguuucaguuccucgaauaugcucucucacuccaggccuuugcccagaacagucauucuugcuuaucuccugaccuuguugacuucuacucauccugcaagucuuagcuaaaggacuacggacuccauuuaggucaucuuguaugcucauguagcacccuaugcuucccuauugaaaugcucaucacaucuguaauauacguguuuaauuuucugucuucuuagcuacacuugaaaguuccuuaaguuacaucugccacacucacugcuauauuaccaauuccuagaacuguggugcauaguagggagccaacaaauauuuguagaaugaguggaauaaaugaaacuuucagaagacucaggaagugauuuuuagagauagacugaaaaaagaacguugaugauaaucauauuaaagcagacucuuuuuugcuauaguuaauaauguauucauugauuuauaguaauuuuguuaagccauguuaaauaguaauuuuaagacugcuuaaacauuauuucccuugacuacuuugcacuacuaggucaacuagaucucuuugguuucuucuagucccuccaaacaggauuuguggguagaauuauauauaaucuaauguaaaucaguacgguauucuucaacugggguuauuuugauauacugugaagcuaguguauuuaauacaugaccauuguuaaccuuaaugguccugccaaaaaaaaauuagacuuguggcaaaagccuaaauuuguaucucuaugcuuuaucuuucucugaaccuuccuuuuccucaccaauaauuucacauuauuauauuauaaaaauaaaacauaaguacaucauuucuuuauuaugacauaaaauaaauuucugguacuuuuucuuucccacaucaaaugaaagagcucguuuuaugcauauaagggaccaaagguaguugguagauauugauucuuccuugauacauguugcucccuuaaucuauagcaaacuacauagcuuuggcaguuuugacauuuuuuuugacuacuuaguugguuuuaauuccuaggaauaggagagauaauuguuaauacaugggugcugcuaaaacuuacuugucauuccaaaagcuucagcaacaucacuuauuuauuuguuuauuuauuuauuuuuagacagagucucacucacucuguugcccagguuagagugcaguggcucaaucucuccucacugcaacuucugccuccugggcucaagugauucuucugccucagccucccaaguagcugggauuacuggcgugugccaccaugccuggcuaauuuuuuauauuuuuaguagagaugggguuucaccauuuugaccaggcuagucucaaacuccugaccucaagugaucugccggccuugccccaaagggcugguauuacaggcgugagccacgacgcccagcccuucagcaacauuacuuuuaauacaauagaaauuuuagauuauucugcccaucccccucacuuuugugaccaagaaagcacuguuuacagguccaggauguacuguuuaaagguuaacaaaaggaacuuacagaguccugcaaaaacaaaaaacaaaagaaccaugaaauuggagaacucaaaacuccuauuccaccaaaccaaccacaaaugauuuuuuaaaaaaacuuaaacaggguggagugcuugaggucaggaguucaacagcagcuuggccaauauggugaaaccccaccucuacuaaaaauacaaacauuagcugggcgugguggcacccgccuguagucccagcuacucgggaggcugaggcaagagaaucacuugaacccgggagguggagguugcagugagcugagaucgcgccauugcacuccagccugggugacacagcgcaacucugucuccaaaaaaaaaaaaaaaaaaaaaacugucaaacagcucucauauaucugaaguuggcuagaaugacagaaaagagcaccaucaaacugggaaucuuguaaacuaucacugugccccagauguuacaaaaaugagcaagaggaaauaaaaucuaacgagagcuuguugcagauaaucaggaaauaacuguuuauacagaucaacuuuggagacuaccuguuccacucggaaacagguaaagccuguuaagucuagccggucgugguggcgggcgccuguagucccagcuacuugggaggcugaggcaggagaauggcgugaaccugggaggcggagcuugcagugagccgagaucacgccacugcacuccagccugggcgacacagcgagacucugucucaaaaaaaaaaaaaaagagaaagccuauaagucuguacuccaaacagaauugaauauacucaaauaagcauuugaggguauaaaaauguuuaccuuggcuuagaauuuuuaaaacuauuaauaagaauggaaaugaugacuaaaggagaaaugaaaaaagaguugaugaaacaaagggaagaaauggaagaaaaagacaauuaccucauaagugaauaaauuguaagauaccuaagggaaaauagacugaaaugaaagcaagaggcaaugaagaaaggcauaaaaacaacgaagagaauugaaaaugacaaagaaaaaaguaagaugaauccgagaaaguagggaaugguagguagauaggcaaagacauaauauucauauuaucagagucccugaagaagaaaaagaaauggaacauaauucauguuuaaaaacauaauccagcaaaaguuuccagaaauugaaaaaaaaacuaaaucuagaaaggguucccuagguaccuggaaaaauuaacccagacuuauugacuuuugggauauauuuuaguacaacuauuagauuucagagauaaagaugaaaucaucaagucuucugugcaaaaagaacauauaacuuacaaaggcaaacuuacaaaaagcaucacauguugaaaaacugacauacaaagcaaggcaacauagagcaguguuuuuuuuuaaagcucaaugaaggugugaauugaaggauuuuauaucuaacugaauguucucaaaugucaagguuauagaaaaagaguuuucgacauaacgaaaaccuggguaauuucuguaccugcuggccauuucugaggaauauacaagagaaugagcuuuauccaaccaauugaugacuggaaaauuuucagcaaaaggacuaauacagagaggaugaggguggaagauuuguguaaccguuggguauugcaacaaaguacaguauugcaacuaaaaugauggaaggagaaaaauggauaaugugugggcaauagauggguuuuaaagacuacugcagaggaaaaaaaaccugacacaccagauaguaaaguguuaaauaagaaaauggguaacucuaggauuuaaaaaaugugaguagaaagguaaccaguagaacaauaauagaaauaucaacucccccucaauuucuaaaaauuaaauggaaaagaaggguaugcauuucauaaugaaaaacagcuauuacaacaaaauacaaauaauuagaaaauauugugauagaguugagaccaaauacauuagucuuaagcaaccuauuaaaaaaggauuuucaauuuggcuuguaaaacaaaaaucuugggaugacaagagacacaucuaaaauaaaaugauuccgaaaagcuaaaaauaaaggguuagaccaaaguauaccaaguaaauggaaacaaaaaucaagcaggaguagugaugcugauaucagacaaauaguauucaagccccaaaguauuacaugugauaaaggacacuuuuuaauuuauaucuuauggagguacguauacauaaaauuugcucccugcuaaugagaacuguaugacauguucacaaaaauugauuauguauuaggucacaaaggaaacaucaaugacauucauaacauagaauauuacuaacagguugcgugcaguggcucaugccuguacucucaacacuuggggaggccaagauggaaggauugcuugagcccucgaguuugagaacagccucggcaagauagggagaaccuguaucuacaaaaaauaaaaacaauuagccagcugugguggcacacaccugugcucccagcuacucaggaagccaggguggaaggaucacuugagccuaggagauugaggcugaagugagccgugauuuuaccacuccacuccagccugggcaacagaaaaagacccugucaaaaaaacaaaaagaaaauaaauuuccagcucagaaaacaaaaaaagaacaacaaaguaagugaaaagaaaauacuagaaaggaaauaauaaagauaacagaaauuaaugaggaaaauaauacuuuuuguccgagcaaucccauuucuaguaauuuauaccaaagguaccccuccaacaauaugaaaauacauguguucaauacuuacuagugauguuuagcuuguuucugucugcuuguuauuccuugcaguauuguuuguaauugcaaaauauuugaaauaccuuaaauauacagacguaggagaggagaguguugaauacgcuaugggaaauccacacgguaauauuuugcagcuagaauaaaggaugaggaaggauuaauucagaguaauuuccaguacauucuauuaagugaaaaaagcaaagucccaaaguauaugccaccuuucauguaagaaaggugugccagguguaguuuauuggcucucaucuucaaauuuaccucuuuuuccugcucuguaaaaauggaccuuggccuuuuaaauacuuuucuuuugccaacuagcacauccuuaagcuuugucagugaagggcaauggagagacuucucaggagucucaaagguuuugcuuccugaucugaugugcuggcucagcaggauccugcagugcacacagcuuccccagugcccagcuccugcaauacacugcagucugaagcaccccgcgcccagcagcuuuccugccaaccccauuucccuccacagcuccccugaacagguuuuccuagugcccuugaggguggauuuccagcaaguuccacugaugcaguaccauagcaacuucuuucuccagcucgucuggaucucuguccaggaagaaaaaaggacuucccugcgcucuuucucagcccuagggguagggugcuccuucuguuugcuauuauucuauacuucaguguucccuuuuacugcuuccuugccaaucccucauuauuccaauccucuguuaaaguuauugaauccuuaaccuuuguucaaauugcuguucuuuuuuucuuccuaauugaacucagauugauacaggagauaacagaguauacacaaauaucuguuuauuugaacaaaggaaauggaaaggacaaaccaaaacuauagagacugauugccugcaggggugggugggaaagggguggaaagaagggagggaaugggaacagguuaguaggaacaaagagggagugacacuuuugacucuuaggaucauaguaaugugucacauauuuuucacacaccccaaauguaaucagacaauuaaaaccaacuaggauguagggggaacccaaaacugaauucaaaaacuaaaaaauaaggcuaguuguauuacggauguguaauauaacaccacugaaaaggguggggaagaaagaacuaaagucuguauuaaagccugucuuuuuuuuuuuuuuuuuuuuuuugagcacuucaugaauuugcauaucauccaugcacaggggccgugcuaaucuuaaauauauuguuccgauuuuuaaauaauaaaaugcuaccaaaagcguaucuugauauaauguaaaggugaagacagaacuguuuauaauuuaguguuucucacagggguauagguuagcaauucuguaacuauuuuauguauuuacuagaauugaacaaaucauagguugccaacagugaaagcuggauuucucacuuguggagaaagacguuauaaacaaggaaauguuaaaggcuaaaaugaauccugugguuuuaguuugggaucagaaguaucaguauaaacucauaguuuuaaauguaugacaguaaaauacagaaauacagauauuuauacauguauagguuaguauacauacauauauuuccugccuaucucagcugagaggccuagaagcagugacuccaguaacaaugagaacgccuagaacccagauacuggucucuaaacaccuuuuuccaguaaaggaacuagggcucuuacaagugguugauuccggggacgagacaagaaaaauauaggaugggccuugagcaucuuguggugccggaaaguaagggaauauuaaaaaaauaaaaaauaauuuuaaaaaggagaggacuugcugaaagaacgggagcuccuaaugauaaagcuguaccaauuugaacaacaaaauagugauaguauuagauuuuaaccccagaauaaaacaauuaucuguagguucauacuaauagaaaugaugaaauaaacagaugggaggaaagaggcaggucuuccucaaaauauaauuccaaugaauaaauguagaagauccaaugaauaaauguagaagaaaguaaagacagaauugcuauuaggcauacagcacaguaauaaauguugcagacauaaucuaucagugaaugcuaaaauucaugggugaaguuugaggagaaacaagauuugcauagugucaaaguaucucccccaaaauauuuaccaaguucauagaaaauaaggugucuuucuggugcaggaaccuggcagacagaaacaagcuaaacaucacuaguaagaugucauauuaauaucaugaacaucuugauaugauauaaugagaagggcaucauuguaguauucuuaccaaaaugcuaaauuuauuccuaucaugaggaacuagcggucaaacccaaauugaaggacauucuauaaaauaacugauuagagcucuuugaaauugucaagaucgugaaagauaaggagagacugaaguauuuuaacaaacucaaggagacuaaggaaaaauaacagaugccaugugggauccuggauaggaaucuggaacagaaaaaaaaaaaaacgaguaaauuaaaaauugugugaaauuuuaaaaaggcguauagcuaauaauauuguguaagaauuuauuuccuguucuuaauugucucaugaucaaguaagauguugacauaagggaagcugaacaagagauagaagggaacuuuuuccugcuuuugcuacuuaaaauuaguucaaaauaaaaaaacuugaauguuaaauauguuuuugaagcccgaauaacaaauguugaacuuugauuuuuuuuuuucuuuuacaucuacaacaggguuagaaaaagguucuuggaacaucgggaagaaaccauuacaauagaucgagccugcagacaagaaacauucguuuaugagaugguaauuaagagucucaucuuuuucacccuuuucucuuaaaacaguaaaccgacauuggcugaggguuaguaaugacaguaugguagcuuuauacuggauaugcuuaguugaaaacaaacuagagaaacuccuuugagucugggaacuagugagagaagaggacccuuagaacucaagugaccacauguuugacuuuuucagaucucugccuuuauucuuguuugguuuuaucuugcuuucgguauuaggcuaaauuuaugccuuuucacuacccuauuucuggucuuuuuguucugcuccugauuuugguuuaaccacauucucaauccucaucuauuaucucuuguguaaaacuuugggaaaauuuaagaugaugacucuugaggaauuaggagcuaguagacacgauagguucagaaucaaugugcuaggcacugugcuggcacuugaucaugcauacgggcaccuauugucucucccacuuauuuuacuuuuauugugguaaaauuuacauaacauaaaauuuaccauuuugaccauuuuaaaguguucaauuaaguggcaauaaguacauucacaaugcuguaaaucaucaccauuuccagaacuuuuucaucaucccaaacagaaauuccauaccuguuaagcaauaacucaccaguuuucccuccugcagccccugcuaaccucuauucuaccuucuuucucuaugaauuugucuauucuagauaucucauguaaguggaaugcuuuuuuguccuuuucuguauggcuuuuuuuuuuuuuuuugaaacagagucucgcugugucgcccaggcuggagugcaguggcgccaucucggcucacugcagucuccgccuccuggguucaagcgauucuccugccucagccuuuuaagcagcugggauuauaggugccugccaccaugccuggcucauuuuuguauuuuuaguagagacgguuucaucauguuggccaggcuggucucgaacccuugaccucaagcaaucugccuacuucggccucccaaagugcugggauuacagucgugagccacagcacccagccuauggcauauuuuacguagcauaauguuuuauagguucauccauauuguaacguguauuagaacuuccuuccuuuuuauggcugaauacuaucuauuguauguauacaccacguuuuguucuauuuauccguugauagacauuuggguucuuuuaucuuuuggcuauugcgaauaaugcugcuaugaaaauugguguacagauaucuuuuuaaguccuuuuucauuuauuuugcgucugccccuaggaauggaauugauggauuguaugguuaauucugagaaaccuguuuuucauagcaaugauaccguauuacauucccaucaguaaugcaugaagguuccaauuucuccauguacuugugaacauguguuuucuagcuuuuuuuuaauaauagccauccuugugggugugaaguaguaucucauugugguuucgauuugcauuucccuaauaacuagugaugcugaacaucuuuuuauuugguuuuuggccaucuguauauuuucuuugaaaaagaucuauuaaaauauuuuguccauuuucaaauuggguuguuuauccuguugaguuauaaagaguucuuggccgggugccauggcuaacgcuuguaaucccagcacuuugggaggccgagguggguggaucaccugaggucaggaguuccagaccagccugaccaacauggcgaaacccugucucuacuaaaaauacaaaaauuagccgggcgugguggcaucccccuguaaucccagcuacucgggagacugaaacaggagaauugcuugaaccugggagguggagguugcugugagccaguaucaugccacugcacuccagccugagcaacagaaugagacucugucucaaaaaaaaauuagccgggcgugguggcaggcgccuguaaucccagcuacucuggaggcuggcaggacaaucacuagaacccaggagguggagguugcagcgagcccagauugugccauugcauuccagccugggcaacaggagugaaacucugucuaaaaaaaaaaaaaaaagaguucuuuguauauucuggauucuagacccuuaccauauaaguaauuuaaaaauauuuuaucccauucuauauguugucuuuuuacuuacuuuucuuucuuuuuuuuuuuuuuuugagacagaguuuugcucuuguugcccaaccuagaguacaauggagcaaucuuagcucacugcaaccuccaucucccagguucaagugaugcuucugcaucugccucccaaguggcugggauuacaggugccugccaccaugcccagcuaauuuuuguauuuuuaguagagaugggguuucaccauguuggcuaggauggucucgaacuccugaccucaggugauccaugcgccucggucucccaaagugcugggauuacaggcgugggcaaccacagucagccuuuuuacuuucuugauacuguugcuggauguacaaaaguuuuuaaauuugaugaagucuaguuuaucuuuuucuuuuguuguccuugcuuuugaugucauacuuaaaacauugccagaugcagcaucaugaagauuuucccauauguuuucuucuaggaguuuuauagcuuuagcucauaaguuugucuuugauccacuuugaguugauuuuuauauaugauguaagguaaggguuugauuucauucuuuugcauauagcugucuauuuuuugcagacuguccuuucccuagugaaugaucuuggcccuuuuguccaaagucaguugaccauauaaguuucauuguuacauucuaucggucuagauucuaaccuagaacuacacuguuuugauuacuuuggcuuuguaguaaauuuugaaaucagggagugugaguccuccaacuuuguucauguuuuucaagauuguuuugacuauucagagucccuugaaauucccuaugaauuuuaggauggguguuucuauuuuuggaaaaaaugccauugggauuuugauagggauugcauugaaccuguagauuacuuugggggaguauugagaucuuaaugauaccaagucuuccaauccaugaaugagauuucuuuccauuuauuuagauauuuaauuucuuacagcaguuuuuuuuuuuuuuuuuuuugagacgaaguuuugcucuuguugcccaggcuggagugcaauggugcgaucuuggcucaccgcaaccuucgccucccggguucgagcgauucuccugccucagccuccugaguggcugggauuacaggugcaugccaccaugcccggcuaaguuuuuguauuuuuaauauagaugggguuucuccguguuggccaaacuggucuccaacucccagccucaggugauccgccugccucggccucccaaaaugcugggauuacagacgugagccaccgugcccagccuaucagcaguguuuuauacucuuuauguauacaacccuuucacuuccuugguuaaauuuaucccuaaauauuuuauucuuuugaaugcuauuguaagugaaauuguuuucuuaauuccuuuuuuuuuuugagacagucuuguucugucacccaggcugagugcaguggcacaaucuuggcucacugcaacuuccgccucccggguucaagugauucucaugccucagccuccugaguagcugggacuacaggcgcccaucacaaugccuggcuacuuuuuguauuuuuaguagacacagaguuucaccauguuggugaagauggucuugaacuccugaccucaggugauccacccaccuuggccucucaaauugcugggauuacaggcgugagccaccgcacccggcccuguuccuauuuucuuuaguguuuuuaucaugaaaggguguuagauuuugucaaaugcuuuucugugucagucgagguaaugaucuguuguuuuuuuuuuuuuuuugccccaucauuccauuagugugguguauuauauugauugacuugcuaauguuaaauuacccuugcauuuugaggauaaauaaauuccacuugguugugggauucaauaaaaauuguaaucauaaaaaguaccuuuucuuaucauaacugaaugacauuagaaaucaauaacagaagaaaaguuggaaaauucacaaaaauuaaacacauuugacaaaagccuuuucauaugcuucugaauuugcuuugcuaguauuuuguugagauuauugcauuccuauuuauaaagggauauuggccuguaguuuuccuguagugucuuugucucacugugguaucaagauaaugcuggccucauagaauguguuaggaaguguuuacuccuuuugaaauuuugugaaagaguuugagaaacucugguauuaauucuuuuaauguuugguagaauuuaccagugaagucaucugguucugggcuuuucuuuguugggagguuuuucauugcugauucaaccuccuuacuuguuacaggucuauuuagauuuuuuauuucauuuugaaucaguuuugauaguuuguauguuuccaggaauuuguccuuuucaucuagguuauccaauuuguuggcaaacaguaguucauaguuuucucuucuaauccuuuuuuuccuguaaaaucaguaguaacgucuccacuuuuacuucucauuuuaguaauuugagccuucuuuuuucucagucagugcaguaaaaguuugucaaauuugauguuuucaaagaaccagcuuuuguuuuuauugauuuuucuguauuuucuauucuuuuucacuuaucuccacucaucuuuauaauuuucauuuuuuuugcuagcuuuggguuuaguuuauucuuaauuccuuaucuaguuauugagauuguucuuuuauauaaaguuauacagccauaacuuuuuaaaaucacucuuuuuacuauaucucccuaaguuuccuaugcugugauuuuugucgaguguuguuaaauuuccacauacuugugaauuuuccaauuuuucuccuguuauugauuucuaauauucacuuaaugaucagaagaguuacguuuauuacuuuaauuuuuuuuaauuuaagauuuguugguguauccuggagaaugguucacaugcacuugagaagaaccuguauucagcuguuguuuggagaguucuuuguauaucuguugggucuaauuguucucguuguucaagucuccuguuucuuuauugaucuucuaucuaguuguucuacccguuauugaaagugggguauuaaagucuccaacuauuaccauagaacugucuauuucuucaauucuguuggcuuuugcuucauauauuuuauuuuacuuauguuuuuugagauagggucuugcucucuugcccaggcuggagugcgguggcgccaucacugcgcauugcugccucaaccuccugugcucaaguuaucuucccaccuccaccucccaaguagacaggacuguaaacuugcgccacuaugcugaguuaaguuuuuguauuuuuuguagagauggcguuuugccguguugcccaggcuggucuugaacucuuggacucaagcaaucugcccaccuuggucucccaugcuucuuauguuuuagaguucuguuggcuuuauauaaguuuauaauuguauauaucuucuugcuggauggcaucuuuugccaauauauaauauccuucuuugucuauugaaaccuuaaaaaauuuuguuuuuagaggugggucuugcucuguuccccaggcuggccucaaacucuuaggcucaaguaauacucccacaucagcuuucugauagcugggacuacaaacacaugccaaaacaucuuauuuuucuguaacuuaaggauuacuuuguuuuuuuugagacagagucucacucugucacccaggcuggagugcaguggcccgaucucggcucacuguaauuucugccuccuggguucaagugaaucuugugccucagccucccgaguagcuggaacuacaagcacccaccaccacacccggcuaauuuuuguauuuuuguagaggcaggguuucaccauguuggccaggcuagucuggaacuccuaaccucaagugauccaccugccucagucucccaaagugcugagauuacaggugugagccacugugcccagccaggauuacaauuaaaucuuaaaauugaaacaacuuacuuuuaauuauacacaguccucaaccuacugugguuugacuuaggauguuuugacuuuaugauggguuuauuggggucuuaaaugcauuuuccacuugugauguauuuuauuuaugggguuuauuggggcauaaucccaucauuguugaacauuugugucaguuuuguuucuauaauauucaaauacucugcuuccacaucuuugucugucccucuuuggguugucacagauuaugucuuuauauauuguguguccauuaacauaaccuuguaaguauuguuuaauccauuuauuuugcaaucauauaggaaaaacagaaaaaucguagaggagugaguuacaaaccaaaaguacaauaauacuggcuucuauauuuaccuguguuguucccuuuagcaguauucuuuauuucuucuuauggcuucaauuuacugucuagugucuuuucauuucagccugaagaauccucuuuaacacuucuuacaggucaggucugcugguaguaauuaauuccccuagcuuuuguuuaucugcaaaugucuuaauuucuccuucauuccugaaggauaguuuugccaaauacagaauucuuggcugacagguuuuguuuuuuuucuuucauggguuuaaauaugucacccaaaaaagaaaaacaaaaguaaaaaaauuuaaaagcugaacacagugguggguucccauagucucaguuacugagaagguugaggcagaaggagcacuugaucccaagaguuugaggccaaucuaggcuacauagauagauagauuuaaaaaaucagggccgggcgcgguggcucacgccuguaaucccagcacuuugggaggccgaggcgggcggaucacgaggucaagagauugagaccauccuggcuaacacagugaaaccccgucucuacuaaaaauacaaaaaauuagcugggcgcgguggcgagugucuguagucccagcuacuugggaggcugaggcaggagaauggcaugaacccgggaggcggagcuugcagugagccgagauagcgccacugcacuccagcuugggcaacagagugagacuccgucucaaaaaaaaaaaaaaaaaaauuggucagucaguccauccgucuaucugcccauucucugguuucuuaaccuccauguuuucugaugagaaaacuccuguuaaucuuauugaggaaucugauuuucuuuaaguauuugguuuccuuuagcuaacugaacacauuuuuaaaguugauacauaaugauuguacaaauuucugggguacucauugagcacauuuaagucaguugcuguaacgucuuuuuuuuuuauuuaacguuauuauuauuuuuuuaauuucauuuucuucauuuuauuucauuuauauacccugaagugggaugacugaaucauguaguaguucuacuuuuaauuuuuugagagaccuccguauuguuuuccguaauagcuguaucaauuugcauccuugccaacagugugcaagaguucccuuuucuuuuuuuuuuuuuuuuuuuuuuuuaguauuuauugaucauucuuggguguuucucgaggagggggauuuggcagggucauaggacaauaguggagggaaggucagcagauaaacaagugaacaagggucucugguuuuccuaggcagaggacccugcggccuucugcaguguuugugucccuggguacuugagauuagggaguggugaugacucuuaaggagcaugcugccuucaagcaucuguuuaacaaagcacaucuugcaccgcccuuaauccauuuaaccuugaguggagacagcacauguuucagagagcaggggguuggggguaagguuauagauuaacagcaucccaaggcagaagaauuuuucuuaguacagaacaaaauggaaucuccuaugucuacuucuuucuacacagacacagcaacaaucugauuucucuaucuuuuccccacauuucccccuuuucuauucgacaaaaccgccaucgucaucauggcccguucucaaugagcuguuggguacaccucccagacgugguggcggccgggcagaggagcuccucacuucccagaaggggcggccaggcagaggcgcccccccaccucccggacagggcggcggccaggcggaggcgcuccccaccuccuggauggggcagcuggccaggcaggggcugccccccaaccucccucccggacggggcggcuggccaggcgggggcugccccccaccucccuccgggacggggcggcuggcugggugggggcugcccccaaccucccucccagacggggcggcuggccgggcgggggcugccccccaccucccuccgggacggggcggcuggccgggcgggggcugcccccaaccucccuccuggauggggcggcuggccgggcgggggcugccccccaccucccucccggacagggaggcuggcuggacggggcggcugccgggcagagacgcuccucaccucccagacagggcagcugcugggcggaggggcuccucaccucccagacggggcggcugccgggcggagggccuccucacuucucagacggggcggcugcugggcggaggggcuccucacuucucagaccgggcggcugggcggagacgcuccucaccucccagaucggguggcggccgggcagaggcgcuccucacaucccagacggggcggcggggcagaggcguuccccacaucucagacaaugggcggccgggcagagacgcuccucacuuccuagacgagauggcggccaggaagagacgcuccgcacuucccagacugggcagccaggcagaggggcuccucacaucccagacgaugggcagccaggcagagacgcucuucacuugccagacgggguggcggccggguacaggcugcaaucucggcacuuugggaggccaaggcaggcggcugggagguggagguuguagcaagccgagaucacgccacugcacuccagccugggcaacauugagcacugagugaaggagacuccgucugcaaucccggcaccucgggaggcugaggcuggcagaucacucgcaguuaggagcuggagaccagccuggccaacacagcgaaaccccgucuccaccaaaaaaauaugaaaaccagucaggcguggcggcgcgcacccgcaaucccaggcacucggcaggcugaggcaggagaaucaggcagggagguugcagugagccgagauggcggcaguacaguccagcuuuggcucggcaucagagggagacuguggagagagagggagagggagaccguggggagagggggagagggagagagggagagggagcuaacgucuuuguuuaguggacuuuuauuuaugugcgaauguaacuauugccuguaggaauaauuaauugacacuuugacuaguaauuccaaugucugggcuuccucaggguugguuuugucaaauucuuauuuuccuaagaguuguccauacuuuccucuuuuuuugugauuuauauguuuuuuugagaacuagacauucuagguauauuuucucuugugcauggcuggagcugccugugacuuuuccaaacgauuauuguagcacguguauuacuuguuguacguggucacugauguuucuguuucauucucucugcggucaaucagugaucugacaaagauuuccuuaaauaccuggcuccaaaaagaaaaaaagcaucuugucuguaagucuuccaauauagauccugcugggggaagcugcugccaccaagagggucaaaaccaaugcacguaccuggaccaggcacucggcaucaccagaccaaccaaaacauaaaauccucaguucuuagagaacagguccccacugccugccuuggcaccagccagcuucuccaggaauuccagcugccugucucaucggcgaggggcgaaggagugagggugguaguugauuugcacacagugcuuacuaaugaaaagcagcaacuucucucgucaucaaacacuccccugauuguuguaagugucccaucagguuccagaguucccaaauaguuuauuccagucucucauuccagcuuacugguugcuucuguuagagggacuaggcccuggagcugccuacucuauuuugugacaugauucccacuuauuuuuaaaacuccugcaucuaaaccaguucagccuggccccuauuuuauauuaauuuagcacacauaaaagaucaaaauauauuaaagaugucaugguguuauaaaaagcauaggguuuagagccaaacaaauccguauuugcguccuaacucugguaugaccuugaguaaaucacugaaccucugagcuuuaucuguaaaauagcuuucacaggaauauuugauaaggaauguaaaaauguaacuggaaaugccaguguuauaccaacauuaguugauacuccuguuugcucaucaacugcuaaguacucaguaccacacaucuuaucagaugcauuguguacacauucccagcaacaguacaguaaguauuuucugguucuguuuguuuauugaaagaagaugaaacuaaagcuuagagaugucuuaacaguuuucccagaguauaauuaggugucaaacccaaggcugcuugacucgaucccuugcugauagccauuguaccacacugcaucuuaucugaguuauaguaucugauuucagugucucuuuuucuuucuucaggagucacaugccauaggaaaaaagccugaaaauucagcagacaugauugaagaaggggagcuuauccuaucugugaauaucuuguacccuguuauauuucauaagguaaguaguaaaaccuuuuggauuuuauggauaauaguaacuuuuguaaaaguguuuaauuauuugaagagucauauuccuaugcuuacauuaaaaauaaacacucugggagugguggcucaugccuguaaucucagcacuuugggaggccaaggcaggaggaucacuugaggccaggaguuugagaccaaccuggguaacacagugagaccuugucucuacuaaaaaucaaaaaaauuagcuaggcaugguggugcacaucuguaaucccaacuacuugggaggcugagguggggagaucacuugagccuaggaauucaagguuguaagcgagcuaugauugcaccacugaacuccagccuaggagacagcgugagacccugucuaauaaaugcaagcauaugcugccuaucugaugucuuauuuuuagaguugacaaucuauaaucuugugccaucuguucuaauaaggaauauuggaaauaaggucaaauuucaaacaaucucucgauccaguaggauuacagguauaguauugaaauauaugccugauuucugcacuagaagcaacugaaaguauauguaaauccauaaugauucuaauucuacuaauucuugagggauuuuugcagaauagguggcuaauggaggaauuagccuauguucacuaauuuagaauacuugggaaguuauugaacuaaccagagacagcucuucuuugaugaaaauacagaacauuauuaagucaaggguaucuaggaaucucuuaggagaaagaacucuuuccuaggccagaguguauauauucuugauuccuuaaauagaugugucauaaauucugaugaguugucauugaaauauuaauauauauauaaguugcacuuaugaauaaauaggcuuuuacaaagcaucugggauguaguuaauacuaaucuuauuugauuaagaucucaaauugcuggcuggguguaauggcucacaccuauauccucagcaccuuuggaaggcugaggugggcugaucacuugagcucaggaguucaagaucagccuagacaaaguggcaaaaccucaucucuacaaaaaauacaaaaacuagcuaggugugguggugugugccuguagucccaguuacuaaggaggauugcuugagcccgggaggucaaggcugcagugagccaagaccaugccauggcacuccagccuaggugacaaaaugagacugucccucaccgccacccccuucuccccagaaaaagaucccaaaugaccaaucauaaaaagaaaccaaaccaaaguaugaaucuggguuuauaaccucagguuacaguauagauugccugaccucaaugaaguaacuuuuaggaaauuuuaagacagucuugcuaaaugaaguuacauuccaguggaucuuaaugcucaugucaguuugguaucaucuugauuauaaacuucaguuuaaaccagaaaauuuccauggcugaguaugucaguuguacccaugggauuuuuguugguuuguuuguuuuugagacagggccuugcuccauugccuagguuggagugcagcaguacaaucauggcucacugcagcuucgcucgagcaauccuccugccucagccucccaaguagcuaggacuacaagcauguaucacaacgcccagcuaaccuuuaaauuuuuuguagagaugggguuuugcuauguugcccagguugaucuugaacuucuaggcucaagcaauccuccugcuucggccucccaaaguguugggauuacaggcaugagccacugugcuuggacauuccaugcuauucuaauuuauggagaugacugagugaugacauggagaggcuauaaugccuuugaaaggagauuuuuauuacauuuccuuagaggagggggcacaccauguagggccacaggaagaagcaucauucucauuuaggaggcugaaaggggagaggggaaggcauagaccacaguuuuuauugggguuucugugggaaagacaagguagggaagaguaaacaguuuaggauuggcuaguucgaacaauuccaguagguuugguggcagaggggcugucccuuguagccuggugcuuggcccuggguggauugagguugagggaauaccaggggaaauaguggcuugguguguaauaaaggaggugguuucagaguggcucuggaucacaggggagauguaaacaauuuugaccaugaguuuggcccuauaauuauuggaugugaaaauacagagcaucaaguuauggggacaauuuaaaauuaagaaaaccagcaauuuaauuuugaucuagucaugacaggauuuguaguuuuaucgcuuugucucuaaaugaacacuuauuuauucuuugacuuuuagcacaaagaacacaaaccauaccaaacaaugcugguguugggcagucaaaaacucacacaacugagggauucaauucgaugugucagugaccuccagauugguggugaauucagcaacacuccugaccaagccccugagcacaucagcaaaguaaggugauuuccucccauaaaacaaaaggaaauaacaagcuaagaaaauagcgauuacucuagcugguucauaaaugucccaguaaauccuuuucuucuccugcgggauuccaucaaacuacacuaucucauuccuucccuuuaucaccggaacuuuuccaaagaagaggcuagacucuguuuugauuucuucaucucucauuuguuucuaaacuauuguauggagacuuuuccuucugggcuaauagugaccaccuaauuuucuuuuuuguuuuuuuuuguuuuuuguuuuuuugagacagagucucgcucugccgcccaggcuggagugcagugucgccaucucagcucaauagugaccaccuaauuuucuaagcaguuggucacuuuuccauuuuuauguaacuugaccucacuguagcauaugacuuugcuguucauucacucguuugaagcucugucagaguugugaucugucaugauugugcccagcaaaaggcuggagucgaccugagagccucaaauaguuagcacccauucuucaccuuucgcugcccaaggaccaauacccaacaaggagagagcauaugaaguugguccuugcugguguuuccccaauguguugcucucaaaaggaaagagaagcccugcauacccccuggauaaggauggaaagaagcagugugguagacuggcuacccacaauguuuucagaaaggaucauuuaccuaauaaagcaggagggccuugaucccuuccacauuucaucauagggcaggauugaacuaaaccugcuacaacucuggcagagggccucagguuuacagggccauuucaggggagggauagcaucuccuagagauaaguaaaaagauauuuggaacaacaaggauggagauaguguuuggacaagaaccaacacaaucuccuuuuuuccuggguccuguuccaccagccacauaaauguugguauaacugagguuucauguuaacuuuuuuuuuucucccuaggcugacauauaaggccuuuuauaaugaugcuucccaaauuaacuuucugaacuguuuacuugcugccuuuacaccucauucauccauagugaauuuguguauuuucaucaguguaccauacuuuuucaugucucugaguauuugaacaugguaggaagcccuuucccuacuucauccguuuugugaguucauccucagauuuccaaacccagcucaaaacucaccaauuauaugcaauuuuucuugacuccuuucuuuguuacccuggcaccuuuucuuuuguccauuguaguauguauuucaguaugcugauucaguguaauguguguccgucugcuccacaggcugacuauauucguuuuuggugacuaguguggagacuagcauauggcucacauguagauuucacuuaaguaccuguugaguuaugcugaaaaugguuuuuagauauuuagguucuucaggguugccaucucagugcuuuuggagagaaacaauaggauaagaaaaguagaauuucaaaauuuuacgcggagcaggaaauacgagauuuaucuuuuucuuucuuuuuuuuuuggauggggcucuguugcccaggcuggagugcgaugaugcaaucucggcucacugcaacuuucaccucccaguuucaagugauucucgugcuucagccucccaaguagcugggauuacagguggccccacugcgcccaguuaauuuuuguauuuuuuaguagaaacgggguuucaccauguuggccaagcuggugucgaacuccugacuucaggugauccacccgccucagccuccuaaagugcugggauuacaaggugugagccaccgugccuggccaagauuuuucuuuaaagcagcgguggcaaucuucugcaaaguuuuuuaaccuugucaaaaaaaacguaagauguaacuguuaaauaauaagaucagucuaagaagaaaaaucugaauuuacccucuucacuccaaccaucugaacauugcucaaagcaguuugagucagaucugggaaucggucuuaccuucaggaaacccuggagaauguuugucugucuguuuuuuaaucaaguccagucugggcaacaacucacuguguugcccagcagaagguuuuaaccaggcuuugucaauuuacuuggucuguacauugcugcugauagcuucggaaguuuuuuaagcagggauuaaauaacccauaauuguauuuuaaaauguuuacauaucuccuguuauauuguuucugucucuucuauuauuauuauauauauauauauauauauauauauauuuuuuuuuuuuuuuuuuuuuuuugagacagaauuuugcucuucuugcccaggcuggagugcaauggcaccgucucggcucacugcaaccucugccucucggguucacacgauucuccugccucagccccaugaguagcuggaauuacaggcaugcaccaccaugcccggcuaauuuuuguauuuuuaguagagaugggguuucuccauguuggucaggcuggucuugaacucccaaccucaggugaucugcccaccucagccucccaaagugcugagccaccaggccagucagggaaguuuauuaguggaugacuuuugauuuaaauggaaaacauuuuuguucuuuuagaguucaccuuguaauuaauaauuaugccaaaagauaguaaguugcuuaaaucaccuaagaugaaguuuuauggcaguguuuuguaaaacacauauauauuaaacuucauuuuguuuccaaaauaauaguuauuuuuuuagaaccuuuauuuuggacccugcuuaccucuuugaggguguagaaauauauuaaguggcagauuuuguauuguagcagcuagucauaugacauuaaguacauuauacuuaauguacauaaucuccauaacaaccuaugaggaaaguaaaggcuuuacucacauuuuacaugggaaaacagugugagugagauuuagugacugguccaagaagaaacaacauagccagucuugcaggagugucugaugcgaacacaagauaaucuguaagugggggaaugaagacaagaaagaaaaauggaagcuucaaagaacuaggagaaaaauuaaaauauuacgguaaaauuauuuuaguaccugaaacauaucuccuauacauaaauugcuuuugaucuucaccacaauccuguaagacaucguggcagauauuauuauucucauuucacagaugagaaaacaggucugagaagugauugcuacauaccaaaaucacaaagcuaguaagugguagauuaaggaaaagaacucaggucuucugacccucauucaggagucuaaauagaaggugaaggaccaguuuaacagagugcuucucaacucugguugcauguuuuuuucuagagagcuuuggaaaaauacugauccccaaagauucuuaauuaaugagucugaguugacacuuguguuugguguuuuugugauuugauuuugcagucaggauugagagccacuccuuugacggacacugugguagaaugaguuaagaacccuugaagguuccaaccaguugugguacaacuacaguaccuggggcaagauugcuugaguaaaaauagaaauucagauucugucugccuaagaguuacugaaaauauaaagagagaauuuuuguaaaaacauugcaaauacaaaaaaaugccagaaaaacauagcucgaugaucauuguuacuacuggggaaacauuaaagauaggacuuuguuuagguuuuaguucuaguauccaacacuacuuacugcucuguaaguauaauaaaauaaugauguuuauuugauuucuaauuggguuccuuucaugaaucucaggagaauauacacauuuagaucaaacguagugauuauaacagcaauaggguaaaauugaaaauaguagcaguuuuuuaacacauauuagugugauuuuaugauauaucuauuuugaauuaauacuuagagcaauuucaucauuguuaauaguugauuuucucucaauacaaucuguuuucuuguaggaccuauacaaaucagccuucuuuuauuuugaaggaacauuuuauaaugauaaaagauacccagaaugcagagauuugagcagguauaguuuccaaaaaucuucucaaagucuuuccuauuucuaguuaucaaaguaguguuaucuccacaaauccuauuauuggccuauuaaggaccuuugccaaggaauuauugauaaaucuugucuuuugcauuacauacauccaaaaaaaauuagccagacacaguagucccagccacuccggaggcugaggcaggagaaucuuuugaggccaagaguucaaggcuguauagcaugcuauaaucucgccugugaauacccacugcuuuccagccuggguaauauagcaagacucugucucuaaaaaaaaaauaaauaaaucaccuuaacaugcauuauuagucucuggccuuuacauauaaguaauaguggcaaauuaaccuuucacuauuuuuucugccuauccagcauauacuauuguuugcccuaggugauggugauauauauauauugcuuaaguacauaauauaggaaaaaucuguaagcucauuuuaaugagaccauacuuucauuaucaaugucuuaacaauuacaguauacaaguauauauauuauuguugcccuuuuuaaaaaaaaaaaaugaaaaagucucguucugucacccagucuggaguaugguggcacgaucucagcucacugcagccucugccucccaggucaagccauucucgugccucagccugccaaguagcugggacuacaggugugugccaucaugcccagcuaauuuuuguauuuuuaguagagacaggguuucaacauguuggccaggcuggucuugaacuccuggccucaaguaagccgacugcaucggccucccaaacugcuaacguuacaggugugagccacaaugcccagcauauuguagccauuuuuaaucuguauucuaacccaacaguucaaaccuauugguuucagcauuuuuuuuuuuuuuugagacaguuucgcucuuguugcccaggcuggagugcaauggcgcgauuucggcucaccacagccucugccuuccaguuucaagcgauucuccugccucagccuccccaguagcugggauuacaggcaggcaccaccacgcccggcugauuuuguauuuuuaguagagaugggguuuuuccauguuggucaggcuggagucgaacucuggaccucaagcgauccgcccaccucggccucccgaagugcugggauuacaggugugagccaccaugcccagccuugcauuucuuuauacuauaaauaauugaagaccccaaugagcuacugcuuauguggguuauaacuaucacuauuuauaauauuaaacauugaaacuaagaaguauuugaaauauuaaucucauuacauacuaacauuuugugaaaaauauuuuucaaaacacaaugaguggcauuguuacacauuuugcauuuaagcuaaagugaugcacaucauguaaccugcagaaaacugaucccuuaugaaaauucagcguuccuaaucucaacaugugucaaacauuuuggucuucaucucaagauggcaacuguccaguuaguugggugagcuagguuaaugugaauuacugcaaucacaaacuguuuucuguaguuuuuaaguuuuuguggaaaaaugauauauccuugccuuuuccccccucagaacuaucauugaguggucagagucccaugauagaggcuauggaaaguuucagacugcuagaauggaagauuucaccuucaaugacuuguguauuaaacuggguuuuccuuacuuauacugucaucagggagacugugaacaugucauugucauuacugacauaagguaggugacagcacuuaagacauuuuguuaccuuuuuuuuucuuuauuucagaguacaaaaccagagauaguuuuuuuaaaaauaagaggaguaaaaguaauaaccauugcaacuuggcuugggagcagcaaaaauacugucuucuuuccaugcaaauaccaacucuuuccauccauuugcauccucuauuguucauuauuuuggaaaaucuuuaagaaauacuuuacuauuagacgguuaaaaaucuguuaauacuuuaaaaaguaucucuauuuuguauuaaauagcuguuauucagauauaguacuuauccauuuauauauaacauugcaacuuuauuuuuagguuugucuuuuugccaaaauuugaagaagauaaaagggaauuggaggaagaguaauucuaauauuugacaaaugugaagucuuaaugcuuugacaaagauuuaaauugggaaggagcuaagauagucuaaaauaagacuuagggaugaguuauaaauuuuagacagcuaauagcucuauuccaugaauaaggcuauucauuuccucuuuauuuaggaaaucacaguuuaagaaggaauacuauguacgaauaaacccugcuccauugcugguuugauuccuuaugagagaccauuuaaaaguuuuuuguggaacaauaauguaccuguguuugaccaguaauuagaaaccaguaauuacugguauuaauuaguaauuuauuauaccacuaauagaaacugaugccugccgggugcaguggcucacgccuauaaucccaacacuuugggagacugaagugggcaaauugagcccaggaguucgagaccagccugaacaauauggugaaacccucucuacaaagaauacaaaaauuagcugagcauaguggugugugccuguaaucccagcuacucagguuaaaacgugaggauugcuugagaccaggaggucaaggcugcagugagcuaugaucaugccgcugcauuccagccugggugacagagugagaccuugucucaaaaaaaaaaaaaagaaaaaaagaaagaagcugaugcuuucagaaagucccugcuuccauuuuuggucuuacugacucuucuccaaaauuuuguaucccaugcacuccaucucaggaaacuaucagaagauguaaaagugcuucacagaaaguguaaaccaugaacaagaaagacauggaaugcaacacagaauagguuaaauagacauaaaagggauucucagaauuauggaaaagugaaaucccagugugagagcuuuacaccagacccagagauuugaucaagggucuggagccaggagcauacagaacucaggaaggaugucugggaggaaaaauagaacugguagacucccgguuguucacuguucugucagaaaauaggggacugaauucgugacagguacacugaaaauuaagcaaaugggccaggcccgguggcucacgccuguaaucccagcacuuugggaggccaaggcgggcagaucacgaggucaggagaucgagaccaugcuggcuaacacagugaaagcgucucuacuaaaaauacaaaaauuagccaggcgugguggugggcaccuguaguccuagcuacucgggaggcugaggcaggagaauggcgugaacccgggagguggagcaugcagugagcugagaucgugccacugcacuccagcuugggugacagagcaagacuccauaucaaaaaauaaauaaauaagaaaauuaagcaaaugcaaaugggagagaauuaauagauuaauagcuacaaaacaaaaugucguccaacagaugucaacuguguggcuuagguagaaguagcaguaauucguccugaauuaaauaucuguuuaaccaaaauuaugguaguucuguggugagaaguugaggagcuaaauucuaaacaaacaauuaagaauggaaaacaauugccccuagggaagaagaauggggaggcaagagccagaagaauacauaaaccuuggauuuauaugacuuuuaaaauuauagacaguacauuuaugucuuugauguuauuaaaauuuuauaucagcagccuggcaugguggcucaugccuguaaucccagcacuucgggaggccaagguggccagauuacuugcagucaggaguucaagaccggccuggccaacauggugaaauccugucucuacuaaaaauacaaaaauuagccagguguggugaugggcgucuguagucccagcuacuugggagagugaggcacgagaaucacuugaacccgggaagcggagguugcaaugagccaagaucgugccauugcacuccauccugggugacagagcaagacuguaucaaaagaaaaaaaaaauuauauaagcuguucugccugcucuuccuuucaaaugugggaaaaugugcuggccuuguaauaaacauaagauggaaggcaauccccuauucucucugauggccuuauuuuucauauauuuuucuuuuuuuuuuuuugagacggaguuucgcucuguugccuaggcuggaaugcaguggcaugaucucagcucaccgcaaccucugucuccuagguugaagcaauucucaugccuuagccucccaaguagcugggauuacaggcacgugccaccuuguccggcuaauuuuuguauuauuuauuuauuuuuuugagaccgaguuucgcucuuguugucccagcuggagugcaguggcgugaucucggcucaccacaaccucugccucccagguucaggcaauucuucugccucagccucccgaguagcugggauuacaggcaugcgccaccacgcccagcuaauuuuguauuuuuaguagagacaggguuucaccauguuggucaggcuggucucgaacucccgaccucaggugauccgcccaccucagccucccaaagugcugggauuacaggcgugagccaccaugccaggccuaauuuuuguauuuuuaguagagacgggguuucaccauguuggccaggcuggugucgaacuccugaccucaggugauccgcccaugucggccucccaaagugcugggauuacaggcaagagccacugcgccuggccuuuuccguacauuucuuauaguguaggccuauuucuauaaacaacgugauuccaaggcugaaggauaaaaacaugaccauuaaacucaugguaacuucuugauacagugaucaacaaaagaaacaugauuuguuugagugucaaagacaaacaauuuacacuuuuuuuuuuuucuugagaggggaugucacucuguugcucagguuggagugcaguggcaaaaucauggcucaaugcagccucaaccuccugggcugaaguagucgucuucccucagucuuucccauagcugagauuauaggcauaugccaccaugccuggccaauuuuucuauuuuuuguagagacagggucucacuuuguuuccuaggcuggucuugaacuccugagcucaagcgauccuccugccuuggccucccaaagugcugggauugcaggcgugagccaccacaucugcccuuuuauuuuuuuaaaugguuuacauuuauuaagaguaugcaauguagggcuuuuuaaaaggccauuuauagaagucauuuuuaucuuacagguggauuuaaucauucauugccauuccauaauaccaacuaucaaaagguuaauuauuuucugauggugaaaguuuuaauuuuaaaaaaaucaaauuuuagaauuguuagagaccuuuagaacaauuuuguguaguccuuucaucuuucagaagaaucugaagucugucaucauuuaaaggauuuacccaaagccauggagcugauuaguggcagaguagagauugacuuccauuucuuuuuuaauaaaaauuaugaaacuucuuaaagguuucauaauucugauacuuaaaacuaagauucuaccaauucauauuaugccaggagucagaauuagauuuuaauaaaggagacauuaaaaaaacaagaggcacauuguaacaaccaguuaaucuagguaaaauaucacugaguagcuuugcccaaauuauguuucauuacaagguacuaaauguuagccaggugucguggcucacagcuguaaucccagcaccuugggaggcugaggugggaggaucgcuugagaccaggaguuugagaccagccuggacaacauagugagaccgugucucuacaaaaacuuaaaaaauuaucugggugugguggugcaugcuuguagucccaacuacuggagaggcugaggugggaggacugcuugagcacaggaguuugaggcuacaguaagccaagaucaugccaccguacuccagccuggguaacagaguaagaccccauuucaaauaaauaaaaauaaaagguacuaguguuaagcaaagcaaggauucucugguagaauacauucaagaaaugcucuacauaauaacucccucuuaaggggggaucacaguguacauuaccauaaagggauuugagaagccuaaggaaagaaaaccuuguuuaauccaaaaugcucuuggagaaaguauuuuguggaacagaauuuggugaaacauggcauaacaaguaauucagcaacaucuuguaagcaaaaauugaaaguaucuauuuuccuaauacucaggcacagauauauuuaauagcucauaaaaauuugucacuuaauauuugucaccuuaauaucuuuauuuucccacgaacaaaaggcuugugcaucaugaugacugcuuggauaggacauuguauccccuccuuaucaagaagcauuggcuauggaccagaaaauguuuuguuuguaaaauguauacagccaggugagugauaauguauuuuuuuuuuucucugagaaauggcaguuuugacuuuugguauuuuguuuuccacuuuggaucuaagaauauuuguacuuuagguuauaaauaugaaguaucaucuaguagggaagugccagaaaaucaauuuagugaguuaaaacuaacauucuuaaauagucaggaaauauuauauguacacaaguccagggauaggucaaauuucaggcuuguaaaauguauacagcuaggugaauaaaaauaaaagucacuaguguuaagcaaagcaaagaauucucugauagaauacauucaagaaaagcucuguacaauaacucccuguuagagggucacagugcacauuaccauaaagggauuugggaagucuaaccaaagaaaaccuuguuuaauccaaaaugcucgagagccauguucuuucugccucuuguccacauaguuuacauaaucagcuucaucaauaaaacuucaucaauaaaaccacaguacaucacaugaaguuaaaauauaguuuuauaaaauuuuuacuuuaugugauucuacauguuuagauuauaaggcauuucuuacugugggucaguaaaaaaaaaauuuguugcuuuuggaggcugaggugggaggaucgcuugaggccuggagaccagccuggacaacacagcaguaacuauaaaaaacauauaaaaaaaaucugaaagccacucagaggaaaggaaauuuaguacagguugagcauuccaaauuucaagaucagaaauccaaaaccugaaaguguuugaguggcaacaucugaugcucaaaugaucauuggagcauuuuggauuucaaauucucagugggauguucaaccggcaaauauaugcauaauauauuuaaaaaucugaaaaaaaucugcaauuugaaauacuucuuuuugaucccaagcauuucagauaaaggauacucaacuuguaucuucaguuuguuuucgccaccccaccacaauauucuuuucugaaagaucaauaggaaaacaugauaaaucaaagugaaaauaauguuaaaagcaaacauuccaugagaugcagaauucaaacauaccauacaauagcaucuucaugccauucaacauuuugguugaauaauguugcccauauugcuauuuguauauacuuuauaacauaaucuugaguucuagguaaaaagaguuauauaguuuucaaauuaaccaguacucauuuaucaguuaagaagguauauuaagcaaaagucuaucagauuuguagcaucuaauuuugccaugguuuuucaagauggucuguuagaagaaaaugacuauauucguacuuggaggauagguaugucguggcaaaugugugaugcuuucaaauagauuuauauucuuccuuuaaggguaaguauuacagagaaacagcauucugcaguguuucuuaauguuagaugcccuuucgcuuuguagagagaguauugguggugauguauuuguaucuauguauacaaaauuaagggauuauuaugcauuaauaacagacugauaaggaaauagaauguuauauuuacauauugcuacaggucauaaagcauguuaaguauggcaaauuugauuguaaugauguacuucuuuuuuuaaaaacuacagaugggugacgaacaaugacaguuuugcaccagaggacccaugcuucuuuugugauguuugcuuccgaaugcugcacuaugauucagaaggcaacaaacugggggaauuccuugcuuauccuuauguugauccuggaaccuuuaauuaagaauagcuacacucacaaaaauacccccucaugaaauaacuguucucuuggaugguuaccuuauuucuaagaaacgccacugaggaacaggauccacuuugaacaguccgcuaaagcuaucaaaaaaaaguccaaaugacagauuuucuuauaaugauaguauuuaaauguuuauaacauaguuuaauuuuauauuuauuccagauaguauuuaauuuagugcuuuuuacccauuuugaguugaguuguaguacuuuauauauucugacuuuaaauccuuugucagacacacauauucuuucucccaauccaugccuucccuauucauucucuguccagaguuuuuugcuaaagauagaauuauuaaugauacaucaaguaguggaaguguuuugaaaauucuuugaagaaugugagagcuacaccuucuaccaugaggcuuccaagguaaagauccuucaaauaacuguaauggaaacuagggagaaugaauuauuuacaaauaagacaaaauuaauagcuuugggauuauuuauuuuuugagacaaaaucucgcucuuguugcccaggcuggaauacaguggcgcaaucucagcucacugcagccuccgccucccggauucaagugauucuccugccacagccuccugaguagcugggauugcaggcaccuggcaccaugccuggcuaauuuuuguauuuuuaguagagacgggguuucaccauguuggccaggcuggucucaaacuccuaaccucaggcgauccacccgccuaagccucccaaaauuuugggaucacaggcgugagccaccgcgcccggcugcuuugggggaauuuaaucuuagugugcuguuuaguaauguuagguuuuguuuuggaggaaacuaggcauacaagacauguuaauaagacuaugugaauaaugaauuuaaaaagaucuugaguauauacucauaacuccagaaauaacauuaacuugaagcuuuauuucuugacaaaagcuuuaugaauguuaugaguuuaaaauaugucaauuuaauacuaugauuuaaaaaacaauagcagauuucguaugacuguggggacauggaaaaaucaagauccuauugauugcuagcucuggcucacuuauucuccgguaaugauacuauuggauauauaccaaaauuauauaagcaaaaagaaaaaaaauaaguuuuccuggcccaggucuuccauucuucugguccccuuacuauaguaauucuaguuacucucaucuuauucugaggaaaaaaaaaaaaaccaaaacuuuuuaaacuuauuuuuugacauagggucuuacugugucacccaggcuggaguacaguggcgugaucuuggcucacuggagcccugaccucccuaggcucaggugauccucccaccucagccuaccgaguagcugagacaugguggcacaggccaccauggcgggcuaauuuuuuuauuucuuguagauacaggguuucacuauguugcgcagaauagucucgaacuccugaccucaagugauccauccgccuuggccucccagagugcugcgauuacaggcaugaaccacagcgcccagcaaaauaaacuuucuuuauuuucaggucuagaccaucagauagauuuauucaaauauuuucugggaaccuuuauggguagaacauuuaauacuguuuagaagacuuuuaggaauacuauagauuucaaaugcaucauuuaaaauaaauaaauuccacuuucucucuccua

SEQ ID NO: 191380 - RNA, 46939 nt, Homo sapiens
cagugcuagcgggcgccgagcgggagccgcgcgggagcagcgcagcuacggcggcggcagcggcggcgcgguugcgauuccgagccguugagacgccucugcggcagcugguggcgcagguggcuugcguggacgcggguagaggcgaccggccagcaaccgcagcgucggcgcccgcggccccggcaggugagcgggcgacggggacucgccccgccccccccucgguggcgucgcuccuggcuguagcggggaaguggacgcggcccgcccgggagccgagggggccgaggcugcagccgcugggcagcagguugcgggggaggccuugcgugggcggaagggggccgcucgcuucucggaaucccugccuuuuucucucccaugcacccccucccuuuuggggcuuaagcucgguggaaaaagcccggagaaagauggggcgggcagacgggcgauuucuggccgggcagcaucccugcuucaggugguggcgucucuucgguggcgggguggaggaccugcuccagcgcggaggcagcgcacuggcgggggaggagcgggaggcggccguccccucgcucucccacccccacccgccgguuccccucccccuccccuugcggccccucccuucgggguucuucgcuuuaaccgcccucggugcucucccuagcaggcgcgucgggacgccccgaggcauccucccccgcccgcgggcccgguagcugggcccgcguccgccgcccgcauccccgcgccgccgcaucuccucgccgccucccgggcuucggacccccggucucgcccccgaaacaugacucgcgauuucaaaccuggagaccucaucuucgccaagaugaaagguuauccccauuggccagcucgaguaagugauuuguagcccucgcgcuuagcagugcuacccuccucuccagaggccugcugcccaccgugucucuuuauuuuuucuucuguccuuucucucccucgcuuuagucucauuuguaaccugaccuuucauuuuaguuuuuugcccaauaaucucccguguaauuaugaaaauccagacguuucuacauaccuguguauuucccuaugguuuauuggcagacuuggacagauuuucuuccuaggaaauauuuaaaugcguugcuaguuaauauuccauuguaggugaaauaaugaagagugaauuuuuguuuaaaaauuagugaaacauugacauuuccauaguuuuggaucaaguacaaaauaucaauggaauuugugcagauuacacacaaacacuuggaugucagagaagugcguaugugauuaaauuggauuuacaggguuuuaaaaaaaauaccuuguacuugaugaggccuucuggauuugcuuguuuaauacagauucaggacuggauauucuugaaaguauuacaguaguuuaguaccgaggaagggccagaaaauucauuucuccuuuuuuauuugagauguuuaugaccuugaagaaguuguuuuaccuuuuuguuuccaauaggcaaaaaggagguguggaccagauuccucaguucacaucuagugguacagagaaaugauuaaggacccaggauguuuugugacauugaggaauugagacuguuuaaagaucuacgcuccauuuuuagaaaaaggguucuuuuuguuuauggugguacccaggcucucaaacagagauagauaggaccuaagauauguugcaaucaauuagauuagguaaacucaagauccuuuaaaaauauacuuacaugggguucugaaguuuuauuuuuccaagccauuuauuuucgacuaauuuacuguccuuugaaaauguauuucuuaaaaauaauuaaauucuguaguuuuaguuaugucagcaggggaaugguggaaaacacccauuagauaacggaguccugucuaggagcugagagugccauccaaguguaaaacgaucacuguuccuugacuuucuuccaucuagcugcucuacguaaacuccuguucacaaguuuccuuccaaagcuuuuuuccuugccuauaaagucugccuuuucggugcagucuuacuugaacaauccuuagucauaauccuugucuguauauuuuacauucuaaucuauuccuuucgugauaaucuuuuguuuuaauucuuaacucuguguaugcuuugaccuccaaauauauugugagaccgagggcaacaaccuuaaauggaauuuguuuauacccuccauaguccguaguauauaugaugcaccuauaaaacacaauucacguucaaauggagccuagggaaacugaucagguuuaaggccccucugauauacuuuuucauggucuucgagguauccuuguuuauuuugagguguuugaaaauaugagguugucuaauagaucuauauuccgauuugcaugccacagugaaguuaaaagccaaaggaaauguuuaaaaaaucucccaaaucacccuccccacgcucauauguuaagugacuaagagugcuacugaaaauaaaauaggguagccuuuggaagaccagaguguuuuccuuauuuaacaaguucuacauuuaacaaguucauuuggauuggaagggaaguguuugucuuuucccuuuuccccaucauuuuuucugagaaacaccuccauuuaguguugguguauucuguguccaacaguuacauuccuuuuucugucuucuucauucuuaaaaauuugaaaucuuugcuguagaguuuagaguccauauuuaaagucugagccguaaaggugacaccucuuguugcaauuuuugcuuuaacauuucugucuacaugucccaaacuucauuaauuuuuaagucuuaaacauucauguacauaaucguuuaccaguaauaauuauuuaaaaaaucaacuuaaauuuugcccggcauuugcuaaaggcuauaggugcuagguauuugcauaaacucuuuaagcuguuugcuagcagaaagaggcauaugaacuggguuaacagaaaugaucucuuaagggauuaaggauuuuugcaauuaucgggacauucccacaaaguugagauaacaggugugaucuucaucauauaaguggggaaauaggucccuagagauauugggugguaaugauucuguuggugugugaaagccuuuagacuucccucacaaaucaguucagucauccugauggucuucuucugcaacaccauaaugcuuacagaggauaguagguccucugauggucaacccccuucuuaacaaagucagcugauuuucaaauugaaguguuuuugaaauuaugaaaauuaugacauuuaaaauagauauguuguuaaauucuuuuuuuuuguuuuuuuuaaagacaggaucucacucugucacccaggcuugagugcaguggcaugaucucggcucacugcaaccucuguugcccagguucaagugauucgccucuggaguggcugagauuacaggcaccugacaccgugcccugcuaauuuuuguauuuuuaguagagaccggguuucaccauauuggucaggcuggucuugaacuccugaccucaugauccauccaccuugcccucccagagugcugggauuacaggugugagccaccgcgccuggccgacauguuguuaaauucuagcuagauaguacugcuuuaguccugaggucugcuuuuccuuuauugaugagggaaaguaacaaguauuauggauauauuagacgugacagcaccugaugauuucuuccuuacauaauuuaaaagguugaaagagcagugaaaaaggaacagguagccucaugugauucaggcacaucagugaaggaucuuuucauaguaaguuuuucagacuuugggagguacugauuuaaacuuuugucaaugucugcuuuuacauuagucuguuauuuguauagauuuccugcagaacuaacauuuaggguugucaaauagguucagacuccuuaccugaaaugauaugauuaacaauucagaauucugggauuuuaggaaggcagggagaguacauaugccauauauuuugcugcuggugcggucuggaauagcacauaauaauaugucugcaaagaaacaacaguggaaacagguggauaaaagaaaugacugauacccucaaugucaguccagguuuugccaccaaaugaguuuugacagaaauuuugguuuucagagcuucuuggguuucagauuuggggauaggagauuaugggccugcagaacuggcccauuuuauaacagaacccuuuuggauguugugcucuuguuuauucagauaaauguugagguguguaugauuuaaaauauuuuaauuuuucucacuuuucuuuuagguagacgaaguuccugauggagcuguaaagccacccacaaacaaacuacccauuuucuuuuuuggaacucaugagacguaaguccuguuagcuuuaaaggcaaaucagagcuaauuuaacaggguuauuaggcaguagacauuaauucaagggggaaaucguaacguaauaggaaacuuuaaaaucuuugaacuuuggaaagagucuuuaagucucuauuuuuaagguagcguuuacagaugcuauagguuuauuuuuuacuggaauugauauuuccuuaaccaaaaaggaaaguagaaauucucugagcaauaagaaugauugauggaugaaaauacauaaggaaaguuuuaauaagugaucugauauuccuauacaguaaaauaagugcuuuuuauaaggacuaguugguaccuaauuuuugguuuuaugauaucagauaugcaaacuguguauauuguggagaaggugagaagaggaagucuagcuaguucccuccauguguuuauauggucccugaagcucugcugccucugguggguaugugggcagagaacugaugugaagcaaauuuuucaaaaauugcagcugaauguugacguauguuacugccaagugcaugggaucacucaggaggcuaccguuaauuucccgaagaauguuccuauguaccuauaauuuaauggccuuagaaauacuauauaaucugguugauuuuggacuugaaguuuggugucugucauaauuuugguagucuuguuuaccugggaugaggagaaacaaaacuauugcuauucugauuagaauuauguauuccuaagaguggcugcaauggcaauauuugguuuaaaguugcuuagcuacuguauaaacuuucacacaaugucuuuaauagcucuauugagauggaauuuacauacaaagaaguucaccugcuuaaagugauuuucaauagauuuuaguauauuuaguagauuuuaguauauugacuaucauaaccuuuugaugaucacuuuccccucuccaaccguaaacaaccacuagucuacugucuguauagacuuaccaguucuggacauuuuauuugaauggugucauacaauauuucauaauaaguuuuuaaaaaaauacaacuuuggauccagaauugguuuggccuucaucauaauuagaguuagguucaaguguauucuauauauaacaauauaauuuuuaagaagugauaaguuucugauuccaugggauacuuuaaagaaacucuucaguaaauuuaauagaggacaaaaguaucuuuuaauggaaaauggugcaguguauauuagaguagggcuuuucaaaguguguugucaggucuagcaccauuagcaucucuugcgaacuuuaauuaaaauguaaguucuuggcugggugugguggcugacaccuguaaucccaacacuuugggaggccaaggcgggagggucacuugaguucaggaguuggagaccagccugcaacauggugaaacugugucucuacaaaaaauacaaaaauuagccguuugugguggcacacacauguggucccagcuacuccagaggcugagguggaaccgucaccugagccggggaggcaaagguugcagugagccaagaucucaccacugcagaccucaucucaaaaaaaaaaaaaaaaaaaaaguucuuaggccuuauucuagaccuacugaauaaagcugugaguguggagccaaagaccuguuuuaacaagccuuccagaugauucugauuuacguugaaguuuggaaauacuguaguaaugugaguggacauuccuuagcauuuuucaguuuuauaagcuuaaaagucuuuaauucugauuuuugucugaaauggaacagguuuuuucuuuuuuuuuuuuuugagaccgagucuagcucuguugcccaggcuggagugcaguggcaugaucuccgcucacugcaugcuccgccuccuggguucacgccauucuccugccucagccucccgaguagcugggacuacaggugccugccaccacgccaggcuaauuuuuuguauuuuuaguagagaugggguuucaccguguuagccaggauggucucgaucuccugaccucgugaucugcccaccucggccuccuaaagugcuggaauggaaccgauuuuauacuucuauauauccugauagucuuacagaauacacaguccauucuuacguuacuauuuuaaauuuagaagaggaaugauuaucccuucuccugcauuuaaaaggauuuucauauauaaauauauguacacuuuaaaccaaaacaaacuaaacuaaauaacuaaacuguuguuugguuaauagguaauuagauaguuaaugaagacagugaauuacuaauauucaagaauuuaggauauauucaaggaauucaaaugaauuuaacuuuaaaguuaagcugacaauacugaauuuucauuucaaaaugcacuugguuuuugccuuaguguucuuaugauuauaccauuuaucuuuggaaaagcagugcugccccauauguauguuggucugguggugacuucuuuuguacuuaagauuaauuuuugggcugggcgcgguggcuuacgcguguaaucccagcacuuugggaggcugaagcgggcggaugacgaggucaggaguucaagaccacuuuggccaauauagugaaaccccaucucuacugaaaauacaaaaauuagccuggcaugguagugugcaccuguagucucagcuacuugggaggcugaggcaggagaauugcuugaacccaggaggcagaggguguggugagccgagauugugccauugcacuccagccugggcaacagagugagacucugucucuaaaaaacaaacaaaaaaauacuaauuuuuggaaacuaggucucugaugaucuuuuuuccccucaaaauuugggaggguaguuauuugaaguuuuuuuuuuuuuggagacagagucucauuccauggcccaggauggaacacagcggcgaucauaguugacugcauccuugaacuccugggccuaagugauccucccaucucaacuucccaaguagcugauaacugcaguagcuugcuaauuuuuguauuuuuuauuauuauuauuauuuuuuagagauggggucuugcuacauggcccaggcuggucuccaacgccugguuucaagugauccuccugccuuagccucccaaagugcugagauuacaggcuacuuuauuuuuuuauuuuuuuauuuuuugugauggagucuccucuguugcccaggcuggagugcaguggcaccaucucggcucauugcaaccuccaccucugagauacaagugauuccucugccucagccucccaacuagucaggauuacaggcacccgccaccacacccaucuaauuuuuguguuuuuaguagagaugggguuucaccauguuggccaggcuggucucaaacuccugaccucaagugauccaccugccuuggccucccaaagugcugggauuacagguaugagccucugugccuggccuguuugaacuuuuuaguuuggauuuugcauaaauaguuuaguagucugcuaaacuagaagaaagguauauuuggaaauuguacuaauucguaacugguuuauagauuaagguuuuuuaauuguuaauuuagagcagaauucuuuuguaacugcauucuuuuccuggccuacagacgucugauuuuacuuaggacauucauaguaaauguucagcaaucaaguuuugaauauuagacagugagcccuaacugugaccauguacuagauauuuuaaaccuaacauauucagacagauuuuuaguaagugggaaugacauagacucaauucuuacugaagccaagucuugguauuauccuugauuacauguuauagucuuuccccuuccuuucuacaucuagucagucagcaaaucuuguucuuugccuuucaaauguauucggaucuguccgcucuuggucaucuuuguauaauucaaguccaugcguaauuacuucuguaaauaauguccuaaguugggcacacugggacaugucuguagucccagcuacucaggaggcugaggcaggaggaucccuugaucccaggaguucaaaucuggcuuguaacauaguaagacccugucuugggggguaaaaaaauuaaaaauagugcgcuuacucuauguugguuucaguuuccacucuucauauacaguuggccugcuguaucuguggguucuguauccauggagucauccugucacagauugaaaauauuugggggaaaaagaugguuaugucuguagugaauauguauagauuuuuuuucuuugucauuauuaccuuaaugcaauguaacaacuauauagcauuuacauuguauuagguauuauaagugaucuagagaugauuuaaagcagcaauggaagacaguuuuuuccacggggguuuggggggaugguuuugggaugaaaacuguuccaccucagaucagcagccauuacuuagauucuuauaaggagcacucagacuagaucccuugcaugugcagugcacaguaggguuugugcuucugugaggaucuaaugcugccacugaucugacaggaggcagagcucaggugguaaugccucccuccugcuguguagcgugguuccuaacaggccacggacggguacugguccuuggccagggggcuggagaccccagauuuaaaguauaugggagggugugcguuuuauauauauauauauauauauauauaugcuguuuuauauaagggacuuaaacaucugugaauuuugguaucugcaggggucgaggaaggauaauccacagucuuacggauacggagguacaacugucuagucaaagagaucuuuauaucucagucagaucaugucauuucacugaaaaccuucagugacucccuauuuuaacauuagcagugaaucaaaaccaaaaacuaccuacaaaugauauuuauaaaaaccuauacgaacuagcccaugcuuaccucuccagccucauuacauuuuucaccgcuuuuuucuauuguaaaaauaagccucaucuuaucucaggucuuuuguuuucccuuugcggggaagguuaugccuucggauauuugaagucauuuagaucuuagcucacauccuccuccucguguuuauuuuccccacugcaacagugacugaauuuuuuuuuuuccccuuuucucuuuuuuucacccacacucgaagagcuggaucagcagggaccuugucuaucuugucaucauuaacuuaagugccuggcacuuaguagcuguuaaauaaauauuuggugauugaaagcuuugugcacuagauaaagucauuuguugauuaugcauuugcuguccauuagccaacguuuauguagagcaacuagaucagaaguuuguuuuugaauacugacugccauuuaccugcuauauaaccuugggcagguuacuuauauuuguguuuuuuuucuuugucauuuguaaaguggggauaauauuaucuugccucagaaucuugggaugcaaauaagacaugacaugaauaaugcuuagaacaaugcuuggcuauuauuuauuuaaaauguucagcuuuggcaaacuuuuauuucauuuugggaacaagaguuguggggauuuacccauuuuuccaagacuucuaguaguauuuauuaaauugaaaugaagcucaguuugaguuuuggugacuaauuaccuuugcuaauucagggacuauuccuaccuaguucuguaucuuagaagucuaggaaauuuaaauaaagauauuuugcuguuuuuuccuccuuacugcucuuaauugucuuaaugcaaagaaguugggugcucaguuuuaggaacuuuaaauauacaucacaggcuguuuuaaaacccgucuaauuuauaguuuuaggagugaaggucagugcagagguacugauaguggugacaagaagaaaauaaaguaaugaaucuuaggauaggauuuuuuucuucuacacuaguucuucuguacaaguuucauagcugcacguauuggugugggacuuguaugguuucucuuaaauuuuacaccaaauaaugagaugaacuguuuauucaucucuuuuuuuuuuggagacagagucuugcucugucucccaggcuggagugcaguggcaguggcgcaaucuccgcucaaagcaaggucugccuccuggguucaugucauucuccugccucagccucccaaguagcugggacuacaggcgcucgccaccacacccagcugauuuuuuguguuuuuaguagagaccggguuucaccgugauagccaggauggucuugaucuccugacgucaugauccuccugccucggccuccacagugcugggauuacaggcgugagccaccacgcccagcccuauugaucucucuuuaccagcagguucaugagaaauagugcgugcauauucaguugucuguugaauaauuuuucuguuauagacuaauacaugcuauuauaaaauauaaaauauuuauaauaaacuuucauauuuugugauuuaguaauguagaaaugaagcagcaaguuagaaucaauauguuguuaaaaauggaauuuuucuguuuagcaauauuacuuggcaacacuuaaaugaguuuugagcuucauauauuuggcucugauuuccuguuuuguguaugugacuucgguuuuuuuuuuuuuuuugagacagagucucuugcucugugguccaggcuagagugcaguggcgugaucuuggcucacugcaaccucugccucccggguucaagcgauucuccugccucagccuccugaguagcugggauuacagggacgcgcccccaagcccagcuaauuuuuguacuuucaguagaaaugggguuucaccauguuggccaggcgggucuugaacuccugggcucaaauguuccucccaccucagccuccuaaaguguugggauuacagacaugagccaccgugccuggccugugacuuguuucuuuuaagaguucuaguuguguaacaacugaauuuuuguguguguucuuguggguauucauauuauucacaaaaagugaauuaagagagagaacugcuugucuuuguuuauauaccauuaggaaaauuggaaugcacauguacacacuuagggcuucaacgugugugccauguaagaaacacauuguagcauuugagcugccucaguauuauaaaacuaguauugaauucaguuaaugauuuccuguuuucuuagaauguuuuacaucagucuugacucuuacaagcuuugacauugguauuugaggucugaguucguacauauagagaaauagcaugaauauuuuauuaggagauguuucaaagacuguauuacaaugguuaaaggaaaguccaaaaccucuuuaaggaacacugcaaguugagacucugcuguuuuaauagguaggugaccuugccugagucagucuuuuugaauuucaauuuucucaucuuuaaaaugagguuuuuggugaucccucaguuuccuuucagcucuggaauuugguggguaaguuaccuugaauguguaucuuuucuuguuaaaauuuuaaaaaacaauauagaaggaaacaaauccuuuuuacuccuauuuuuuagaaauaaccccuaaaccugguaauauuuugacguguuuuuuucaaacuugucugugcauuuuuuaaaggagcuucugucguauauaguuaugcccugcuuuugugugcauguuaagcauuugguauguuauuuuaaaguggaaugccuugaagaaugaaucagucagaccuacuguuaacauuuugauguauuucagacugacuuacaauuuuuugguauuugauauuauguauaauuauauccugcauuuacuuagcauauuaaggauuuuuuuauauguaauuuuaaaguggaaugccuugaagaaugaaucagaaccacagcugcacaagguuguacccuugggaaguaguauagugauguccgucgaaaaacuaaucuggucccuguucaccaaaccugucggacugcgugcccaaggaagauuuuuuuuuuuuuccaucugcugucauuuuugagucucauuaagaguucaucagucuugagcauaucuuacucuuuguuuuuuuguuuuguuuuguguuuugaaacggagccucacucugucacccaggcuggaaugcaguggcacgaucuugucucacugcaaucuccgccucccgaauucaggcgauucuccugcuucaggcuuccuaguggcugggauuauaggugcacgccaccacggcuggcuaauuuuuguauuuuuaguagagaugggguuuugccgucuuggccaggcuggucucgaacuccugaccucaggugacacgcccgccuuggccucccaaagugcuggggcugggguuacaaaugugagccaccauucccggcuugacccacuuauucuuagaauuuauugugaagauaggugcagagauugagcaauauguuuauuauagcagugugauuuuauaauauaaaauuugacauggaaaauggcccaacaauagguuuagcuauucagugaaauaguguguagguguuaaguaauuguugacauaaaaagauacucauuuuaauuuaaagaggucuacuuuugaguaaguuuguaucauauacauugaaauugcauaguuauauauguauauauacaaauaagugggcugaaaacaguagauuuaguuggugagauuguggauuaguuuacuuugauaggauauguuauugucaaaaaauuuuaacagcuuuauuaaaauauaauucauuucuccaaaaagaaaccauguauucauuagcauuuacuuuccauuucuacccaaucuucuuucccaccuuggucuaggugguagcuaaccuacuuucuuccuauucugggcacuucauauaaauggaaucagccgggcgcgguggcucacgccuguaaucccagcacuuugggaggccgaggugggcggaucacgaggucaggaguucgagaccagccuggacaacauggugaaaccccaucucuacuaaaaauauaaaaaguagccaggcgugguugcacaugccuguaauuccagcuacuugggaggcuaaggcaggagaauuguuugaacuugggaagcagaggauguugcagugagccaagauagcaccauugcacuccagccugagugacagagcaagacucugucucaaaaaaaaaaaaaaaaggaaucauagaacguguggucuucaguggcuggcuuuucucacuuaggaugauguuuuucaagauucauccaugcucuagccuggaugugauaguacauuacuacucuacuuuuuauugucacauauuccauuauauugauuuaccauauuuauucaucacuugauagacauuugaguuauuuuuacuuuuggcuuuuaugaauaaugcugugaacauuuguguccaaguuuuuuugugaacauaaguuuucauuucucuaggagaaaauuccugggucagauguaauuucacguuuaacguuuugagaaaacucucagacuugccaaaucagcugcaccguuuaacauucccaccagcaauuguaggaggguuccaauuucuccacauccuugccaacacuuguuauuauuuguuauuuuuuggccgucugagugggagugacgguaguauauugugauuuuugauuuacauuuccuggauaacuuaaugauguugaauuaugugaacuaaaaaaaagugugcgaauuuaaaaaucuucuguacuuaacaugaauuuacauuuguaaaagucuuuucaguuggaagaacauaguuauuuaauuuuugguauauuaagauacgugaauuuauguaugacaucaguugaaccauuaugguuaauaaugaaagguacaacuuguaaaucugaaucugggaguaggagcaaggggugaauuuuuuuaaaaaccuacuuagcaaaguuaagaauaaaaaacaauuguagugaaaagguacacguaaaaugagguggugugaauaaaacuaaauguaaacauuacauuuuaugaaugaauauaguucuguuaagacuuucuguuuuaauaaaccacuuugcuaugucuuauuuugugagacaaagcucaaacaaaacaagagcaagcaaugauacaaugucacaaagaaagcaggaauggcaauacugcugucuguuaaaaguggaauuuaaacucaaagcuugaagagagaaggguauauauaggcaguccuuagcuuuacauaguuccuguaggcacaaauuucaauugccaugacuuagcuaaguaacaguccacuaacaacaugguuaaaauuucaccuacccugccauauuaacuaauuguauaaacuacaacauuugcugcuagucuuucaaccuacaaauuaagauguaaaugacaggugcauauaaugucacuuuuaaagcuucuuggugauuggucaccaugcauugguuucucaaaaucaugcacagucggauguauaguuggccucugucuccuaaugauguccccaugugacaguuuaccaaaauaaacaaggaaauuggucaacaaagaugauagugcagcaaaaauccuaaugcuagaugggaaauuugaauuuaacauaaauggaauaauagaauaaauagcuuaccuugugaauauagaugguuugcaguuggagagacacuaauuguccagccagagaaacuuagugaaggcaagcuuaucaacauaaaugaaaaagguaguuguaauggaaaauaugaagauauccuauuaauagaagugauaccaacaaaaaacauugaggauauuucacaucauugaaagcaugaaggauaaaauauuggaaugugaucuaaacuuaggaguaugacaguuugccaaggcauagaagauagacgcauuccauaucauaauaaauaucacuagaagaaggcaagcacuguucaaacuauucuugauagauuuuuuuuaauacaaagaaaugauacacuuuaauaucaguguuccuaauguuuuaaguuacagcauacuaaguugguauugguuuuacuauuucauuuccuuaugcauuuacauaaccgucaguaauagacuacuuaauauucugacaaauuuuaaaggucacagaacaaucguaacuuuucccauugauuauuaagauugccuugcaugguccuuuuuaagaacugcuuuuuuugagguuaagaaaaaugauucauguaaaaaaauuuaucuuuuauacaguaacuuugugguagaucagucuucuguggcuuuuagacuuagagccauaucuuuaaaaaaaaauaaauauuugagguuuuaaaacauuuuccuguaauuauuuuugaggucuuuuccuacuccugaaguuccuggucaccccaauuuugagcccuuuggggauuuuaaauuguaaaugagggugcuuaagauucaacuucuuuaguugucuuuuuagcuuccaaauuuuauuuuugccuuguuugguuuuaagaguuuauacuuuuaaaauaaucucuuuacuguuguuuuucugguuuuucaggagggagaauuuguguugaauuggguuuguucugaccagaaauacguuuucauggagguuuaacucaagucauuuacuuggaauuugaaaccuguuacauaagaggaauguuauacuguuagagcuaaauguguuaauuuuucuaauuugagauuauggacaggaauuaaugaugucuaguaaaaucuucaguuuuugauggaaugagaugauuucaguuuaacuccaaaguaaauuugguaaauuauugguuugccuuaauccuagcauaauaauauuacuuugaaaaugggaugugcaguuaaaauacauggauacaaugaauguuacagaauuuaaauaauaaagcugacuuuuauauacccugauuuuuuauauauguguguguguguauuuuuuuuuuuuuuuuuuuuuuuuuuuugagaugcaguuuugcucuuguugcccaggcuggagugcaauggugugaucuuggcucaccacaaccuccgccucccggguucaagcgauucuauugccucagccucccaaguagcugggauuacaggugugugccaccacgccuggcuaauuuuguauuuuuaguagagacggcauuuugccacauuggccaggcugguuucaaacgccugaccucaggugaucugcccugcuaggccucccaagugcugggauuauaggcaugagccaccacgcccagccauauuuaaauagaacucuuaagucuuuuaauugaaauuuuauuuuagagccuuuuuaaaauucuaacuagaauauuaacuguacucauuaguucccuaauucuuaaagaauuuuagcagaucaggaauuuaugauauguaucuaaugauaguaauaauuuuaaaauuuaguacauuuuagaggaaauaaguaucaguuccauuuuccuguugcuuuggggaguauauguauaucagcugucauaguaaaauuaucaacauacuuacgucuagcuuuauagaacugacagacuuauaugacucacugauguggggaggagauguacaggguccauccuggauaauguaucuaaauauauauguacagauggucccugaccuacugauaugguuuggcucuguguccccacccaaauuacaccucgaauuguaauaauccccacacaucaagggcaggaccagguagagguaauugaaugauuggggcaauuucccaaaugcuguuauggugauagugagucucaugagaucugaugguuucauaagugucuggcauuuccccugcuugcgcucauucccucuccugggucccugugaagagguaccuucugccgugauuguaaguuuccugaggccuccccagccaugcggaacuuugagucaauuaaaccucuuuucuuuauaaacuauccagucuuggguauuuccucauagcagugugagaacugacuaauaugguaaauugguaccagaaaguggggugaugcuguaaagauaccugaaaacguggaagcgacuuuggaacuggguaacaggcagagguuggaacaguuuggagggcucacaagaagacaggaaaaugugggaaaguugagaacuucuagagacuuguugaauggcuuugacccaaaugcugauaaugauauggccaaugaacuccaggcugagguggucucagauggagaugaggagcguguugggaacuggaguaaagaucacucuugcucugcucuagcagggagacugguggcuuuuugccccugcccuagagaucuguggaacucugaacuugagagagaugauuuaggguaucuggcagaagaaauuucuaagcagcaaggcauuuaggaagugacagagcauaaaaggaaaauuugcagcccgaugaugcaguagaaaagaaaaacccauuuucuagggagaaauucaagcaggcugccaaacacuaaucaccaagacaauggggaaaacaccuccaaggcauaccagugaccuuccuggcagccccucucaucauaggacgagaggccuaggagggaaaaaugguuuccuggccugggucccgggccuuccugcugcgugcagcguugggacuuggugcccugugucccagcugcuccagucuuggcuaaaagggaccaagguauagcugaggcuguuguuucagagggugcaagccccaagccuuggcagcuuccacaugguguugggucugcggaugugcagaagacaagaauugagguuugggaaacucugccuagauuucagaagacauguggaaaugccuggauguccagguagaagucugcugcagggacgaagacuucguggagaaccugugcuaggacuguguggaagggaaaugugggguugcauccccgacaccgaguccgcacuggggcacuggcugugagaagaaggccaccauccuccagaccccagaaugguagauccaccgacagcuugcaccaugcaccuggaaaagcugcagacauucaacaccagccugaggcggguuguguaccaugcaaaaccauaggggcagagcuuuuuaaggcugugggagcucaccucuugcauuugcaugaucugaauuugagacaugcagucaaaggagaucauuuuggaacuugacugccccuauuagauuucagacuuggcauggggccuguagccccuuuguuuuagucaguuucucccauuugggauggguguauuuagccaaugccuguccccccauuguaucuaggaaguaacuuaacuugcuuuugauuuuacaggcuccuagguggaagagacuugccuugccucagaugagacuuuggacuuggacuuuugaguuaaugcuggaaugaguuaagacuuugggggauggggacuguuggaagggcaugguuguguuuugaaaugugaggacaugagauuugagagagggggcaggggcagaaugauaugguuuggcucuguguccccucacaaaucucaccuugaauucuaauaauccccagguguuaagggcggaaccagguggagguaauugaaugauggaggugguuucccccauguuguucuugugauagugaguuucaugagaccugaugguuucauaagcgucuggcauuuucccugcuugcaugcauucucuccuguggcccugugaagaggugccuucugccaugauuguaaguuucuuggggccuccccagccguguggaacugugagucaauuaaacuucuuuucuuuauaaauuacccagucucugguauuucuucauagcagcgugagaauggacuaacacaccuauagugguucaacuuagauuuuuugacuuuagaguggguuuuucaugguuacuuaaauggauuucugacuucagauauuuuagauuuacaguggacuuauugggacauaaccuccuaguaaauuaagaacuaucuguguauauauguacacacauaugcaaacaguugaggcucguuauuuguggauuccauauuugcgaauguaccuacucaccaaaauuauuuguaagcccagaucaguaguacuuguuguacaggucauucacaaacaugcacugaguaguggaaagacuugagucuccugauacaacacauucuuagcugagguuguacaagggaaugcuugccuucuuuuuucagcacucauacuguaagcaaguaucuuuuuugcagucuguuuauugccaugcauuuuuuugcuuuuguuggucauuuugcuauuuaaacuagcucccaagcauaaugcuaaaguguucuuucauguugcuaagugcgagaagguuauaaugugcuuuacagagaaagcgcauguuacauacgcuguuggcuaugaguucaguguuaaugaguuagcagucuguauuaaauaaggugucuuuaaacagaaacacacauaaaaugaauuuauguauugauugguucaugaaaaccuugugauuacaggaaccuaacccuguauuuccccuaggagcaaugguuguguauuugcuaauucaguuuucacagugacuuuauagaacauuacuaccacagauagcaaaaauugauaguacauauaugaaugaauggguuauaauaugucugauucccucauucaguaaaauaaaauucuuaacauacucacugauuauuuuaaaaacacgauaguuuugugaguuguauaauauacgaaguuauuuugaagugaaacuauauuuggggugcaguuaaauguguugauuaaugcuaaugugucaaaguuuguaguuuaaaaaaacccaaauuuauugaauuaaccuuuuuuuuuuuuuuuuuuuuuuugagacagagucucacucugucacccaggcuggagugcaguggcgugaucacagcucacugcaaccuccgccucccggguucaagcgauucuccugccucauccucucaaguagcugggacuacaggugcacgccaccacgcccggcuaauuuuuguauuuuuaguagagaugggguuucaccauguuggccaggcuggucucaaacuccugaccucaagugauccacccgccucagcuucccaaaguggugagauuacaggcguaaggcaccacgcauggcgauguaaccauuuuuaaguguauaguucagcaguguuaaguacauucacauugugcaacgucugugguuuuacuuaauaggauuauggauuuaaauaguagcuuguuacugaauuuaauaaaaguauuuggaauuauuaauugcccuuuaacuuauuuaagauuuguaaugcaguuuagguucuguauuuuugauaauuguguaauagggugucuuaucuaauaaauuauguauuugagcuugcuuugcacucacaucuuccccacuucuuuuuuagugcuuuuuuaggaccaaaggauauauuuccuuacucagaaaauaaggaaaaguauggcaaaccaaauaaaagaaaagguuuuaaugaagguuuaugggagauagauaacaauccaaaagugaaauuuucaagucaacagguaagucauauuacauaaaauuugauauuacuuauuuaauccuggggaauaaucacuauccuagcuguaggaaaguaaauacuaaaagccuugggaauuucauacuaguuuguuguguucuuauuugugagguugaaccuugggcauuuuauaucaaaaugaauugacaaaaucauuauuuuauguaguuaaacagaucucaagaaacugggaacuauucaguuauuuaacuccugauagaggguuuaauacgucauugaauauaaagcuguauguacuguucuaaauuuagguuuugcgacuuacaugguguaugccuaaguuuucuuauucucuuuaauuaauuaauuaaauuucuuuuuuuuuuuuuuuuuuuugagguguaguuucgcucuuguugcccaggcuggagugcaauggugcaaucuuggcucacugcaacuuaugccucccggguucaagugauuguccugccucagccucccaaguagcuggguuacaggugcccgccaccacgccuggcuaacuuuuuguauuuuuacuagagacaggguuuugucauguuggccagacugaucucaaacuccugacuucaggugauccacccaccucagccucccaaaaugcugggauuacagaugagagccauugcgcgcagccuuuaauuucuaaauccauagaauuguauuggaauaugaaccucaugaguuaaauugguaugugacaaauguacuuacagcacuaugcaaauuauauuuauuggugucagcagccaccuuauaccuucuuuucugugguuuuucccauggguccagagcuuuuauuaauuuauauguuauaguaaauuuucauggagugguuugccuuuauccaauuuguauuguuuuuauccuacagaaaacacugguucucuuacuucuccuuuguguugguauugaugugauuuagaaaaaauuuauuuuuuuugagaggagucucgcucugucgcccaggcuggggugcauuggcucuaucuuggcucacuguaagcuccgccucccggguucacaccauucuccugccucagccuuccgaguagcugggacuacaggugcccgccaccacacccggcuaauuuuuuguauuuuuaguagagacgggguuucaccguguuagccaggauggucucgaucuccugaccuugugauccgcccgccucggccccccagaguguugggauuacaggccugagccacuguguccagccuaauuuuuuguauuuuuaguagagacgggguuucaccuuguuagccaggauggucucaaucuucugaccuugugaucugcccaccucggcuucccaaagugcugggauuauaggcuuagaaaaauuuuuuauauugucgauugcacucuugaauuguugcauauauucccaaaugaauguuccagaacucuuacgauuuaaaauaaacagauggcuuuauaauaggaucagagggcuaugagaggucuuuaugaagauaauugggacaguuucucuuucaucaauaaacguccucuguuuaagaccugagguccaaaaacuaggaagagcacgaguaaaucuaaagaagcgagguagcaacaaaguggaaauucugcagcuuuuuacucuuuuuuuuguuguuguuguugagauggagucucacucugucaccccggcuggagugcaguggcgugaucucggcucacugaagccucugccccccaggucaagcaauucuccugccucagccuccugaguagcugggauuacgugugcgcuuugccaccgugccuggguaauuuuuguauuuuuaguagagaugggguuucaccaucuuggccaggccagucuugaacuccugaccucgugauccacccaccucagccucccaaagugcugggauuacaggcauaagucacugugcccggccuagcuuuuuacuuuuaaaccgauaaauuuuauuucuucacaugugccaugcuuuaccuuggagaacuuuuuagauacuguucuaucuggaacauauaaaucuuucauugcugcuccaaggccacauuaaaugauuagugacuuuauuacuucccaguacuuacuuguuaauggauucaucgaaccauaucauaauuguuucuguacuugucuguaccugcuacagaauauuauguugccucugugaacaaagguuuauguccugugugcccagcauguacacgugugagaagaauagcuaaucacuaaauauuuguugaauggcuacaugguuucuuaucauuauugccuugacugugugaugggaagacaucugucuaaagagacagaauugauuguuaucugaaacuuaacgucuuguaauuucuuuuuuguuguuguuuuuuuggagacagcaucuugcucugucgcccagguuggagugcaguggugcaauuuugaucuugucucgcugcaaccucugccuccuggguuuuaaguuauacucgugccucagccucccgaguagcugggauuacaggcgcgugccaccaugccuggcuaauuuuuguauuuuugguagagaugggguuucaccauauuagccaggcuggucuugaacgcccgacuucaagugaucugccugccucagccucccaaagugcugggauuacaggugugagccacagugcccaacuacguuuuguaauuucucuuggaucauuuguccugugauugcaccuuuauggucuuuuuuauccuccaaauugccaagccuugucaccauauaaucuuggaguuuuuuuuaauuuuuauuauuugagacugcguugcccaggcugggguacaguggugcaaucaugguucacuacagccucgaccuccugggcucaggcugaggagggaggaugccuugagcccaggaauugaggcuucagugaaccauaauugcgccacugccuccagccugggugauagagugagacccugucucuaaaaaaaaaauaaaaauaaagaauuguauauauuauugggauaaaaacuuauuuuuugaaauuaauagaguugauugcucacaggcagcaacuaaacaaucaaaugcaucaucugauguugaaguugaagaaaaggaaacuaguguuucaaaggaagauaccgaccaugaagaaaaagccagcaaugagguauguucuauuucuccuaacauuuuaaacccauuuuguuucaaggaagaaauaaugaaaugaguuggccaugauuaauuaguaaguaauuuuuaaaguacuucaaaagugaauuagaaaauauuuaaggcuuauuuccuuguguaaauauuaaauacaguauugucaaacaacuuaugcaucuuuaagaugcauaccuguuauuauuugaaguuauuuuuauauguaaaacaugaaguccaacuguagggugcgguaguguuaaggauuuuuuuuaaagagaaguguuguaggauggauguacuggaaacagcauuagacuaaauuuuuuaaaaccuagguugauguccaacuguauaugaucuguguguaaagaugacucauuuagcccuuccaggccuaaugaaaugguuguuagaugaucuucaaugucccagccacccuuuaaaauucacaauucaaauuuauccaccccuauaauucagaauucuaguguagaaaaaguaguuuuauaaauuuaaauagacagacuuccugguguaccagcaaccaugacuuacauuugaucugacaguggaaaugcauuuuucucacuuuauaauguugagacacaauguuuuuaauuucagaacucuacagagcaaaacagauuuccccaaugcuuucaguuaaacgugcuuguaacuuuuaguuuaacaagguuucuuucauuccuggaauaauuuauucaguauucaguuuucuuuuuucuuuuuuaggaugugacuaaagcaguugacauaacuacuccaaaagcugccagaagggggagaaagagaaagguaauuucacugacuuaccaaccauggggaucugaaaagaauuuuuauuuuaauuggguugagggagaguagauacaaugaaaccuuaaauuucagcuuuuauucuaaacccuuuaauuuuuuauggguuauguuuuacuuggcaaaacuaucuguguuucuuucuuagugauauagcacccuuaaaguaacuugagugguaaaggaaauaaaauacaccaguuuucauucauuuuaaugacugugccucaguuuucucuaaauuggguagaaauauauacuccaagguuguggaggauuaaaugauuuaacauaugugaaauguuuaugcuaaauccugauaccuaaacacuaguaaguguuauauaaguguuguccauuauguuguuguuguuguuacuucacguugugagaaaugagugugagugacagugcaagguuagguacauaguaggcuuuuaauuaauaugaaauuuuccuuccauauacgaaguuuuguucacacccuuuucugaccuauuuaugucucaaauuauuaucauauaccaaagaugcaaagaaaaccaaaaguucaguaucucaugaggagguaaacuaugaaaauaaauaauuacaguggcuuauuuguugugcaguauggguuggaaguggugugauaacaagauuuuaaaauacaggcagaauuuugucaggcggaugaaggagcagggaaggacacaugaagccauuucacauagaggaaauuccuacucaagcaucuugaguauuguauuucauuauuaacacaccauaaagucugagggaaauggguaccaaaaaaaccugauguuguccuaaagaccuuggaacuuacagaagugaugggaaaugauugaauuauuuuaaauuuuagauaccuccuuuuaaaaaauuuuuuuaagagauggggucucaugcugucacauaggcuagaguagugcaguggcacaaucaugccucacugcaaccugaaacuugugggcucaagggauuuucccaucuuacccucccuaauagcugggacuguagaagugugccaccauacccggcuaauuuuuuuuuuuuuuuuuuuuuuugagacggaucucgcucugucauccagguuggugugaaguggugcgaucuuggcucacugcaaccuccaccucccgaauucaaacaauucucuugccucggccucccaaguagcugggauuacaggcaugcaccaccaugcccagcuaauuuuuguauuuuuuuguuuuguuuuuguuuuuguuuugagacggauucucacacuguugccccagcugaagugcaguggcgccaucucggcucacugcaaccuucaccucccagguucacgugauucuccugccucagccccccgauuagcugggauuacgggugcacaccaccaugcacaccuaauuuuuuuguauuuuuaggagagaugagguuuuaccauguuggccaggcuggucuugaacuccuggccucaagugauccacccaccucggccucccaaagugcuggugugagccaccacgcccagcuaauuuuuguauuuuuaguagagauggggucucaccauguuggccaggcuuaucucgaacuccugaccucaggugaucugcccaucucagccuccugaagcucugggauuacaggugugagccaccgggccuggccuauauauauauauuuuuuuuuuugauagacaugggguuuugcuauguugccuaggcugaucucuaacucccagccucggugauccucccaaagcacuaggauugcagaugugagccucuguacacaacuugaugccucuuuuuucuuuuuuuuuuuaaauauaaauuuguuuuuuuuuuuuuuuggauacagaguuucauucugucacccagacuggagugcaguggcaugaucuuagcucacugcaaccuccaccucccggguucaagcgauucuccugccucacucagccuccugaguagcugggauuacagacgugcaccaccacgccuggcuaauuuuuguauuuuuaguagagaugggguuucaccaugguggccaggcuggucucaaacuccuggccucaagugaucugcucaccucugccucccaaagugcugggauuacaggcauccgccaccauacccagcuaauuuuuuguauauuuaguaaagacaggguuucacuauguuggucagccaggucuugaacuccucaccuugugauccgccuuccuuagccucccaaagaaugcgucauuuuuuuaaagcagugugaacgauggggauuggauuggggcagugagaccaguucacuguaaaauucauucagaauuuuaguacuaacuuuacuggacuuggcauggauuugaguagucaguaaagaagacaaggucuuuguuuccauugaacuuacauuuuuuuuuagacaaaaaauaaauauuuaaaauaagaggguuuaaauggggaguuaaugaguuggcaacagacuaggcuacaaaaggccuuucuaaggaguuggcaugagacuggaaggacaaggaucuuauagauuuuuuaagugguguagacgagagaugggauuuaagagcacuuuaagagguuaaguugaugguugaugagaaguggaugguaaagggggcgggggagggaacuagaaucuaagguggcucuaaggucuuuacuugaauaagcuaguuauugggagugcagaggauguugguuuggaaucauaggcaugaguaaggggaaggugaagcaccugugggaacuggagugaagagauauauauauuguucuggcaccaaagagggagaagauguaaguuacagaugcagucucuggcaugaagauaggguaauagaugaggucaaaggagaacgguuuauugagaggaugcagaaaccagaauccugaaggaauauaauggagagggggaaagguugcucugugaaauuauggcugagaaugaacugucaagagaaaaucuaagaggguaucaagcuaaacaagggaagggggaauguccagaaugaagaaguggucaguaauguccugauuuagagaggguaccaguaagauacuugccacauaggcugcucuaggauacuuucaggugaacuccauuuaguugaaugguaaggacagaaacuagauuaagggguuagagaauaaauguuaaugguaaaguuacacugugcuuuuuaaaucuuugaaggcaaggagaauguggcaacauaauagggauuuucauagcuaagggaaaguguuaaaaugacaaaagacaguaaaugccuuaacacuuuuucucugcaaaauuaggaaagaucaaagauguggagucaguauaaauuauuuuauguaaauacauguuggaugagagaauggaggggacauuugaaggaacugacuuaacaaggaggagauggauguuucagucucuuaacacugaaggggagggauggaggaggcucugaaaauuucuugggacacuaggaaauuaagggaauuccuuucuacagcccuuacucccuucugccccauccacaucaaagcaagacuuuggaugugguacaagucgggaagaauagauugaguaaauuaugcagcuguuggugggaggaggaggccugaucagauaggguaaagugacuuugagaucucaacugagauugcauaaaaugaaugcauguuuguacauuuuuuuuuucccagcaggcuucagcagcugggaauaauagaacagagaagguagaauuguauaguaaccucucuugaggauuugugggacagauacagcaaaacaaggauguggaggacuuaugaauacauuugaauaguaaucccaugagguuuuugugugugugugaagugguguguuuuuaguuaagaucaaggaagcugguagagcuagaaagggguaaaaaaugaagagaaaaugaggguuagaugucucagagcaaguaaaauauggaagaaauaaaucuguagucaguaguuuaagauauuagcauuuaagauguuuaaauauuuaagcauauccuaagaguggaaaaguuuuaaauauauauguuucguauaacuucauugguccuuucuuuagauaaaauauuuauuauucuuugauuuuauuuucaugaggaaugguucugacuugcaugauuuugccauaauagucaugaacacacgugcaugguagggcugaucucuuaguauuaguguuaauauaguuuuaauuauuauugaugaacuuguuacacuuauugguaccuccuuaaaaaccaucucuuuuaccuauaauucuuuguuuuuuuugagacggagucuugcucuguugcccaggcuggagugugguagcaggaugucagcucacugcaaucucugccuccuggguucaagugauucuccugccuuagccucuugaguggcugggauuacaggugccugacuuauuuuuguauuuuuaauagagaugggguuucaccauguuggccaggcuggucucgaacuccugaccucgugaucugcuagccccagccucccaaagcgcugagugggaauuacaggcaugggccacugcacccaacccuaccuauaauucuuauucaguguuuugauuuauuuccaaaagcagaaaguguaaguggagagagucuucuuugcaccaaagaauugaccaguuauaacugaauuuuagacaaauuaugcccucuuaacuccucaguaggaaaagagcucucagucuugaguucuuaagcuuuguuaccuggggagcuuuauaaaaacacagaauccugguucccugacucagagcuauugaaucaggauuggggcagggcaacuuuguaaguucuuaaaauucuagaaauaaaaccugagcuaauaauguucagggaggaauuuucaguguucucugagaacaacucaaggguuaccuuagaugaguuuuaauaauacuuuuaauaugcuucauuauguuucaguuauuuaaagaaauguuuaaaaaacuaauaaagaaauggauacauucguagaaguggaauugccauauaaagguuuuuuguuuuguuuuguuuuuuugagacagucuugcucugucgcccaggcuggaaugcaguggcaugaauuucaguucacugcaaccucugcccccugaguuccagcaauucuccugccucaguuuccuauguagcugggauuauaggugugcgccacaagccuggcuaaucuuuuguuuuuaguagagaaaggguuucaucguguuggccaggcuggucaugaacuucuaaccucaagugauccacucaccuuggccucccaaaaugcugggauuacaggcgugagccacuguguccagcccuauauagagauuugcacauucuauauugccaauacucauucauaauuaugugcuuucauaaaguaucaguuuauugauaccagcuuauugaucauugguagucaauguaugaaugauucuccacaugcuuaucaacacugggcauuauguuuacaaaucauugaugaaaaggcaauuuuuaauuuuuuuaaucaaugagauuggauuaugcauguuuuugaaugccuucuuguuuuuaucuuuagugauacaguuaaugcugaauucuaaauaguugggggaguuggggaaggagcccaucuccuccuuuggucuuucucuuuccuccuuuugcaguuaugaucaguaccaacugcugccucauguuuacauuuuguuucuaauuuguguucuuaaccuuuguuccauucuaaugcuuaaaucaauaauacugauucucauuuggggccauucucuccaggagaaucauacuagcaguuaucaaagggcauuagaguuugcaaauggucaguggauuccuuacucucuguuguaguaaauccuuucuuacgggaaauaagaauaacuccuaaaggagaacuguuagguaacagucucaguuuagaaauaaaaugugucuguaugaacgaagaauuagaaauaacauuguguuaguugcaguguaaucacauacuuuguucuccauaucgcaucaagaauauuagcuuuauuuuuacaaaugacuucauuucuaagaaauuuuuuguuuuuuuuaagaguuguucacuagaguuauaaacuaaguuugaagauguuacucuugaguugauuguugaaaaaacaaaagaucauauagagguuauaucuauacuugaacucaacguuaccauagacuggcauauuuuugccaucgaauuaaacuuugagugccuacuauuugcuaaauaaguuaauuaaauuuuuguaauucaggcagaaaaacaaguagaaacugaggaggcaggaguagugacaacagcaacagcaucuguuaaucuaaaagugaguccuaaaagaggacgaccugcagguaggauuacugauguuuaaauaucuguuuggcuugugauuaauauuccaguccauuuaaaguguugcugccucaaauauuuuggaaugaagcaaauaggcaauugauuauguguaacauacagauuucaaaggagauaaacaugauuugugcucuguuucaaaguauuuaaauuugaaauaaacuuugcuuuaucucuguuauguuuucccuaaauagugguaagagaggcuguggggagguuaaaauuaucaugaauaauggguuuauuuuaccuuucacuuaagagucguaagauuucaaaauggaguuauaaucagagaaugagaaauagcauuugauuaaagucauuaauauuuuaaauuugugcguucuuuauugauagggauuuugauuuuuacaguuugcagcucucuucagcauugccuauuuaaaaguauuuucuuaauuuggcaaauuggaaauauuuuggaaaaaucuucguaaaacaaaaccaaaauugagugaauuuuuuuucuacuuuuuaauaggauucuuacugaaaaugggggguaagaugaguaauacccagaaaagaaaaaagauuuuuauuuauauauuuuggaguuuaauauugcaguggauaaaauuaauagugcuagggaaacucagugaauuuugauaugaacuuccaaagauauguaacugcauaaguaauauaauauguauaugaauauuaaauauaagugcuguuuccuauucuaaaaguugaauuuugugacauuacuguuaaaacgauagugaaaaauguuuuaagcccucucagucauaauaaggacaaauugaggauuacucuguuuaccucuuuauaaauuuuuuguuguugcucauuuuaaccauggugggggagguauuauuuuuucaauuuagcaauaauuguaucuguaauaagcuacuaauauucuuaaauaguauguaucauuucuaauauuuauaucugagauuuguaucuuaaauagaaacuaguaguuacugauuuuuuuuccauguguauauuagcuacagaagucaagauuccaaaaccaagaggcagacccaaaaugguaaaacagcccuguccuucagagagugacaugugaguuuauuuuuaauguauaauuaugcaauaaaugagacauuugacuuuaaacaagcacauaucucugcgauuuuaucaguuuucucuuacaggauguuuguuauuauuuugaucuuucuuaaaauuacaggaaaaacugggaaaauuuuguaaaguaaaaauugguaaggaauggcuauuuaucauuucauuaauuaagacucuuggguauaucaauuuauauagauacuuagauaauacaacauaaaauauauaauagagaaauugggcaagaugguauguuucaggaauuuuagaauauauuugaaguaaugucacaaauuuuuuuuuuuuuuuuuuuuuuuuuaaagaugggguuucacucugucgcccaggcuggagugcagugcugcaaucgcacacuguaaccucaaacuccugggcucaaggagccucuucccacuuuagccucccaaguagcugggaccacaggugugugccaccacaccuggcuaacuuuuuuugaugagacuggucucaucguucccaggcuggucucaaacuccugggcucaaacgauucucccaccucauccuuccauagugcuggaauuauaggggugagccacgugccuagccuacaaaucuuuuuuuuaucuccucuagaauaggugcuuuauuuaaaaauagggcuaaaauaauuuuuguauguaaauuuaauuuuuaaagcauuucagaauaacuauucaguuauccaggaaauugugcguguuuuuugguuuuuugcauuuuucccuugcugccuuuucuacuuggauccuuuuuacuuuggcuuuuuuggggaaucuuugccagaaggaauagagaguauauuuagacaaagggggagaaaaacuuuuuguggcuauuguguuugaagauuugaaaggcuuaagugggguaugucuauuaagcauagauuuacauuguuuugaaugaacugauuauagaaaauucuaauuguagaacacuauuagagaauugguauguuucaaccaaaauauguuuaaagaguuucacugccagucuguauuuacuuucaaaaauaguggcacauaacaauauaucauauacuugaaaauuacuaagagaguagacuuuaaggguucucaccacaaaauaaaaauauguaugugaggugguaugguaaauagcuugauuuagccauuccacaguguauacguacaucaaaacauuguguugcacaccauaaacacauagaauuuuuaccugucaauuuuuaaaaauaguggcagaaaaauacaacauacuuuaacuauuauagugaaauuaagaaauuggauacuuaacaggugaguuggcagucauuauucccuaggaaaucugaaauucugcugggaaaauacugugagaucccucuguuuuggauauaauuaguguucccuaauuaggucccaguuuucccccggaguaugcuucccacuccguuugucuucuuggcuuuuggcugauuccucuggaacuucucuacuuuuucaguaucauccuuuguugcaucugaaaaggucauuggaaaauacugcccuccucaucagcugagcagcuuucucagccuacuuucggaccauagugaucugagggcccaguguaccuuuuuaggaacuuauccucaucucacuuacuuucuuuugauggagucuggugucacuuuugguaauguaauacuuuuguauguguguuuaauucuggucagcuuccuaugcaauuauuguuaagacuuuucucagacaugcucgucuuuuuauauuuaauaacagauacuuugaguuuauagguuuuugugagaaaccaucccucaggaaucauuuguccaucugaaggauuaaugaaguccaauuuuaauucuuaaggauugcagcuauacccuuuauugggucuuugacccaggcuaucacccaauuugaaaguccuacauccucacuugaaaauaggcuaaucuuuuuugaacacaucuuucuugaacacuaucaaauucaccuugauagucauuucacgcuaccaguauucuauuuugaaacuucuucacccaaagccacaaguugauugaauauauuuucuuauuucugcugcgguccaacaguuuuacccauuguauaauaacguauuaggguuuccagucucccagcccuaaagcaagugacuacauguuuuagguuuuugguccuggugucaguuucucuauuagugagcuuuuuccugaggcaauggacaacccuaaaauagcaguagccuuuacaacguuuauuucuuauucaugcugugcguaggcugagugugagcuguaacuacucuuggcuguguaucugggcacacacucaguggagugcagaacuaaacuguauaagcucuuuuuaaacuucugcucuucaccguuagaacaccauguaucucuuagcgucuacuucuuugucacggguacugaugugacacaacaguagaauagagcccagaagagcuaaaaaccaacucauaauccucagaaauguuuguuaaagcccacugaagcucuuaggguuguguuugcauuagucuuugcuuauauuaacauauauuaaaagauuaagaaauuuacaaauacaacuuugcuaauaucccuuaccugcuaaaaagggaaguugucacaagucuguauuucauggaagaaccacugggaaaagacucauugguagcaagcagugauagucauguuuauguaaauuguuuuggcacaaagauuauuucacaccuugaaauaaucuuuuuuaugaccuuaggauaaauuuuuaaaauaaaucccuaaagucacuuuuuaaagaccagcugcaugguaucccacuguauguuuuauaauucuuaagaucuauccuauguauggauagacgauuuuaaaaacauugucaucuauucuuuuguacauaaugcaaauauauugguuaggauacauuguuagaagcagauuugcugggucaaaugguauuuguauuuuuaauagcuauuuccuuccauacagguguaacauuuugggagaaguaguuggccaguauuguuuaagagacacagaaaugucuuuuuaaaugggacucuagucccauuuuuaggaaacugauuaucaaaauauuuacaucaguggaaauccugaagaaagcaaauaguuucacuugcaugcuuuuacuuucauuuauuaaaaguaaaggaugguuuuaaucccagagaggcuaaaguuaaaaggauaaaaaccauaggaccauuagaaaauaagcauacccaaugauaauuauauaauaaaaaguuucuaaaggggcaaaaguaaauuucuucucuuccaacuuaauaguucuuaaguggucagggaaucacuugucuggaaagagguuaauggauuuggaauugagauguugggcuuguuauuugaccuuuugcaucaucauuuucucauuugucaaauggaagggguugaacugaaugauaggaagucucuucaagcucucaaauucauugauuuaauugaauaauuugcgaaaaucucaaugaaauucuuuggacaguuaaaagguuacaguuuuuaaacggcuuauuccagcuucaaaugaaguauuuauuuguaaaagaauugcuuuagaagaauauauaucaaccauaaaaguaauuacgugguuaguauuugcauuauuugauucuccuagagccuauuucuguaguaccaacuugcauaaauaugcagcaguaauuaggauuauugagcaguuuagguaguuucucuuguuuuaguggugucugugaaauucaguggugaugggaauacuuaggugcuagucagcacagcacugucugaaaacaugcuuaauuggcuauauauuuaucauaugcuuaaguugggaccuuuuuacccugcaaagaauauuugaguucuaaaacgaccguauuugauuucacuuccgcaauuccauuugucccagugugucuacuuuuuaaacauaauuuauucuuacaaauauguagaauuuaaguuccauaagagccagggaucugcccaucuucuaucuucuaauuuauaccaaaaggauguucugugacagaauuccuuuuaugauuggauagugaagacacucuuuuuacuuuguuuuagauuugccuuuaaauuaaaaauuauagcuuacugauaucuaaaauacuauuauaguugaaugacaaguauacauuguuauguucucuaaaauagcauuacugaagaggacaaaaguaagaaaaaggggcaagaggaaaaacaaccuaaaaagcagccuaagaaggaugaagagggccagaaggaagaagauaagccaagaaaagagccggauaaaaaagaggggaagaaagaaguugaaucaaaaaggaaaaauuuagcuaaaacagggguuacuucaaccuccgauucugaagaagaaggagaugaucaagaaggugaaaagguauaaaguuuacauauauaaaauggcuguucuauucuuaguuuauauauauauuuuuuguuuuuucuuuguuuuuuuuuuguuuuuuuuuuuguuuuuuuuuuguuugagauggagucucgcuguguugcuuaggcuggagugcaguggcacaaucuugguucacugcaaccucugccuccuggauucaaguaauucuccagccuuagccuccugaguagcuggaaguacaggcaugugccaccacuaccggcuaauuuuuguauuuuuaguggagacaagguuuugcaaucuuggucaggcuggucuugaacuccugaucucaggugaaccucccaccuuggccucccaaagugccgggauuacaggcaccacaccuggccauuuauguauuucuuaaucugcccaguuuaagagcuuuuaauauuuuggaggaagucuauaaauaucaguggcaguuaaaaugaauuuguuuaccuuuuugaauagacuugaauuagcuguguuacaaagcauauugaaaacgucccuuuauuaucuguucucuaaauucaucuauuuuacaauuaugaucuggaaauuaaguaaacaguaccuuuccaauaaccccaucugucuagaaaagguagaugaaauaggcuguggccagugaagacaaauguuaaaagagguggauuuauauagagauuuuuguuauuuacccccaagaaguucuuaacacccuucaggccuauuguacauuuuaucagugguauguaaauuuauuuggacgccauaguuguugggaaccucauuaaagcuguguauccuuuuguguagaaaaauaaaauuuuguguauagccuuagagauuuacagauucaggucaugcaaaucuuuuguuuacuuucaucugauuuuuggcucauuucuuaaucuuuuagaaaccaaacauuuuaaauuggauaggucauguagugugcuugucaguacucaagucaaaucacucuguagagaggcaaacagacugacauacuauauuuuauccaaaggacaucacuccuauagcagggcauaaaacaagaugauuauuucacggucauuaaucaaaguuaaacuugcagagauagguguaauucaaagacuauuuuuagguugcuaauuugaguauucaucccuuuuuuaaaaacuagcugcugcuuuucccccaagauuauaauuccauaagcacuagucacugacuuuauaguuaaauaaaaccauccuaauucucaaaacagaagagaaaaggugggaggaacuuucagacugcucacagaaggaauaugcugaaaggccaacaugagaaagaagcagcagaucgaaaacgcaagcaagaggaacaaauggaaacugagcaguaaguauuuuuuuuuuucuaaauuuuggguucuuuuuaaaggcuagcauggaauuuuuaaauaauagacuuucauuuuccagacuuuaugaagccuuuugaagaagugacuuuucccauguguuagaaaaaucuucaauauaugaugaugaucuuauuucaggcuucauucucuucugagaggaugaaauugacugaggcagucacucugugaauuauuuuugaauuuaaacgaagugcagauaggauuuaauugauacuggcuuugcaagaaguguacucauccucaaccauuuguuuguauaauauaauacauauagauagaggggcgauaauauacugguagacaaagaaugcaggaaaugcccuuauucaucacaccaccaagcaggccucacccuaaagaccagcaaaaguaacaaaagcacauuuggaaacccaggaagccaguaaaaguaaaucuaaaggcugacaggguguacauuauuauguaugugcaauauaaaucaaauucaaagcuguuuucucuuaaauuuugauacuuauagagacaggacuugccauggggaauuucuuuccccuuacuauauaauuuuauuacuagaaggaaaaguaauagcaaugauaauaaugaacagacuucgugucuuuauuacauuugcuuuccuaguuaccuuuagacugucacuucugaguucuuucucugacaugcuuuucuuuucucgugaagcgucuuacauucugacuaaauuuuguuuuuuuguuguuguuuuagugaggugauuuuuaaaacaugcucuaggucaauaagacaaaguuaaugaugagcaguaaaacaauucuugaacaauuuuguacuuuuuuucuuuauauaauauauccguaagccaaagucuuucuugacaaguacagcguuuuacucugcuuucuuaguuuggaggauauacaaguaguuuuagcuccuugagggaguaauuuaaauaacuuaucuaaagcucaaaaauauuauucccucuaauguuagacuuuaagcacuucuguaaauauuuaaguuauucuuugucaccuaucauuuucuauucuaucuuuucacugaaaagcuguuggacuguuuguugcuuuugacuuuauugugaucucaaaauuaagauauaaaauuaguuguuacuaguauauguagcccaacccuucuuuaguaucuuaaaguuaucuuuauguauuucaguuucuuuugaauguccuccaauguaacuuucucaaauucuaauauuuguguuuucuuuccuucuccuguuauuacaaaacuuuguacuuggacaguuuugcucuguaaagcauuucagaugcagcuugugugaaaugcauuaugcaaaauaaaguuuauuguauuguauucccagccaaacaacauguaaucuacaguaauaaaaaauauaucucauuuugggcucaaagcauuaauccaguuacugaaaagagaauacaaguggagcaaacaagagaugaagaucuugauacagacucauuggacugaauuucccccuuccccccauugauggaagaauguuccagauucuaaauugaggacuucauuauuaauggcauuacuguguuaugauuaacaaauuuccuguaagguacacacuacauacuaaggucggccaucauuccuguuuuuuuuuuuuuuuuuuuuuuuuaaccaagcuuaaaaugaagcuuuguguuugaaaguaauaacaagcucagacgaagauggugguuguacauuauucaucuagaaaauauaaaaauucauuuuguuuugaagcuaguuauuaaacuggaauagcaguuauaucccugagaauggggcccuucucuugacauuccuuuguuguuuaauucuuuagaaucuuaauaaauguuuuuuuaauccugagagauuaaacaguaguagacuuguuaagaaugaaacuguaaccaaaauuuuaaaauaaaguuuuuuuuaaaaaaaaaaccugauuuuuagauauuuuuuguucuugucuauuugaauugguucauaauauggccugaacucuaagccaagguacuagaaauuaagauuucaauuuuaagugguuauuuuugugauugacaauaaaaugguaccuuuugugaaauguuagugaauguuacuggacgucauucaaguuugaugaauuggccaaaauuuuaaaaacaguguuaucuuaagucuauuuaacuuuaaagcuaacuucagaacucauuaaucugcuuguuacaugcacaaugauuaaauuggucuauuuuaagaugcagcuuuaaaaaagaauggauguagaagccauuaaacauuuauaggugucaucuucccauuguggccuguuuguccagugacccugaaauugcucuucuagcaacacacuauuugugaugucacugaaaagccagauaugauuuaaucuagcauguuaauuagaguuuugcuuauauuuaugcuacggaacugcaccauucuaagagcuacagucaguuccuuugcagucuaggcuauugacuuauuuuaaggaaaacauuuuuagcuuuuacauagggauugugggcauuuagucacaaaauuccaauguguugaaauauuuuuguuaacauuugauaggcagaauaaagaugaaggaaagaagccagaaguuaagaaaguggagaagaagcgagguuaguuauuucacuuucuaagauacauaaaauuauacauggaaaagaaguuauauagacauaacuuuucauguauugguuuuggaauaauuuuauacucauauccuacaaauagaauuuuucaaaucccuaaugggcuuuauauaaauugcauuguauuuuaagcauaaucaagugaacuugcuugaguuguuuauguuuaaugcucauuaauuauuugauggugucaaauuuuaguacacuugcugaaagcuggaugcuuucccauuucagacaaaucccuugguuaaacauaaggaaaagcagguguuuggggacuggagagcagaggaguuaucauaugcagacuauuuauuuuaggaaaaacgcagccaaguggugguuuugugcuuuuacacugcauguugcuuuucucaaccacuaaaaauggcaauaaguacuuauucuuaguuaagcuauugugcauaucuuugagcuucuuaguaaagauuacuaagaacauuuuuuuuuuaaguccacuaauucauuauacuuagccuguauauagaaauacugguuuuggaaaaacuguucacuguuuuucacauauuuuaauuuguagaaacaucaauggauucucgacuucaaaggauacaugcugagauuaaaaauucacucaaaauugauaaucuuguaaguguuuaacuucauuuaauacuucaguacugcauuuauagcuucaucuuuuauuuucucacaugaucuuaugaguauguaaauuuaagggauaauuacuggucauuuugcacuaccucuuuuuuuuuggaaacgaucuuuagaaacagauuguuuaaguguuaagauaauuaacagcuaugaaauuacuguuuugucaugaaggaugugaacagaugcauugaggccuuggaugaacuugcuucacuucaggucacaaugcaacaagcucagaaacacacagagaugauuacuacacugaaaaaaguaagugauuucaagucauguggauucuuugaauuuugucauuacuucauuuaaaaauuguuuaaaaaaucaauuaggaaaacaauuaugaugaauguauauuguuuucucagauacggcgauucaaaguuagucagguaaucauggaaaagucuacaauguuguauaacaaguuuaagaacauguucuugguuggugaaggagauuccgugaucacccaagugcugaauaaaucucuugcugaacaaagacagcaugaggaagcgaauaaaaccaaagaucaagggaagaaagggccaaacaaaaagcuagagaaggaacaaacagguaugugguaaaaagccaacaauuucacaccaguuuuuaaaccauuugccaggacugcuuuuaaaaauggcuuucauacauaguuucacuguguauacgccacagaaaaaguauacaaaggcaaaauggugaaaaucugaugggccuauugaaggacuagagcagugugcauugagaacaaaaaaucaugucaguuuauauucgacuucuaaggcagaaaccauugcucaugaggcagaugacucuggauaaacaauuuuuaaaaacccauccaucacaaugccuccuaaucccuagaguacccacuuccugguugcucagcugcuucuguuuucuucucaccuaaaaaguaaaauagcguacaguagccuuuuaaauuaaaacacagccucauagguggagacuacaccugccauuacuugauacagguauucugaugaugcugcugaguuacccugaacagacuucacaguauuaaugccauguccuuuuuuuuuuuuuuuuuuaaaagauggaguuucgcucuuguuguccaggcuggagugcaguggcgugaucucggcucaccacaacccuccaccuucuggguucaagcgauucuccugccucaaccuccagaguagcugggauuacaggcauacgccaccacaccuagcuaauuuuguauuuuuaguaggcacgggguuucuccauguuggucaggcuggucuugaacucccgaccuaugguaauccaccugccguggcuucccaaagugcugggauuacaggcaugagccaccgcgccuggugauaaagucuuacaaagcacuuagauguguagcauauauguaaggcacugaaccuuagcuucuacuuuuuucacuaacuuuagcaguaguuaaauccugcuaguacuuauuacuaacaguaguuauuuucuuuucauuuguauuaggaaaaauuuauaacuuauacaaauagaaauaacuucucauguccuugucauccagcuuuggcaguucaguuuaugaucauugugcuuuuguagcccauaagcuuucucuaugccccucuugaaaguuguuuuacgaaaaaucccugacauaccauuucacucauaaacauuucagaauguaugaaagacucuuaaaacagaaucauaguaccauuaucagcuccuccagucuuguuauuaaacaucuuaguggcagcugcuuaagguaaaagcuggcauuucaaaagcagucgguugguuuuuuguuuuuguugcuuuauuggggaaugacauggguccccuuagagaauuauuaauacgacuuacaggaaaacccccuuuauuaggcacaaaaauaucaauuaggaaauacuccuuuagcacuuuguucuaaaauaguaaauuuuaaaauuugauucacauugcuuuuccgugguagaauaaaugaauaugcuaagaauuacaacacccuguaguauuccugguaauaguaacaaccagaauaaucagauuaauaauccacuuccuguacucauagauaguuaaccugcuuuuuauggugccuuagcuacccaaagccucugguggucaucugcuccccuuuuugacaaagccaucaaaacccaauucuaacauucaagagagggcuguauuacaauguaauuucaaauaaaagacauuaaguaguagaaacacgauggccauguuguauuuugauucuggaucuuuaguggacaccuucaauuauuguuuuguaagcuuuaacaaaguuuuuccauuggauuccuucgcaagggucaaagacucuaaauggaggaucugaugcucaagaugguaaucagccacaacauaacggggagagcaaugaagacagcaaagacaaccaugaagccagcacgaagaaaaagugaggaauagguuuuaaugggucuuguguguuuuuuauuauucagguuuuuaaucacaguucuguuccaagguuaucuuacuauaauaagcaguuaucuuuugaucacccaauuccugaauucaguaagcaaguuacaauucaaaaaggaagaagaguaaaaaccuuuuauugacagugacuuugccacugaauucaagggaauggaacuagcugggaacccaguuaaaaagaaaauauuugcuccuggacuacuuuuacugagauacuguuaguaaugacuugcauucacacuuucuugaauugugaaaggauaauuguaaaaaguuagauggagaaucacaguuuuguuguuguuguuuuuucuuugagacagaguuucacucuuguugcucaggcuggagugcaauggcacgaucgugcucacugcaaccuccacuuccuggguucaagcgauucuccugccucagccucccaaguagcugggauuacaggcaccugccaccacgcccaucuaauuuuuuguauuuuuaguagagaugagguuucaccauguuggccagcccggccucgaacuccugaccucaggugauccacccaccuuggcuucccaguguugggauuacagcugugagccaacaugcccggccaucacaggcuauuuuuuaauacccacccuaaaauaggcuauggagccauaguugaagucuugcuuuguuccacuguguaucugaaggaguuagauagaagcaucccuucuaauucugaaauugagggaaaucuuguugucuauguguguaucaaccucucuuuuuauuaagauuuugaaauauguugguaucacagauauaaaacauucucauguucuuuaaagagaauucacuuuuaugcuagaaaugauggaaagggcuugguccaugacacuuugcugaguuauuuugcuucaucugcauauuacuuugggaagaagauacaacaugguaaaauaacaguuuugaagaagaaaaaaauaauaaugacuguucuaauaacaagucaaguuuuucuuuuguuugguugguuucagucuuuucauggguuuaaaaauauaaugcagacuuaaugucuuuuuuuccuucaucaggagaaaauccuaauuccaguuguaccuuucccccuuuucuucaggccauccagugaagagagagagacugaaauaucucugaaggauucuacacuagauaacuagguugacauaccuggaauauagagaacacuugagaaguuuguaaugguuuucauuugaaauagacugcugaaaguuuuaaauuuuuauaagcauagguuugauguugaaaacuuguuuugagggagaaaaucccuuuguuuuaaaguaaaguaaacauuaucgcuaaguguacuugugcaguauuaacagcuacauuauacaguaaaugugggauaaaauccauuuagaaaauguuaaacugcuuuuccagacaugguuguagcauauuuucaauuaguguguguauguuaauguguaauugauaguagaacaaaguuacauuuuuaaaacugcuacuuguauaaaccuugccucuuuucccaaauacuguggguuuugugcauaguuuuuacaaaccuuggauuuaccagacugucuuuucacuguuuguggguuuuguagaaguuacacauuuuuaugguagauaaaauguuacuucuauacaaguacucacucccuuuuuaucaaaaguuaauuuuaaucucacagucuacauugugcuacauuauccagcuucuuuggaacaaugugugcucuguaugguuuuuuuugguaugacaacuaauuaagcaacugacauggaacugagaauucuacaaacuauaaaacauuaauuuuugaagguaauuuaguuuuguggcugggcauucagugaagucuuaggacuucuuugcagacaacugacuggguauauauaggaaugaaucuggcuuuaggguuaaaucauuuaagguccuuuuauaggcaggcacuaguaacuaaaacugaaaacuaaguaaguuuauuuuugaggaauguuguuaaaaaugucuuuaggaagucacuaaaacuuaauuggaagaaaaaaucaugaugcuuauacaauaaauaugaauaaauguuauauaaggaaacucaccuauuugaaaucauggcuauauuguuuuuauuuucuagauuccaaaaauacaaacacuaguuguuccagcauuguacuuugauaagucuguacauugacguguauggacuaaauccaggguaaaaucaauguuacaaaauuuaaggguauguuaacuaaaggauagcauuucuaagauauuuugaauauuagggucauuuggcacuucucagcaaguaggauacuucucauguuuugaaauuauaugaauauggaaaaaaauggcuuaagaccagcgucucuguaugacauugugugguugacccucugagauaacuguuuucaucuacagaauugcauuuuugcuuuuaaagaggucuuauaauggaacuaggaaucaccguuuugagagaaccugcauauauaccagucauuaucuguuugguccuuauacaguuuuaacuuacuuagauuuauucuaguuaagccauaaguucaacguguaaacuuguuuucauuaaagaauuuuucuaucaa

SEQ ID NO: 191381 - RNA, 83391 nt, Homo sapiens
uguaacagaaaacaacaauuuuucauuuuauucaaccucaauuuuuauaugcaagguaauuccaaacuucuguugggucaguaaguguuaaguauuaaaacuaguaccaagucuugaguugcaaaaauauauacucucagacagugcaaaagauccauuuugaagguaaugaaaauuguacauaauuucugacaaauuguuucauuuagcauuuucacaauaaauucacacuagaauucugcauaggucagauuaacccugaaauguugaaagacugguacaauaacuauaauuuguaaaugguuacaucagguagaagggaguuagguuguuacuguaccauauggaaguaauuuuacugugucaacucauuuagucaucugcauaauuacuguaaacacacacaaaaccaauggcuuuuuaaaccaugcagagaguuaaggcaaacuuacuguuccuaagggauauuuuuaauaaaaggcaugauaaaugucaaagugaggcaugugagaucaugauuuucuuaaaccuacuggcaacaagcuuaauaaauuuacaguuuuaagacuuaauugauucaaccuaaaaacacaguauuuacaaaugcacauuuuuacucacaagcauacaaaucuaaauauacaagaauaaaacuuccgugugcagugcaaguuuaucccacagguuuuaaaaagucaucaauaccaacaauguaugugccugaaaaaagauuucauguucaaugacauacacuuuagcauuuuaagcacauuccaaugaauuccauaaauuauuaggcagcugauuuaauuucauuuuaacuaucugaugauugauucauuuguucccauuuuaaaacuauugcaaauuaacauugggaagaggauggaaguaacuggauaaucaagauaaaacccauuaagcaagauaauacauaauaugaaagguguauuauguugguacaaaaauaauugcgguuuuugccauuaauaguggcaaaaacuacaauuaauuuugugccaaccuaauacauuaaaguuagggaaggcagcugucaucagauuuucagguaauuuuaagauuaaugacuacagacaaguuuaguaguagucauuuauuuaauagucaaugagaccccuuucagaaaaccguauugcaacaugcaaucuauuuuaauaaauauacacuuagaauauggcuguauauacacauaccuacacagcccuacacauauacaaacuuacacaaauauguugcucucuuuuuuuuuuuuuuuuuuuuuugagacggucucacucugucacccaagcuggaguugcaguggcgugaucuccacucacuguagccucugccucaguucaagcgauucuccugccucagccugaguagcugggacuacaguggugcgccuggcuaauuuuuguauuuuuaguaaagacagggucucaccguguuggccaggcuggucucgaacuccuggccucaagugauccacccaccuugcucagccucccaaagugcugggauuacaggccugagccaccgugcccggccauguugcuuuuauaauugagauauuucauuuguuuuggggguuaggcaaauuuaauuugccauuccucaaacucaguaacuucaaauauaaacaaugccuagaaugaauaugguuccucauuauuucuaucaaacuacuacaaauacugaagaaucccaaaguaguuuuccacagaggcagaaaagcaguucagggguugaaaaucuucaauauuaauaagcccugggacauucaaauggcacuucauauuucaagguaaugcaauaugaaucauaauucauuauauauuguccccaagaguuacuucaauuccguauucaccaguucuuacgauuuggaaaaaaaaacuugaauguuuccagaugaaaucuaauccccaagccuugugugucaacauucuagugaaucucuauuuaaaugagaggcgcuccaaaacacuuccugcaccacucgacacuggcacuugguggagcaucaauuuucugcaaccuuucaagaaucucugaagacagacuauuguaugcaauuccauauucauugucaaaugccucugaaagaaauuuucaaaaaugaaguuguaauuuguuaagaaagacaacagccguucauuucaaauugguauugagucaaauuauauguauuugaacuauauauuuagaaguagaaaucuuuuaaaucuuuuauacauaccagcuacauuuuuaaaaauuacuuuugaaaauaaaauguaaaacuuccuuucauaaucuuuuauuaaccaacuuaccaauaucaauauucucucuuccuagagacacuaaugauaagaagaggauuucucuguauaaacuccuauaaaacaaauauguuuuaaaagucaaugggcaaauagcauaaaaacacagaugcauuuuuuuuaauggugaagacauuaaguucugucaucuaguuaauaguaauauaacuaugucaauguccugguuuuaauauuacauuacaguuaguuauaugaggugucacauuuggaggaagcugugugaaggcuacauugaauucuguacuauuuuuguaacuuccugcagguuucuauuccaaauuaaaguuaaaacauaguuaaugggcauaaagcuucacacuaguaacaaaaauggcuuaacuuuauuacauuucaacaauacauaacuguuuuaacucuaauuucuaaauaaaauuuacaaaagcagagucuucucucaucuuuugucacuugacaaaguaacagauuaauuucuaaguaaguuaggggucuaaaacccuugacacaaacaauguaaaaggugguguggucucuuuacuauuuaacccaauagcaaaggacaguucaccuuuauuugguuugugagcauuaaaauguuacaaaugaaacacuaaaagugagcuucaugacucaguuguuaaagaugacaggaaaacuuaagaaaugcacugauguacagagaaaaaaaagacguaaggcugauucuagugacacuugguaucacuuucuuuagaagcuucagaagccauaauaugacauuucuaauauuacauuccuguccuuaaacuacagaugcuugaagcaagcuacucauauuacagacugugaagaaggucaucucuaccucaacuacugauaguaaaaauggauccauccauuuucauuaucaauucuugcccugucacuucugagauuaucuucaaagaugccaugaccuaaaaaacuugaaggggaccauggaaacauuaggaauguuugauauacgcgauuacgcacacuauucugaagcuucuacugcaaaauucacuuauguugaggaggggaugaguacuaaucugagcauauuagcagacaauagugacaggagcacaauaacuccauauccuuuguaguucacugcgucuaucucuuugcuacauuguuucugcuccuauucccauauucucuuauguccaacaaaagaaaagauguguggguaucacaggcccugaauaagugguacguaaguuuaucaauguuaauaaauauaauuauagguuuccagcaaacagcaguaauguuuccaaaagacaguacacuuuagaucaaugaaugaucuucuuaaaauggaaucuauuuccacucuuuuuuuuuuuuugagacaggguuuugcuguugucacccagguggcagugcagcggugugaucacagcugacuguaaccuggaccuccugggcucaagaaauccuccugucuuacccucucaaguagcugaggucacaggcacauaccaccccugacaaauuauuuuuuguagagauggggucuugcuauguugcucaguccagucucaaacuccugagcucaagcaagcaauccuccugcuuuggccacccaaagugcugggauuacaggugugagccaccgugccaagcccccagacacuuuuauuauguguuuguguucaaguaggaauguauauaucuguguagcacuuaaaacaauagauguuuugcaaugaguauguguuucuucgacaacuagagauauuuuuaaaaguaagauauuuuuuuaaaaacaugaaaugacugagugguggcaagcaaaaaauacuggauuauuaccuuugucuuuucaugccuggcuucauuugcugugaaaguagguugauggguuuaagaacauuauugugcugaauacucugccugaugguuucuacuaaagugcuuguuucuuguuguuccucugacaggagagaugauuucuuuucagaaucuaacaauaagaacacaguaaguuuuuuuucaauuauuacuauuauuauuauuauuauuuuuuuuuuuuugagacaacaucucacucuguuacccaggcuggagugcagugaugugaucauggcucacugcaaccuucgucucccaggcucaagugauccucccaccucaaucucccaaauagcugggacuacagauguaugccaccaugcccagcuaauuuuuguauuuuuuguagagauagggucucaccagguugcccagguuggucucaaacuccugggcucaagcaaucugccucccaaagugcugggguuacaggcaugagccacugugcccagucccagucccaauuauuuaaaaaguuuuuucuccagaguugucgcauuuucuccuugcuuaaccaauagcacuuccccacuacuaguaaaauuauguggcagugugcccaacuaaaaaauauuuuuccugcuugcucccuucaaacaggcagaccugucacucugccuuucucuucuaauauaugguggcuuacugccugaggcuggaaugugauagcuuguacuccagcagccauaaaagcagguacaacagaaggaaccuggaucccugaugacagaggaguugucuagcaguacuagacugucuaguacauaacuuuuuuucuuuuuuaaaaauguauuuacuuaauuuuuggagacaggaucgcauucuguugccaaggcuggagugcaguggcugaucauuguaaccuucaacuccugggcucaagcaguccucccugcucagccucccaaauagcuaggacuacaggcaugcaccaucacaguuggcuaauuuauuuuauuuuuguagagauagggucuugcuauguugcccagacuagucuugaacucagccucaagcaguccuccugccucagccucccaaaucacuggaauuacaagcaugagccaaccaugucuagccuuauuuuuaaucaauaaguaaaaauuguauuuacuuaugguguacaacaugauguaauucauaacuuuuuagacaguuuuucacuccgucacccaggcuggagugaagucgugcaaucacagcucacugcagccuugaccuccugggcucaagcaauccuccugcuucagccucgaguagcugaggcuacaggggcaugccaccacaucuagcuaauuuuuuauuuuuauuuuuuguagagaugggcucccacuauguugcccagccuagucucaaacuccuggucccaagugauccucccaccuuggccuccaaaagugcuagccugauuugccuagccuaauaacuucauaugagagaauaaucuuuaccuguuucagccucuguuauuuucuguuaaauauagcagagucuagugcuaauuagaaggaacguaauucggccggguguaguggcucauggcuguaaucccagcacguugggaggcugaggcaggcggauugucuuuuucauuauacauuuaauuauauuguauuguguaacaccgccccuaaauaaagacaacugguaauaguucauuuguguuaaaccgaaaaaaaaaaaaaaaaaaauagcaaaguccucuguuaugauaacaggaaauacuggcugcuaugaguuuucauccuaggucuuccaccugcuaaaugauagacuuugaauaguguuaaucuucacacuaugcuauaauuucacaauuauugagauaagucucaaaccaaacauuacaccaauuuaaauacacaauucaaugguuuuuaguauauucaugaaguugugcaaccaucaucacuaucaauuuuagaacauguucauaucccaaaaagaaaccccaucucaaccccuuagcccuaggcaaccacuaaucuacuuucugucucuauacauuuucuuauucuggauauuucauauaaauggaauaauacaaucuaugcuccuucacaacugguuucucuucuagagugguuucaagauucaacuguguuguacauauaucaguacuucauuguuuucuguugccaaaugaaauuccauuguauggauauaccauacuuuauuuaucaauucauaauuuuuuuuucuuguuuuugagauggagucucgcucuguugcccaggcuggagugcagcagcagaaucucagcucacugcaaccucugccucccuggguucaagugauucuccugccucauccucccaaguagcugggacuacaggcaugugccaccacgcccagcuaauuuuuguauuucuuuuaguagagacgggguuuccccauguuggccagguuggucucgaacuccugaccucaagugaucugccggccucagccucccaaagugcugggauuacaggcgugcgccacugcgcucagcccucaauucauagacugauagacauuuguuuccguauuuuuggcuauuaugcaaaugcuauuaugaacauucaugugcaaguuuucauguggacaucauuucucuuagguauauacgugagugcaacugcuguaucauaugguaacucauaugguuugccauuuugaggagcugugaaacuguuuuccaaaggagcugcacaauuuuauauucuaacugacagugucugaggguuccacuuucuccacaucuucacuaacucguuauuauuuuuuuuuauuauagccauccuaguaaguaugaaguguuauuuccuugugguuuugauuugcauauccuugacagcuagugcuguugagcauuuuucaugagcuuuuggccauuugaacauuuuauuugaagaacuacugauuuacagccuuugcucauuuuaaaaauggguugccuuuuuauuacugaguuguaagaguacuuuacauagucuggguacaaauccuuuuuaagauaugauuugcaaauaucuccucccaaucugucgauugaccuuucacuuuuuugaugguuuaaauuucagaaguucuuucuuuugacuaaauccaacuuaucuacuuuuucuuuuguugauugugcuuuuguugcuuuuuuugaaggccuugccuaacuaacacggagucaugaagauuuacuccuauguuuucuucuaagugcuuuauaguuuuagcucuuacauuuagguuuaugacccauuuuuaguucauuucuauguaugauuugaggaaguauccaauuucauucuuuuuauuauugcuagccuguugucccagcacguguugaaaagacuauucuuuuuuuugagacagagucacucuguugcccaggcuggagugcaguggcgcaaucuuggcucacugcaagcuccgccuccuggguucacgccauucuccugccucagccucccgacuagcugggacuacagguacccgccaccacgccuggcuaauuuuuuuguauuuuuuuaguagagaugggguuucaccguguuagccaggauggucucgaucuccugaccucgugauccgcccgccucggccucccaaagugcugggauuacaggcgugagccacugcacccggccgaaaagacuaucuuaaauggucuucacacugaaaggcaacugaccauacauacaugugaggguuuauuucuggaacuucagcuauauuccaucaaccuaugucucuuuuuacaccaguauuuuacuuucuugauuacuguagcuuugcaguaaguuuucaaauugaagaacugugaguccuauaacacuguucuuuuucaagauuguuuucgugauucuaagucccuugaacauccauaugaauuucaagauucacuugucaauuuacguaaagaagcuaccugaaauucugauagggacugcauucaaucuguaaaucaauuuaggacuacuuccaucuuaauaauauuaacuuuuccagaccauaaacauuggauucuuuccauuuacuuauucuuuaauuucuuucaacaauuauuuaaguuuuuggaguguaaguuuugcauuucuuugguucaauuuauccauaaguauuuuguucuaaugcuauuauaaauaaauaaaauuguuuucuuaguuucauuuugaauuauuuguucaaagauauagaaauaguugauuucucuauacugaucuuauagccuggaaccuugcugaacuuaugcaguucuaauaugguguguguguauaauaauauguuaggugugugucuauuccuuagaauuuucuauauauuauauauauagaaaaaauaaauaucauuuaucauauaaucugcaaauauagauacacuuacuuuuuuccuuuccaguuuggaugccuuuucuuuucuugacuaauuacucuagcuagaaccucugguagaaugguaaauaaaaauggcaaaagugggcauccuugucuuacacuuguacuuagugagaaaguauguuaagaguaugguaucaacuguagauuuucauagaugcccauuaccaggcggaggaagaucuucucuauucccagcuugaugaguguuuuaaacaaagggugauggauuuugccaaaugauuuggcugugccuccugagaugaucacgugaauuuuguccuuuacucuauugauaguauauuacacaauugauuuucaaauguuaaaccacaauugcaugcuugagauaaaucccacuuugucaugguguaaaaucauuuuuauauauugcuggauuugaucugcuaguauuuuauucacgauuuuuaugucuauauuacuaaaugauacugauuuuuaauuuucuuaugaugucauuggucuuuguaucaggguaauaauggccuucugaccaaaaucuccacuguuuuugagagugcucucaggcuuaaacuucuccacacucuguuccaaauaaaauaauuuccuuuagggaaaauuucagagcucucuauucuuaugaccugccucucccccugggcaaaauuucuuuuuuuuucguuuucuuuuuguuuuuugagacagucucacucugucgcccaggcuggagugcaguggcacgaucucggcucacugcaacuuccgccucccaggccucccugauucuccugucucagccucccaacuagcugggauuacaagugcccaccaccacaccuggcaaauuuuuuuguauuuuuaguagaggcgggguuuuaucauguuggccaggcugguuucaaacuccugaccucaggugauccacccgccuuggccucccagaaugcugggauuacaggcgugagccaucgugcccagccccugggcaaaauuucuaagccacugcucuggagcuggggcugggaacaguggcccuucuuuuagagugacauuccugcuuuaugagcagggugcuagauagagacaugacccugucucaaaagaaaaaaaaaucuuacaguaaguauccuuguguaaacaguuagcuguguacuguauuucuauagaacagaguucucgaacugcaauuccugaguuuaaaggguauccacauaugaaaucuacaugucugccauauuguucuccagaaauguaucauuuuacacaucuaaaaguauaugaaaguguuccccaaacaucuucaacaaucuuuaaauuuuuuuaaacaaucuucaucuuuaacguuuuuugccaaccugacaguuacaaguuuauguuuuccuuuuuuuuuuucuuaacagacaggaaggcggggaggucucacuuugucacccaggcuggaguacacuggugcaaucauagcuaacugcugccuagaacuccugggcucaagggauucuccugccuuggacucccaaaguguugugguuacgggcguaagccaccacgccagccacauuauccuuuuuuucuuuuaugagauggagucuugcugcgaugcccaggcuggagugcaacggcgcaaucucggcucauugcaaccucugcuucccggguccaagcaauucuccugccucagccuccugaguagcugggauuacaggcgugcaucaccaagccuggcuaauuuuuuuuauauuuuuaguagagacagaguuucaccauauuggcuaggcuggucuugaacuccugaccucaagugauccaccugccucgaucucccaaagugcugggauuacaggcaugagccaccgugccaggccuacauuuuccuuuuuuaaaauauaaaguuauauuucacuuaauacuaguaugauugagcuuuuaaaauauguuuauauuacagacugaauugugucacccccaaauucauauguugaggcccuaauugccaaugugacucuauuuggagauaaggccuuuaaauaaauaauuaagguuacaugaggacauaagaguggggcacuaauguuuuuuuaauuuuuuuuuugagauggagucucacucugucgcccaggcuggagugaucuuggcucacugcaaccuccgccucccggguucaagcaauugucugccuuagccucccgagcagcuggaacuacaggugcccaccaccacgcccagcugaauuuuguauuuuuaguagagaugaccaagaccaucuuggccaugcuggucuugaacuccugaccucgugauccacccgcccucggccucccaaagugcugggauuacaggcaugagccacugcgccuggccaaguggggcccuaaccuaauacagcugaugucuuuauaagaaaaggagacaccaggaaugugugcaugugcaugcacacacacagagaaaagguuaugugaggguacagcaagagggcagccaucuacaggccaaagagaggccucagaagaaaccaaaccugcugaucccuuucuagauuuuagacuuccagccuccagaacugugagaaaauaaauuucuguuguuaaagccacccagucugugguauuuuauuauggcagcccuagcaaacuaauacaguuugaaagcugcuuaauguuuuuaauaugaauuaccuauuaauaucauuuggucauuucucuacugaauuguauuuuucuuacugauucacaaggcuuuugaauacaugaauaauaacucuuuaaacaccuuguaaaaauauacucuaaaagauuaaaaaugaagccagaacccuuaagaccagucaguaaccauuaauacagcugaacuuaugauccuauaccaacacaucuaaauuacucuucugcuauauagaauuuacucucaaaauagccaaccaaauuuuuacuugauagaaaaaucaccaaaaaaauuacucaacucaguugagacccgucacaauuaaaaaacaggucaguaaaacagcaaaccacuuuuucauuuguguguguguguguguacuuuuuuuuuuaacagcaaaucacuuugaauuaauuaaaaauuuaaaaauaaagcaaaauaauuugcuuuucuauauuuaacucuaggggaauuuaguuuaauucuguuucuuuuuuuucuucccagcaguccauucuuuauugcagaacaauauccuacaguauggauggaaugugccacaauuugcuuauccagucaccuauggaugcguauuugaguuguucccauuuugagucuuuuaugucuuuaacucuuuguuuuguuuuguuuuguuugagauacaaucuugcucugacacccaggcuggagugcaguggcaugaucucagcucauugcaaccuuugcugcccagguucaagcgauuuucaagccucagccuccugaguagcugggacuacaggcaccugcuaccacaccuggcuaaguuuuguauuuuuaauagagacaggauuucaccauguuggccagccuggucuccaacuccugaccucaagugguccgccagccuaggccucccaaagugcuggcauuacaggugcgagccacugcaccuggcuguuaugucuuuaauucuauuuuacuuacuaaaauuccuccaugagacauacagagguucucuugguuccugaugaagguugauauuaucccauaacagcugaauauacacaaguuugcuauccugggacagagaugacagaggaagcuaaaagaaaucaaaagaaaguauuaguaucccgagaauaacaauuaccaguagaucuagugaagcuugauuauauaaaacagaugaguccuuuuaaaauucuggaccuaaaauucagaaucaaaauuuuaauuuuuauuaaugucugaugacaaauguuauuauuauuuucugaggucaagguuucucagugugacuuuuaagaaaugggaugacaauuagcuaacuggcaugaugguuguagaaagauuaauuaccauuacagcaaauuuuaaggucaaagugcaagagguucuacuaccuuaccaaauaauuuuguuucaccuaccuaaucaaacuagaguuuauaguacuuuaaggaaagauuuuauuuugccccauguauauguuuagggccugagugucuaucaauauuaauccuauaaaauaaagcacucuaggagcucacugucucuaauggaaucaggaucccaguauaaguagaguuggggcuuuuaagucagacagccagaaugugaccuugggucuccaucacuuauuagguaugucaccuuacagaaauuacuaaauuucucuaacuuuuaauuauaacaucugaaaaauauggauaauauggguccuuucaaauaaggugguugugagaauugcagcugggaacagaacaguuaagaauaauagcuaccagccgggcacagucgcucacgccuguaaucccagcaguugggaggccgaggcagguggauugccuuaggucaggaauucaaaccagccugguaaaaucccaucucuaccaaaaauacaaaaauuaacuggaugugguggugggugccuguaaucccagcuacucgggaggcugaggcaggagaaucacuugaacccagaaaaaggaggcugcaaugagccgagaucacgccauugcacuccagccugggcaacauuuucuagcuacccuugcagacagauaugaccuaauaacugaguucaggccaagaaaauauauguagaaauauuaucuacaacuccaggagcuaucccuuaagaaaaaagacauacucuccucuccauccauuuuucuccuaacugcuggauagaaaguagaugugacagcuuggagguaaucagccauccuggaccaaaagcagaacuuggaaauggaggauaugcauagcuaaacaaaaauauaaaaggaucuuagguuccuaacacuuuaccauuccaggacugcuuauccaaacuuuuaagugagagagaaauaaaucugucuuguuaagcugcuacuguuguauacuuucaggaccuugaaguuaagccucauccuacugaauacuaauguaaguauaaaaguuggcacccuaccuguacaccuucauuacaauguucagaugugaggauaaguccuggcaaguuacuaggaagguccaaacgucugaaauaccaaacgagguuccagaaaaugauuggauguugauugaugaaagaagauguaugaaucaccugaucaccuucauuuucuagcaaagauucaaguucuuuacggaguacuagaggacucaaguagggcacagaaacagggggaggauugggucuuuuuccuaaaggauccuuaaaaaaaauacaaaaagaaauuaauauuaucuguuuaaaucuguaugcucaagagcacuucucaaugagauaaugccucucuauccuuuuuaaaucaguuauuuuaggaccauugcuacaugcaagagaauaugcuaaugaaugaaaaccuaaaaaagaaaauacuuaaauacuguuaaguuaaaucauuacaaaagaaaauuaaucaacagacucuuuaaaacauguucucuaucacacugagagcaauggccugaauguauuagguuuuuuucaauuuuuauaagaaauauuugcauuucagaugcuuuauaguaauguauguguguaaaaacugugugacauuaucuuccuccuacaacucuaaacugauggggcaaucuuuugcauuaauauucuuuguugacuuaacucacuuuuacaacugauugcaacaaaaacugaaggaauuaaagaaauagcauuuuuauaauucaaauaaaauaagaaaugaaaaaagacccaaccuagacuuugugaguuaugcauauuauaaucaggauaaaauguuuaagacucucucaucaacagugagucccccuggugccuagacuguggucuccaaaaccauuucccucuaaagggacccacaguuucuuagagaaacagcugauucuaggucuggguaagaaaguauauaacauaagcauaaaacaucuugucauauaagaaagcaagaaagcuuuuuaaaaauuacaaaaaugcuacuagaguugugucaaaaggacuaaugagcuaacuucuagaggcuucuagcugaccaaagagaauaauauaagcaugaacaacgauaaaaacagcaauagauauaaagauaaauguuuaaggcaugguagugugugccugugguuccaguuauuagggaggcugaagcaggaggaucacuugagcucaggaguuuaggaauagccugggcaacaaagcaagauccccaucucuaaaaauuaauuacuuaauuaaacauaaauguugaaaucaaugagcucauaaugauacccuauuccuccaaauuaauugaugaccuuggagaaugacagggacucaacucgcuauuuugaaaacucuaaauaaaaggaaaaaaucaagcauuuaaccugccuuuccacuauaaauuuuaucuuuugaaaaucuaacagagacauagggaaauuucuguuuauguauuccuuauuauaaggaagaaaugacagaaugagaccauuaucauuuuauagcuccuaaugaauuacuuuaucuaggcauuaaggcauuaauagcuacuaauguuuaugucuccugcugggaggaacauaccaccacugaugaaaucgucuuacaaaaauaaacaagcaaaugaacacuaacacaaaaaccccaaaucugaucaagguuccggacacaaauuccaacuuuuaucguugcaaucagcaaaaucuggauuauggaaaacuguacucuaaccaguuuuaucaacaaauaaauugcaagaggaaaagagucuacagauucaaaaagacuaaaaacuauaucaaccaagugcaauacacugacuuuauuugauccugauuccucaaacuacaacccacacauacacaagcacacauaugcauuugacauuuuugagacaaucagaaauuugaacagacuaaauaacuugauacuauuauuugggguuuuuuuuguaugauaaaagcagugugauuauauuuuucuaaaguccucaucauucagggauacauacugaaauauuuacuaacagaauaugugauguuugaaauuugcuucaaaauaaucucaaaaaaagagagaacugaaugagaauauacauaaaagaagaaugccauaaacugaaaauaacugaagcuagaugaugggggacucauuauacuguuucuuuuuguacauauuugaaauucuccacaauaaaaaguuauuuguuuauggaaaaacucuaucacuuuucauguaauuaaaauaaguccacuacagaagaauuuauaauguucuacuauauacuuagguguguaugcaguauaauuacaauguuguuguuguuacauaccacaacuuccugcagacuauuuggaagacuaacuguugagaugccaugaaacggucgcuggguaaagucaauauucugcaaugggccuccaacacugugacuucgagucaaagacacauuucgcuuugauaaacuauuaggcacagaugaaauuuucauaguuuggacaucuccacuggcucucuuuauuucaucacuuaaaaauaaauauagaagaaaugcuauguucauguugaaaaacagucuaaaucuguagagcuagaguauuuucuacaauggaccuugagucuacuaaauauaucuaagaagaaucagcaccaccuuguaagaauugcauuuccuucaaccauuuuuguaaaacuggucagaaaaacaggauggaguagaugguucuggugaggggugggaagaugacauauuguagauauacagguauuauuuuaaaaagacaaaguacccauucaguugcuuuacucaaauauuauuucaucuuuauuaaacaaaauuaccuagaaguaugcuauaugcaaauaaguacaauaaagacacugacaaguauuuaaucucuacuaggccacgauccaccuaaggagagagacccagucauauuuacuuuuuuauuuuuagagcuuagcauaauauuuagcauacaauagagucucaauaaauguuugauucaauuaguauuuaagggccaaguguacauuucacagaaagagaacauuucgccucuggaaacuggcaaugacuauauuaaaagggaaauauuuuacuguugagaaguucauuuuguaaaagacaacuguaaaauauuaaacuuaguucaaaaaugguuuaucaucagauucauucauuagcucguuaaacacuaugugguaauaaguuaagauguacucuuaaaugccagaacuuaugccuauaugagucagguugucuuuagagacagaauuuuuacaaggguaccccauuuauuacuacauaaagaggucucuguacccuuugauaccuugguucaacugcagagccuguuucuucaguuaugaucugguuauguuuugggaaguccauaaaguugaucaagucagguucugcuaaacuggauacagguuugugcuccaaggauucauuugccaauggaaugcuuccacuuuguaaacugucaccagagguacuugguuucaggaaaaagcuacauaaggaaaaggggggaaaaagagccuuuaaaaauccucaaguuuucuaaaauucuaucauauuuagaaucauuuuauugcuaaagcagucauuaauaaaauuauauauaauccagaaggaaaacacggccuauuuccaauacacucucacucucucucucucucucucucucucucucacacacacacacacauuccugcucucauuuucucuuccccuccuauccuaaacuuuucaaauacaagguuggaaaugguccaauaaaugauauuccaauuuuugagaaccacuaaagaaaacugugagggaagagggaaagcaaaauauuuuauuaauuuccugaguuaaaaaaaaaaauaaagagcugcaguagcagcacuuuaagauauauuaaccuauaauuacuuauaaugucuuuuaucacuuauaaaucuccaucuuguuucuaaucauuucuucucuguucauuguuuuauuuacaucuuaucucucuccuucucucuuugggugggacuugaggagggaagggccuugcaaggaacauuuagagaauuuucugagguaaugguaauguuuucuaaggguuuaauuugcacaaauacaugcauuuauucuucaaaugguauguuuaagauuuguacauuuugcuguauaucaauuuaucucaaaauaaaaaaauugucaauaaauacugaacucuaaugauaugcauaucaaagucuuugggggagaaauguauuaauaucucuaucucaccuucaaaugaauaaaaauuuaagauagauugguggagagacagauaggugauagacuaaguauaguaaaguguaaauugaaggacgcagggguagauauuugcgugcucauugaaaaaaaaccuuuaaaauuuguuguaagcuugaaauuuucuauaacaacauauucaggggacagacuuaauaaugcuccuuuauacccaauuugaaaaauauaaaauaaaaugcuugucacgauagcuuaaaaacacaauuaacucaaaaaguauaggacuuauggagaauaauuuaaaccuguguuaaaggacauaaaagaagaucugaaaaaaaauacagagauauaccaggcucacagauaagauaauaauaauagaaaagucaauuuuccucacauuaaucuauaaaucucaaagaaaacucuaguuggauuuuuuuugaggaccucaaacuuauucuaagaauucacaggaaagagcaagcauacaaaaaauaauaacaauacaauccaagagugggaacucacccuacuaaccagagauacaacacaaggaccaagugaugaaaacaacauggcauuaagaaaaacagcaagaaaaugcagaaccaagugagguauacaugggaacugaaauaugauaaaggugacaccauauagcaguaagcaaaggauagguuauuuaguggauaauauugggauaacuggauuguuacauggaggaaaaaugaaagcuggaucucuaccaucauauauaaaaaguagaauaaagauauauuaaagaccuaaacaucaaaaguaaaauauaagcaaaaacguucaaggauaaaaauuucagguccuagggauagggaacaacuuuaaaaacaagauuccaaaagcacaaauugcaagguaaaaaauuaauggaugacaucaaaauuaaugcuuucaaguaauuaauaucaauaauauucaagucagaucaacaagaaaaagaaagaucaauagaaaaauaggcaaugaauggccaggcaugguggcugacgccuguaaucccggcacuuugggagaccaaggugggcggaucacaaggucaugagaucgagaccauccuggcuaacauggugaaacccugucucuaccaaaaauacaaaaaaauuagccgggcgugguggugggugccuguagucccagcuacuugggaggcugaggcaggaggauggcaugaaccugggagguggggcuugcagugagccaagauugcgccacuguacuccagccugggugacagagcaagacuccaucucaaaaaaaaaaacaaacagccaaaaaagaaaaaaaaaauaggcaaugaacauaagcaaccaauucauagaaaaugcuagagcaggccaggugcaguggcucacgccuguaaucccagcacuuugggaggccaagguggguggaucaucugagaucaggaguucgagaccagccuggcuaacauggcgaaaccccaucucuacaaaaauuacaaaaauuagcugggcaugguggugggcacucccagcuacucgggaggcuaaggcaggagaaucgcuucaaccugggaggcagacguuguaggccaagauugugccauuggacuccagccugggcgacaagagugaaacucugucuccaaaaaaaaaaaaaaaaaaaaaggcuagaauaacaaguaaugaagagacacucaaauuugucaguaucaagagaaauucaaacaaugccaaaauuuaaaaagugauaauaccaaaugcugguaaggcuauauagaaaugagaauucuuggguacuacuugugggagugcagccgucuaggaagcaauauuuuguguuuacuaaaaucauguaugaaaaugaucuuacuccaaggauuaucguuuucuuagagaaacuacuucacaaguccaaaaggggacauguauuuugcagugcacugcauuacuaccgugguguuuguaguaacagagaacugaaaguaacugaaguacccaacacuagaauaauggauaaguagaaagguauauuaacuuccuguagaagaaaaggaauaaacuagauguacauauaguaacccagauuuaaaauagagcaauaaaaagaaguaaauuuagauauauaucacacuuagcagagucagugucuucguagaauaggggaaugagggugggaaugaggaaaggaggauaaacacgagagggcccuugcacaguccaaagaugauagugugucaggaauuaaagaguaugauuugacuuagcuccacccuugaagcuaaaagaaaaaacagagaagaaacaccucuacaauuaaauggugugauuucagcucacugcaaccuucgccuccuggguucaaaccauuuuccugccucagccuccugguugcugggacuacaggcaugugccauggugucgggcuaaccuuuuuuguauuuuuuuguagagaugggguuuugccauguugcccaggcuggucucgaacuccugaccucaagugaucugccugccucggccucccaaaguacugggauuacaggcaugagccaucaugcccagccuaaauguuuuuguuguuuuuucagagacagagucucucucugucacccagacuggagugcaguggugcaaucucagcucacugcaaccuccaccucccagguucaagcaauucuccugccucagccucccgggugccugggacuacaggcgcacgccgccacaccuggcuaaucuuuuguauuuuaguagagacaggguuucacuguguugcccaggcuggucucgaacuccugagcucaggcaauccaccugucugggccucccaaagugcuaggauuaaggugugagccaccacaccuggcaguguauuuuuuuuaaagcagcuaaaggcaggaaauaaaaaguucaauuuguuccauaaaaugaauggaauauuaaguauaauucccuaggucagcacagagucaccaaacucucaauuauuuuauguauaauuauagaucagcuagucuuauaucuauugccuagaauuuggucauuucacugcacagaauacuacuaggacgugcaagugacaagagaagaguugaagccuuuuuuuccccuuuguuucuucuaaaauauauacucacugcagcuucaaacuccugggcucacgcgauccuccuaugucagccuuccuaguaacugcuaccacaggugcacacuaccaugcccagcuaauuuuaaaaaaucuuuuguagagacagggucuugccauguugcccaggcuggucuugaacuccugaccucaagcaauccucccaccugggccucgcaaaguguugagauuacagcaugagccacggagcccggcugauaaucuuacuuuaaauaaaauggaaaaguagacucccacauuacuaguauuugcuacucaaauacugaaggugaaggacagacaggaaggcagaccuggagcauaccaggaauauuucacucuucucccagaagucguguuuuuugaggguacuuacuucuugagagagcuuuuauaagacuaaccuugcagaaccucucaaaucuuugaauucuauauugagaagaggcaagaaguugcuuuuacagaauggacaagcuguauucaaauuugagucaucugcuguccauccagccauaauuucuucaucauaaacuaaagcuccacaagcucuacacugugaacaacuggacaucaaaaccuaaaaacagaaaaaugcagacacugagaacguuuaauaaaaauuaaucuuaacaggaauucucuugagauaaugggauuuuuuuuauucuacugaucaaauuuggaauuauuaauaacaguucuuuuauuucacagguaaacuaccaguucaaugucuuacuuacauaagacaucaagcaaauucaacaaaaugacuuauuuuauuauacuguccacaaggguaucuuagaauccuguuaaaugccauucugaaauaaaaauaugcuuacagcuacuuuaucaugaacugaauauagaacuuuuaccuccauugcacaauucugauagaugcuagacaugcugguauuuugagaagaaccaugaucugauuuuucaaagucuugcccuuucaugccucuuggaaauggaacuucaccuacaaaggaauauacaucguaauaccuuaaguaaggaauguccuuguuuuuugaaaaugcaugccaaaguauuuaggggggacacagaauaaagucugcaacuguuuuucaaguggcucaguauaaaaauguaugcauacauagaaagagauaaaguuaacaauaguuaauuaaaucuagguggaaaauacaugauuguucauuauacgauucuuucaacuuucaggacauuugaaauuuuuuuuucuuuucuuuuuuuuuuuuuuagauggagucucgcucuguugcccaggcuagagugcagugguacaaucucggcucacugcaaccucugccucccagguucaagugauucuccugccuccgccucccagguagcugggauuacaggcgcacgcugccacgccuggcuaauuuuuuuuguauuuuaguagagacgguuucacuguguugcccaggcuggucuugaacuccugagcucaggcaauccacccgccuugccucccgaagugcuaggauuacaggcaugagccacuguguccgguuuggacauuuuaaauuuuuacaguaaaaagucagagaaaaagaaccgaauuauaauuuuaaaaaguaacauggaguaagaaacuucaaugacacauccuagugauucuccaacucugguauacaucggauucacccagagaacugcuuaaaaauacacauucccaaggccccaucucacaaauucagucucagaaguuuuagcguuaggcuuggacauuugcauuuauuuugaaacaaauuucccagauuauucugaugcaugccaaaguuugagaacuaaugauauaauccgugaauauauacaacuaaaaacaaaggcaguaggugaccacaguaguuauaaaucauacaagaucagaauagaucauaaggcggcuaguauuaaaaaucucucaaucauuucaacaaauggggcuuauugagcggggaguuacaggcaucuaaauuaaaauaagcaaagacaggccaggcgcuguggcucacgcuuguaaucccagcacuuugggaggccgaggcaggcagauugcuugagcccaggaguucgagaccagccugggcaacaagacaaaaccccgucucuuaaauuaaaaaaaaaaagcaaaaacuauuauaaagcaaaugaagaaaggauaauccuuccccauaccuguuggauaaugcaguuuuccuacaucuccacuacugcugcuacugccaagacuuguguugcucuggguaaguucacuggggaccaacccugagauacuuguguuaggcgauauauucucccccaaaauauggucuucuaggccagcugggaagcuguagucucuauuaguuucuuccuuuaauugaaaaaaaaaaauuccacauacauaaauaauaccuucuccagugggauuauacccacucuacccuuuucaaaauuaaacucuauaauccuuaaacaaaucaucauccccacauuuuucaaaaccaugaaaucuccucacuauuauuucacuuccacacucuaagacauucaagccauaagcaacaauacuuuaagaaagaucguggugugccucagguguaugugggaggucugggugucucucaauauugaaucuuauaaaauaacagaauucuagggagcccacugucuccaauggaaucaggaaucccaguacaaguagaguagggguuuuugaaucagacagccagauugugaccuuguucuccaccauuuauuagauauguaaacuuacagaaauuacuaaacuucuuuaacuuuuaauuauguaaucugaaaauauggauaauaugaguuguuucaaauaaagcugcugugauaauuucggcugggaaucugaauguucagaauaacaaauaucaauauuagagccaagaaacaugaauaaaguuucaaacacuguaguucuuaacuacauaggugauuguugaagcuuuagguagaaaacauuucaacaaucagguuuuuuugcuuuaaaaaugaaagauuugugucuuccuuguuauaaaaccauguuacaugauuuuaaaaaauuaaauacagauaagcaaaacaaggaaugaaaaaugcuuaugauaucaacagucagagaauauaaucaaaaucuugauauacaucuuucuagucauuuaaaacauacauauaaaaucauauaaaucuuuacaaauuagaauauuguuuuucaccuguacuucuuauguaauuauuuuaaugucauuaaauuuucuucuaauuauuuaaacaccugugaacuaaucuguuuuacugauauacuauuauguauuuacuaacuccccuguugcuuaaacauucaaaaugcuucaaucuuauauaaauuacauugguaaauuccucuauuuuuacauauaccucuaauuaauuccuuaaacucgggaugaaaguuaaaaacauuuuauagacuuuucauucauuccuucauguguaaauauuuauuagguaucuccuauuugccuuuugccagguacugcuuacuggugccagggauguaacaaugaaaagacaagacaagauccacagugacuuggaauuuacagugucacauauuccaaguccacauaucccuguguaauguacuucuguuuuuaacagauaauuuuuggggaggcaagggagaaagggucucuaucacccaggcuggagugcaguggugugaucucggcucacugcgaccucugccuccugggcucaagcuauccucccaccucaccuucuggaguagcugagacuacagguacaugacaucacgcccagcuaauuuuuguauuuuuuuguauagaugggguuucaccauguugcccaugcuaggcucaaacuccugggcucaagcaaaugcccacuucaaccucugaaagugcugggauuacaggcaugaguccucauaaccaaccucaauaaaauuucaaaaauaaaacaaaggccgggugcaguggcucauggcuguaaucccagcacuuugggagaccuaggaacacuugagcccaggaguccaagaccagcuugggcaacauagcaagacccuaucucuacaaaaaauaaaauauuagcagucaugguggggcacgccuggaguccuagcaaucaggaggcugaggcaggaggauugcuugagcccagggggucaaggcuacagugagccaucccugugccacuguauuccagcuuggguaacagagcaagugccugucucaaaaaauaaaauaaaaugauacacuuuuuuuuuucuuuuuuaucauaaugccagauuaagacaguuuggaagcuauuuuauuucgccuucccuugacugaccucguaagcucuuuaaauacaaaauaguuaauuuauaauguucaauacuauacuuuuaauucaauuauuauuuugucuauaaaguauuccuucaaaugguauaaaagucuuauacgucuaauuuuuuuucccacgucucuaauuccaauuuagaccuuuuacgaucugaaauugauuauauuaccuugaaaguacaugaugcuuuaagcuuccaagccauuucacauuauucuuucagauauacucuucugacacucuucuuacagcuuuaaccccaaaugucaaauuuauccuucaaauccuaaauuagauaucaccugcuuugcuuuuuuucuggauagcccccaaccugaaccucuuuucauauauugcucuuugguaucuucuccugagauaucgcuucuaagguaagagcauggacucuagagccaaucucucugacuucaaaucauaguucuacuauucccuaguuguaucaucuugagaagcuaauuagccucucugaguuucaaauaucaucuacaaaaucaggauaacaacaguaccacccucaugggguugcugugaaaauuaaacaaauaccuauguuuguauauauucauauauaaaaccagacauauagcuuauaacaguaccuaggacauacuguuaaauaacgagagcaaacauuauacauaucugccuuaucuacuaaaguacucaaauacuauacaauuucauacaaggugaaauuucaauuuuuuucuguaaaacaagcaaaacuuacccacuuuuguuuuuaccaaaagaucuaaugauuaacucuauguauaacguuuuuuuaaagacaauuauuuuugccaugugguaugaaauccauggauuaagcugcagcuugacuucauauguauuaaggagauuacauagguaaaaauuauuuuaaaagugaaugcuacacaaauauaacauggcauuuuuauuaacuucaaacacuaaucauuagagcuuucaaagaaauaaauaauguuuuaguuuagacuaguguauggaauuauaaaauggucccaauauucuauuucuacauuauuaacuuccuuacauauacgguucaaguuacuucaagaaagaaaccaaauaugcauaguuuuuaaauaugaaaaccaaaguuaccagaacugucuuaauaauccuucacauauuuuuaaaaagauauacaaacauuccauaucagauagacuacacaaaauagacuacagauagacuauucuauauuagauagacuaugcaaaauauaaaaaccaaaguuaccagaaaucagccaggcaugguggcucaugccuguaaucccagcacuuugggaggcugaugcaguuggaucaccugaggugaggaguucaagaccagccuggccaacauggugaaaccucaucucuacuaaaaauacaaaaauuagcugggcaugguggcacaccccuauagacccaacuacucaggcaagagaaucgcucaaagccgggaggcagagguugcagacagccaaaaucaugccacuguacuccagccugggcacagaaaucucugaacaagaauacauauauuucuagaaagauacuauaaacacuccaauagcagacagacuacacacauaaagcuuucuuaccucaucaucugaguagcuguaggcagacgcaacagcuacccacaucuuacuggcuacugucgcugcuuguuucauaccagauuucaggacaucuaucuugggcccugagaguauauuauccagcuuuagcccugacaaagaauuuacuacagaacccaacgagccauguggcgaagaacgcaccagugcugacaaagaaguugaacguucuuuaugaguucgagaggggguuugcugcuugaaacgcccaguaaaaguuuuagaccuggacacugcaggugagcucuuuucacuuucaggauuuuccugugcuggugaaccaugaucuaaagguaggcuugaucuccucucuagagcaugaauaaaugcaguagucaugccagacucucuguuuuccucucuguguaauuccauacuagaagauuuacuaccuaggggacuuuuuagguucauauagcuuucuauuucaucagccagauuacgugcaauaacuggagaaaacaacuuaucuucagaaucaggaguuuuuccuccuguacauucaguggcuaaaagagacaaaggaucuaguccaguuucaacaucuucccucugaaccaccuuagcaauaccauauaaacuacuucucuuauuccucagaucuuuggauacuguuuucaagucucuggacugauuacuguuacuaucacuuaguagacucucauauguaucuacuguugcaguaguuuuagguacgucaucaaccacaggcucaaggaguucuuggcuuuccucaagcaucucuggcaccggagaugaucugugcucaggauuccaagugcuuucagacauacaaguccuacuaucagguaggugacagcuaacauucucaaagcuauggguucuugcaauaugaaguagagaagucuuaggacaugucaaugcugcugugagaaucuuggcaucugcucccaucaugauagccauuucacuugaauucgaauccaaacuacucuucuuaagcaacauuccugcucgacuuucagaacuaaaacuacaacuccucucaggaaaaugcuuuugucuuuuuucuccucuaucaccauucuucuugagauuaguagcuucgccaaagacugcaucuucaacuggaucuugaguagaaaacagcacauuugauauacuaccuaaaagggaaaguaaaauauuaacaaugaaccuauuuuccaaguuaacuuuuauuaaaauauuuauuguuuuccugauuaugaaugugacauauacucagaauaaaagauccagaaaauuuagaggccauaaagaaaguauaaaaaaaagugcacuggaaaagcuauuuaaaacuugccucccagggacauuuuaauguauaaccugucuuucauccuauauuuauauaaacacccauuuaaaaaaacaaaucaugcaacauaugauagauggauauaccuguguucuucacuaaaauacagaaaaagaaagaaucucuuccaucuuaguuuuguauccaauucaacaaauacuugccaguaaucuacucugcaaaaagcaaauuuguaaucuuauaggaauuguauauuugcuauacucaaagucuuacugcuguaaaguaaaauaauccggaauggaaugcuuagcacuggcaaauucuaagaaggcugauaaaaucugagugguuaaaaaauuauucagauauauccauuucuucaacaaauacuaaacgucuacuaguagccacuauaugaggugcuaggaauauaaaggcaaauaaaacagacauaauccuagccuucacagaagucagucuuauuugaucagguagagaaaaaauaugcuaauggccauagcagcuucccccagcuuuggaaaaagaaagcagucuuuuacucuuggcuaccaugcaauuuguuucacuccaagaccaaaagcuguuauuuccuauuugaaucauuauuagaacuuaagucuaccuguuauggacugaauguuuguguccgccaaaauccacaugcuaaaauccuaacccucagugugacaguauuaggaggcagggccuuugaaagauaauuugaucaugaaaguggaacccugaugaaugggauuagagcccuuaaaggagagcucucuccuucucugcuguacgaggauacaauaaguuagcacucugcaaccuggaagagggcccucugcagaacucaccaugcuaacacccuaacccuggacuuuccagccccuagaacuauaagaaauaaauuucuuucuuuuauuuuuuuuuaaguuaggguuaugccgggcaugguggcucacaccuguaaucccagcacuuugggaggcugaggcaggcggaucaccugagcucaggagcucgagaccagccugggcaacauggagaaacccugucuccgcaaaaaaauacaaaaauuagccagaugugguggcauucgccuguagucccagcuacuugggggucugaggcgggagaauccucaauugccugagcccaggaaguugaggcugcagugagccaugacugugccacuacacuccagccuaggcgacagagugagagucugucucaaaaacaaacaaacaaaguuagggucuugcucugucaccuaggguggagaguacaguggugcaaucauggcucacuacagccucaaucuccuggccucaagcgaucuuucccuccagccugccaaauugcugggauuacaggcaugagccacugagcccggcagaaauaaauuucuguuguuuauaagucaccuagucuguggaacuguauagcagccugaguuauucauauuuaggauucucauuuguguuuuucuuuuccuucguuuucuuuuuuauccauugcuuuuuacuguagucacaucauuuguuuuguuaaaaagcauaacaauaucugggugcuucaaggaaaaaagcugucuuagauaagaucuuucuuuuaaacuucaagauugauuucaagguucuuuuuaaucuuucaaguuaguacugauaaucauaucaauuaaucagaauaagcauuuagagauauucuuuuaagccuucacgggaauuaaacuaaccuauuuuacaacucaaaauauguaccugcuuugaaagcuggucccaauauuugagaaacaaauccuugcaaauauuauugguucucauaguauuuccaaggaauuuaacggcacauuuuauucaauguuuuuuaaaaaaaauuugcuauacugacaaaagccccauuauccucgcccuucguucuuaauaugaaaauaaguuaaaagggaaggaaacacaacaguccacagacgauguccaguucaauauuuugagaggauucuaagccucugacgaagaaaacucuucccuccuuuuccccaguaucucugcuaucaagagguuaggaaaauggaaucugcaauguauauaucaauuauuuucucaaaaaaucuuuagccccaccucuugagcacuacccaaacaaguaaugagugaaacucggagucacgguaaauacaaagagaaaagacuuuaagaacaaggaguacuuuuacauugguuuaagaagcugaacaaauuaauuucuguacagucauacaauagauacauuuucagacaagacagucaacuucagaaaagucaacugcagccaccacuaaugaagggcaaaggaugcaggccaauuucauugucuuuuaaaaucauauacuuggauaugugccauaagagucuugggagaccuauauauauaaugaaaguagaaaacucaaauucaagggagucauacacacagaguuauuuaguacaaacacuuaaucacaaauaaaaaauggcuugggguaccuauaacaauggccaaaaucaaagauccacuggcauaucuguguagaggggaaaugacgugaaucuuuuucuuccauuucccuucagugauaggaauuagccugccacucauaagcccucuggaauuugaucacaucacugccuguucaugaugcauacaggaagcccuaaaaguacacuuucuuauuaucuauaaugagaaagaguggccaaacgguggacaggcaccacaacaggaaaggguauuccaaauaacaaacacacuaaauacuccuuuuaaaaaucaaacaccuuuaaauaacaauauuuucaauuucuuuagccgauuuagagaauucaaaagucccuucuggcucuuuagcauguucauuacaauuaagucaaaaauuuaaugucauuaaagacacauaugagucuauaaaaguauauuuuaaauauuuaauaaccaaaauguaaagacucaccagugcuacuuuuccugcuguugacaucaaauauaccagacggaacuuucacaauacugcugccccaugcaggagguucaguaggacugugaggcucuggacuagguugugaauguuuugccacaauagcagaggcaucacacaccucuggaaaaaaauauuuggauguuaucauuccuacuuuugccaauauuaaacagaaaccauauauugacuuuuagauauuguauguauuuuucuccaacagucagugugucuauuuuacuuuagacacaaaguaaaauagacugugucugguuuacuuuaugccauaaaugcugccaauauuaacugaaauaaaugcuuuguuuuagcauucaauaauccuaacauaaauguucuuuagugaaucaauuaagucucuggccuucaguucuccuucucaucacuuggcaaauggagaggggcuuguuucuccauaacucuggaguauaaaauaaauaacauuaaagaaaguacacuuuugugauagagaacaggaagagugucuuauuccauaagccaaaauauuccuccauguuuucauaaaaugauuacaacaaauuaucucugccuuaaugaguccuauaaaaaccgggaaaaaccacauagacuuuuuuuuuuuuuuuuuuuuuuugagauggagucuugcucuugucgcccaggcuagagugcaauggcacaauauuggcugacugcaacuuucgcuucccagguucaaaugacucuccugccucagccuccccaguaccugggauuacagaggugcugccacuaugccuggcuaauuuuuguauuuuuaguagagacgggguuucgccacguuggccaggcuggucucaaacgccugaccacgugauccgcccaccucagccucccaaagugcugggaauacaggcgugagccaccacgcccagcccacauagacuauuuuuaaccuaccaaugaaaacuaugcaccuagauauuugaaggacugcuagugaaagagccuuuuagaauuaaaaagggcacuaaaauagaaguuuuaauaacucaaaguuuaguccugguucugucaaaaguagcuauguaauuuuggcaaauaccucaaugggucacacuucccuggaaaauuaugggcugaccuacagagucucuaaagguaucuuacagccaggugugguggcucacaccuguaaucccagcacuuugggaggcugaggcaggaagaucacuugagcucaguaggucaagacuagccggggcaacauggugagaccuugucucuacaaaacauaaaaaaauuagcugggugugguggcacgugccuguggucccagcugacaggggacugaggcaggaggaucauaugaggccaggagauagggcugcaguaauacauguucucgccacugcacucagccugggcgagagagcaagacccugccucaaaaaaaaaaaaaaaaaaagaaagaaagaaaguucucuuaaauuuuaaaacuucagagacuaccaaaaucuaccuuauguaacaguacacagcaucuuaggagccagaccuuacauuugugaaaauaaucaucaaagcuaucaacuaagauaaacuuuuaauuauuaauaauacagguauuauucuaaguaaaguucguaaauaucaguacuuaaccuucuguuugcauuuuuguuuuaguuaucaauucucuugcugccuguucuucaggcacaugaauuucugcaucauccuuuauaaguucauccuuagacccguauccuuggucagacugaccaccuguuaaaaagaaugcagacuuacauauaaauguuuucauauacuuauaauucauauauaaaaaucacaagaaaauuccacugaucuacacaauuacgguuagacaaaaggaagacaagaaagcacacaaggaacacagaacauuuuaaaaauaaugauaagccgcaaagaacaguagaaacaggaacaucaaagacuaaacacauuuggaagcacuacaucuuaauuucuucaucuguaaauuaaaaagauuuagacaagauguuuggaagucucuuuuggagaccgugucuacagaaugcuaacuucucuguaagaauaaaacacacauauaucugcuuacuuuugcaaaaaguaaugcaggcaaaauaaaccagaaaacaguaaagaugguuaccuaccaggguuggggggaaauaagauacaaugaauaaagagggagaaaacuucucuauguauggcuuaugguauugcuuuuaucuuuggagauagaauacacuucugcauguuaaaaaaaaaauaaaaucaguaagauagaaggggugcaacugaaugcaaauggaaacaaaugaagccaacuguauuucacaugaauaacauaaucacacugaaagggccaggggaggacuaauccaaguaacuuugaacacauuauuuugaguaucuacccuaagccugggaguaacagacaaauccugaacaucuuaguagguuuguuuuugacagagaaaugggugugacaauucugaaauuauuuuuuauguacaguacacguauuuucuagcuuaggaaaaaaguuuagaagcaguaacacuauguuaacacugagcccaaaucuuggcuucuaaaaucuauuccccaugaaaaagaaccugggauccccgaagaaauggcugauuccagagcucagacagagaagguacaagauugagcuagaacauucuguugugccaaaaagguagugcucagaaacauaauaggagaauaucuaaaggacauaaaaacuagcuuaaaggagcucccacuggccaacacggggauaaucugaggaccaaauaaggacaguaaugaauuauauuucaaugaauaaaacaggaguacaucaguccauacugauaauaaauaagaaaaaaauagagaauggagaauuaucuauauacuacaauaucaucuucuaaauaugaaaacagugauagaguuggcaaaaucaccacuuuguagccaucauaguaaugacugguucaggcaagcaucaucaauggaugccaaauuuaaaagagaaagugucaugagaaaggauauuagcacauugucucagaguguucuuucaaaaauagcuuaucaucugagaggaaaaaaauauuauaguaacuauccacagagaaaccagacaauagugagacuaggugauccaaauuaauaucaccgaugaaggucagacugugugugccuguaggacgugacaaccugagaaggagucaacaucauuuacguagcacacccauggaugcauaaccuaaacacuaggaaauaacagacaaaccuaaguuaagaaacauuccacaaaauaauuaaaaugaauucuucaaaaaggccaaggucauaaaagauuuuuuaaaggcuaaagaacuaugccagguuaaggaagacuaaagaaaggggguuaaaguaccacaaggaacacugggauaacugacaaacuuggaauauaaauuauaaagugguauaucaauguuuuccugaauuugguaaccaaagugugguuauauacaagagaaaaugccacugaaauaauaaagagguaaaagggcaagauguauguaaccugcucacaugacuuaggaaaaagaaaugguaugugcaugcaugcagaaugaaaauaauaaaggaaauguggcaaacuaaaaacaagggaaucuagauaaaagauaugagaguuuucuguauuauucuugcaacuuuucuguaaguuugaaguuauuucaaauauuuuaaaagucuuuuuugacuuuauacuucuauacuuuaaaaucaaaacuaagaucagguacuagagaaaacaguauaaagaugucaauaaaagacacauaaaauaacauaugcaguaccuccauuuuccaucacuuauuacacugccacucagacucuggguuugccauacaacaaaagaauuaaaugucuuuaaauacuacuacuuagaaugacuaacuucagucacuuuuuuacuagcucccucaaaaagucugguaaagcaauguggugccaugaaaugaacacuaggcugggaccugggugaauuaaaaccaaacaugccccuaacagcuaagugacucuguaccagguaccaaguggaaagauuccacgagauaauccuuaaugaaaugagcaacuuaagcaccugggcugaagacuccaaaagcaucaaauggcaucgccagaaguucuacagagacacaccaucacugcaaauucaguauguggcauucggucauuugaaaugcagcuaaaauauauauaagggggaccugaagguuugugcccaacuauugaagucuuuauaccaauuacccagcauuacuaggagauugguauuuccauuaaaggaguaaauugccucuauaaugagguaaacuuaaaaaucugaaggaauaaggggaaagguguuuauguauuacuauuacuauuccugguaaacguuuucauacaaaaaaauauauuuuuuugcuuuuuauacaugaagcccauuucuucuacaaguaucaugaaaaaaauacuagaggaaauaaaauaugguggcuuuaaaauaaaaguuucauaaaaauucuuauuuguuaauauaauauacaaacaugauggcaaacugaggaaguuaauuacaaacaggauuguaaccuguagcuuuauguugacuuucaaauuuacacaugcuccuguaauuaugugaagguuguuuuuagcacaagaauucagcagauaaguuuuggaaagcaauggccacaccaccuuaacagcugaaacaauuaauucuucaaugccuauaacacuauuugucacacugaugcuacaaaccaaccucaaaauaagaauuuuagcaaggcauaauauauuuucaaauaagauaacaaacaugcuuugcaaacugaccauaaaaaguuagcuggauauuuucaagagucuauauaugauuacauuuaucugaaggagaaaaggcaagaaaaugaaaacuguuuaccacucaaaacaaacuuaaaauacaaugaaaggucuuucccccacccuugcaggucagcaaaauuuaaccuaauaaaugggaaauuaccugaugugguuaacauucaaggguagaauuaaugcacacguguauccauagcuucacgucauauaagucugucugcaccccacaccaugacagccaaggacaaaugcagcaccaagaaacagcacagagcaaaaagcaaagcaacaaagagcagagaaaaggaaacuucagucauugagacaaguucaucagaugaagcacaggaauuagacccagaauucuuuuuaaaggaaggcuugagauauuaaaaacaaccacaacaaaaaaacaacacaagaagaaggauauguaacacacauauaucugcacaacgugcuacuuuaguuacacuuauuucuaacuucagaggagagggauuauucccauggcuauguacauaaaagcagcuucaauaacuucucagaucuuaaaaaauguaacuuaaagagaauacuuuuucucauugugugacuuccuuccuucccucuuuaauauucauacucuugaaguuuuaagauacauuuucuauuuaauuuuuuaaaaagauuugcaaguugugucacuaauuuucaaguuccuuagcucaugauuccuaauuauagcauacacuuucacaaacuaaugauaaacaaauacaaagaagcaucaugcuagagcacugugcacagcacucccauacuaauuuuguacuauaggaaauaaacagaagucaucugcagacucguauuguuucucuuguaagcauacaguacuuuuaaaguagucauaucacacaaacucaagaauggaagaagcuuuuugaaaaaggaaagauuuaacaugagaguaagugaaggguuaguaaaaucuggauuuuaguaccugugcuagagugauuaucaauggacucaagccugauuaaaucucugacgaagacugugugcuccccauuguuagcaucauuagaacuauccacacuaccguggcucaccguguccccaucacuuccaccugugacauuuugaagagcuaaagauaaggacaauagcaguucaauaacucaugcauugauaaucucuuaaacuaaacaugauugacccacaguucauuuauaguugcagaacacuuucuaaauuucuggaaaaaaacaaaaauaauuuuggacuaagacaaucugucuuuaaauguaugugaaaaugucuaccggaauuuaaguuuucuacuucacauagcuaaaaauucauaugccuauaaagcucaugguucaguaaggaauuauauuucuaaucacauguauuaccugauauugaggagaccugugaccuuugcacagucuuuuuaagcggcugccuaaacugugccaagccacguaccacauuccguaccuucguccauaagaaaauaccacugcggguacugcuaggccacgggcucuccaagacuaccuaaagguaaaauaaggguaaaaauaauguucauuagcaauaucugauuuuaaaaauacauacauauauguguguguguauguuuauauauauauauacacaaauauaaaaaguuauacuggccaagagguauauuaaaaaaugcuaaacauuacuaaacaucagagaaaugcaaauuaagacuacaaugagauaucuuaucaccucauacuuguuagaauauugucaaaaaaaacaaaagauguugauuaaggauguggacaaaagaaccccuacacagucuugguggaaaugcaaauuaguacagccauuaaaaagauuccucacaaacaguauagaguuuccucaaaaaauuaaaacuagagcuaccauaucauccagcaauccuauuacuggguauagauaugcaaaagaaaugaaaucaguauauugaagagagaucuguacucccauguuuauugcagcauuauucacaauaaccaacauaugaaaucaaccuaaguguuuaucaauguaugaauggaugaagaaaaugugguauauauacacaacgagauacuauucagccugaaauaaaaaaggaaacccaguaauuugugacaauaugaaugaacccagaggacauuaugguaagugaaauaagccaggcacagaaagacaaauaccgcaagaucucacauauauaugagauccaggaaagugaaacccauaaaagcagagacuagaaguaugguuaccaggggcuuugggagguaaggggaaaggggacacuggaagauguuggucaaaggauacaaaacuucaguucaguaggagaaauaaauucaagaaaucuauugaacaacauggggacuacaguuaauaacaauguauuguauuuugaaaauuucuaagagauuagaaguguucucaccacaaaacaaugaaggcauauguuaauuauuuaauagcucgauugagccauuccacaauauacauaucucaaaacaucauauuguacaugauaaauauauauacuuuuugucaauuuuuaauaauuauaaaaauuauuaaaaaauuauaucccaaaacuuccuuuaauaggaguuucaugaauaacuaaagguauacaaaauaaucauucuuaauaaacaccacaucuugccuaaugucgauccuacuuaccuuauuauaauaaccauaaguaauagcauuaggcuuuauccuagcaguuuucauuucaaauaagacucucacugcuaaaacaggaugaccccaaaguccacaaagcugcaucacuacucgauagcacaccuaacaaaaaaaaaaaaucagugucaguaauuaguauacuaaucuaucugugaauuguagagauuuuacugaauucuuuccaugaaguuauuaagcaguauuuucuccuuuguucugcuuugagcaucuuagcaaauuauuuuuaagaccuauucaggcugggcacaguggcucacgccucacagcacuuagggaggcugagacggguggaucaccugaggucaggaguucgagaccaaccuggccaacauggugaaaccccaucucuacuaacaguacaaaaauuagaugggcaugguggugcauaccuguaaucccagcuacuugggaagcugaggcacgagaaucgcuugaagccaggagguagagguuguaaugagcccagaucacgccacugcacuccagccugggcaacagagugagacucugucucaaaaaaaaaagaaaaaaaaaaaaaaacccaaaaacaaaccuauucauuaaugcaaguaucaucauuauuaaccauuucauauaagacauauguguccauguuccauuuguuugaguaacuaaaucuauacaaagagaaagacuauuacuccucauaauuugagagguaauucauuucuaaaaucaaggauagaggccgggagcaguagcucaugccuguaaucccagaauuuugggaggcccaggcaggcagaucaccugaggucaggaguucgagaucagccuggccaacacagugaaacuccaucucuacaaaaaaauauauacaaaaauuagccaggcgugguggcacgcacuuguagucccagcuacuuugggagagugaggcaguagaauugcuggaacccgggagucggagauuguagugagccaagacugcgccacugcaugcuagccuggaggaaaagaguaaaacugucucuaaauaaaaaauaaauaaauaaauauaaauaaaaucaaguauaauugaagucucucucuccccaaucacuaugcuuuccauucaaugccaaaggaauuaaagacaguaucuccaaaaugccuacagaacaaauaggauuugucuuuaaaagaaugagaagacaguuaaauauacuguaacauuauuagcaaagacuuuucauuuuuaauucuaaucuaguucaaaacaucauuuauaguuaucuuaacaccaaaaauaauuuuuaaagggaaaaacagcauuggaaaaagcuaaauaagugccucaguuuccucagccauuagcuggauaauaucaguaucuacuucuuaggaugguuucuaaggcuugagagagaaaaugcaugaaaaugucuaguauaucauucacugagugcuuacuaugaacuaggcacuuuaaguauauuaacugauuuaacuaaccuucaaacuaaccuuaugaugaaggugcuaacuauuauuaucuaccucagugguucuccaggagcaauuucgcucuccgggaacauuuuugauugucaugaucugugcagggaaagagaggcauacaguugguagaggccagggaugcuacuaaacauccuacacaauguacaagacaggccccuaaaauaaacaauugugugggccaaaauaucaauagugccaaaguugagaaguucaaagcuacauuuucuaauagauaauccaaaacacaaauagguuccauaggccaggugcaguggcucauauuuauaaucuuggcacuuugggaggccaaguagaaggauggcuugacaccaugaguuugagaccagcccagguaacauaucgagaccccaucucuacaaaaaauaaaacuaaaaaaauuagacgugguggugugcaccuguagucccagcuacucaggaggcugaggcaggaaaaucacuugagcccuuaaguucuaggcuacagugagcugugacagugccacugcacuccagcuugggcacgaguauauauauauauuuaaauauaaauaaaaaauauauuuuuaaauagauuauauaacucaccuuaggacacagguccuaaguggagagccacuuacuaaaagccuauucccuaucugcuccccaauaaaguuauauuaagaauaaaaugaagccagccacaguggcucaugccuguaaucccugcacuuugggaggccaagguggggguucaagagccaggaguucaagaccagccugggaaacaaagugagacuccaucccuuaaaaaaaaaaaaaaaaaaaaucaaaaacagaaaaaccauaugccaggugccaugaucacacaaccgcacuccagccugggcgagagaggagugagacuccaucucuuuaaaaauaaacaaacauggccggaugugauggcucaugccuguaaucccagcacugaaagcugaggcaggcagaucacuugaggccaggaguuugagaccagccuggccaacacggugagaccccaucucuauuaaaaauacaaaaaaaaaaaaaaaaaaauuagccagguaugguaacaugugccuguaauuccagcuacucgggaggcacaagaacugucugaacccgggaggcagagguugcagggagccaaggacgcacugcugaacuccagccugggugacagagugagacucugucacaaaaacaaaucaauaauuaaaauaaaaaauaaacaaguaauaugcaccagcuccaugaaacaguaauaguuuuaccuuuccugcuuaaugaaaaugcuugagcacacuuuaaagcaacuuacacccaaauuuuauuagaaguacaaaaauaaaauuuaccuuagaaacaaugucaauuuguuauacuugccucaucuaagggauccacaucuguuuuccucaucuuaauaaguacaucauaugccugcugaagugcucugacuuuaggaugagaaacucuaacauaggccggaagacaaauaaaccauaaacuguaacaaugacuaaacagacacuuggcccacugugguggauuuguauaacaucucuucgccaauuuaugagcuguuuuuauuuccuagaaagagaauaaaauauuaugauauuuacuaaaauucauuagggugaggggagaagugagaaggaaaagggagaggagaauuuaaguaaaacuugacccccuaaaaucaagcacuucaaaguugacuuuugugaguggcuuccugcuuaucaguguuaaugguuccccugaacauucauuuacaguaauacuucauacuauaccaaaucuauuuguuagcaagcaugugucucuuaacagaguagaaauuaagagcaaagaucauucaucuuuuuguaauagaauggcucaugucuuuuacaaagaaggaacucauuuuugaugggugaaaaagugauauuccucucacucuucucuucacuaaaguuuaagaugcucuaggcuaucuccugccaagauuuccacucugucuucccaagcuacagucuauguuaacucccucacugacagacuccuuaaaaaagaccuguuucuggccaggugcaguggcuuaugccuguaauccuagcacuuugggaggccaaggcagauggaucacgaggucaggagaucaagaccagccuggccaacauggugaaacccagucucuacuaaaaauacaaaaauuagccgcgcaugguggcaugugccuguggucccagcuacucgggaguuugaggcaggagaauugcuugaaccagggagugggaaguugcagugagcugagauugugccacugcacuccagccuggcgacagagcgauacuccaucucaaaaaaaaaaaaaaggaccuauuccuuugcagucaacauaaacuuuccuaauaguuugauagucauguuuucuaguucugguuuucauucagauuuagguagaagagaaaauuagguaucaaaaucaucuggugaguuuugguguuuucuuuguuauuuuuuuuuaagacagagucuugcuuuugucgccaaggcuggagugcaauggcgugaucucagcucaccgcaaccacugccucccggguucaagugauucuccugccucagccuccugaguagcugggauuacaggcacccaccaccaugcccagcuaauuuuuuugugcagauuuuuaguagagacagaguuucaccauguuggccagacuggucuagaacuccugaccucaggugaucugcccaccucagccucccaaagugcugggauuauagacgugagcugccgugcccagccaucugcugagcuuuaccaaacuauauauauucccagaaacuacagaaccuaucacauauaucagaaugccauuuuaugcucugcacugaagauuccuugcuagucuauguucuaaauaaaaaaaucuuggggcugggcaugguagcucauguauauaaucccagcacuuugggaggccgaggcagguggaucacaaggucaagagaucgagaucauccuggccaacaugguaaagcccugucucuacuaaaaauacaaaaauuaguugggcguguuggugggcgccuguaaucccagcuauucaggaggcugaggcaggagaaucgcuugaaccugggaggcagagguugcagugagccgaaaucgugccacugcacuccagccuggaugacagagugagacuccaucuuaaaaaaaaaaaaaaaaaaaaaaaaccaacuugguauauuaauuuuacuuuugagcucgaucuccaugacacuucaguacauauuuaaaaauacaugcccuuguuuuucuaagauccuaugguucuuuucuuuuccaguuagccugaaaaaaaaaauucugcuauaaaugagauuuagaggcugaguuagcaaaauuuucucguuuuagaaauuugccuuuuguuagcugguaacaguaaaaaaaaauucuuuaguauucucuucagacaacauugaaagaaauaugaacuguaugaaauuaggaaauaccucaggauaucucuaggauuuaggggacuaucccauaaauuaguaaaaccugaacuaagauuuucauugugaaauuuuccacauuuuaaauauccccaaaaugucaguguauguauaaaggauguuuaauuuuaacucauacguaaccacagcuuaguucuuuauaccuaaaucacauauaguaguaaagcaagaugucuagguuguccuaaguuaacucccuuuggauuguaauacuuggaauaaaguauauuuacauuagccauuagggaaaugcaaauuuaaaauacaacuucuuacucacuagaugguuauaaccaaaaagacaaacaauaacaagaauugacaaggauauguugugaaacuggaacccucauacacuacuggugggaauguaaaguggagcagccacuuuggaaaacagccuggaagugccucaaaggguugaacacagaguaaccaucugacauagcaauuuacuccuagauauauaccccaaagaaauaaaaacauacauccauauuaacacuuauacacaaauguucauuugcaauauucauaauagccaagaaguaggaaguauccacaugucuaugaauagacaaauaaaauaugguauauccacacaauggaauauuauucagcaauaaaaauuauuacugauauaugcugcuacguggaugaauccugaaauguuacacuaaaugaaagaugccagucacaaaagaauacauauuaugcaguucuacucuugaaaugcucagaauagacaaauuuguagacagaaaacagacuugugguugccuagggcugcuggggauugagaauugggguuaauggcuaaaggaugcaaacuuucuuuugggguugaugaaaauauucuaaaauuaauuguggugguaguugcacaaaccuguaaauauacuaaaagccacuaaaucauacacuuuaaguggguaugcuguaugguauaugaauuauauuuuaauuaaguuuucuaaaacuuaauuuugcucuuguugcccaggcuggagugcaauggcucaauccuagcucaccacaaccuccgccucccagguucaagcaauucuccugucucagccuccccaguagcugggauuacaggcaugcaaccaccacacccagcuaauuuuguauuuuuaguagagacgggguuucuccauguuggucaggcuggucucgaacuccugaccucaggugauccaccugccucggccucccaaagugcugggauuacaggggugagccacugcgcccggccaauuccuacagauuaucuuaaagcauaaauauaagcauucaaaaacuucagccuugauugauagauagacagauagauagauagauagauagauagauagauagauagacagacagacagacagacagacagacacauauauagacuuuuuuugagauggaguuucacucuugucacccaggcuggagugcaguggcacaaucucagcucacugcaaccugcaucacccagguucaagcgauucuccugccuuagccucccgaguagcugggaucacaggcgccugacaccacgcccagcuaauuuuuguauuuuuaauggagaugggguuucaccauguuggccaggcuggucucuaacuccugaccucaagugaucugcucaccucagccucugaaagugcugggauacaggcgugagccaccaugcuuggcccagacuugauauuuuaaguaggcuugcaagaaaucuaguuaaauucaauaacaaccaaagugagucuucaaaugguuguugugggugaucauucuaaacuaugagcugcauaucacauauacauauuuuacaucuuaaaugaacauguauuagauaaagaauaucugaccuguuuaguucucuuagccaugagagguggacucuuuguaaugcuauucccaguagggugucuacuaaaacaaaguuucaacuccugcggucugucaaaaagcuuaagguccagucuuggaaaguauuuguaacuaaaauaaaaaaaaaaauagaacugcugauuuaaaacacaccaacucuucauauuauuccagcguuuaggcaaauauuucuaaacuucaaauaguauccaacauuauuuuaaaugcuuauauagaaaaaauacuuuuucaaaauuuuuaaaugauauaacauacagagacuaccuucaugaaaauuuugucucuuccccacccuauuuguuauuuucaaucaaucucuaaaacacagaaaacucugauaucuuacuuaaagggagaaauaacucuuucaagauaauccauguauucaauaauuuauguuuaaaaaaauuuuaguauacuucauaauuuuauguuuuucuucauaaaauuaccuugcauagguauuuaaaauaaaaaaaauccauaaaauuuuuauuuuaaggauguaccacaauuuaagcaguuuuucacugcuggacauuauuagguuguuggcuguuucuauauuucuccaauuaaauauuuucauauguauaucuuugugaauaccuuugcuuaauuucauaggacaaauacccaauaauagaauuugcuagguccauguuuaucaaaagaauuaaaauuauuauaauuaauaucaaauuauuucaaaaaagauuauacuuaaacauacauucuaacuacuagcauaaccuauucucaaucucaaagguuucuauucaucauuuugguuugcauuucuuugaaugcaaaaaaccauaacauauuuuuauauuauugacuuuggauuucuuggaaauugucuacuuauuucuuuuggccaauuuucuuccagaauauagcgccuuuccauauuugauuuuaucuuguuugucaauaucuggauuccaauuucuuguaguuaagccaaagcagaaaagaauucuauaguuaacaugaaaucaaaauaguauuuaaucaagccauucaaucccagauacauuccucauucugauccaguccucuugauauuauacauuaauucucuauuuugggauguacuuacuuuacuuucuauuuuagaaauucuuuuagaaaugcagccuaagaaaauaacaaagauauagauagcaaagaacuacaaacaaauccaugaggcuaguuaaauaaaucauaauaaaugcauacaauguggucauuacaaaugauaaggcacaaaaauauuuaauggcaugggaaaauguucagaccacuaaaggcaaacauagauuacaaagagaaucuaccugaugaacucauacaugcaauacauacacacacacauccacaugauacauacauaccuacaauuguuaagagacacaaguauuggugcuagaaugauguauuaguuuuccauuuugguuugauuuucuaaguuuauuaaauuuauagcaauaaaaaaacuacaaaauccauucuaauuucuuaaaagagucacauccaaauccuauccuuuaucuuaauaaagaauaaauuccuggcccucuaccuuaaguuuucuugguaaauuacuaauucauaagaauuucacagucuuuguuucaaaaugaaacucccaaagggagcagggagccucauaaaaguaucauuuuucuucuucagaauugaaacuuuuaaagauuaaaauacaaacacuaagguaaacaaugaucaacaucugacaauaccauccaauucuuaaauuauaacaccuaguggcauuuccauaaaauauuuaucuacauuaguucacugaacuaauacugaaaaugaguuucacaaaagacuaauauacauaucuacuaauaaaaauuaaaagaaacugauaggcugugccauuaagcucuuuuaaaacuuccuacuaccuguacuuuggugacagguccuuuccaucaucaggagguggcucuggcggcauuauaaauacaguaugcucacuuuucugugaaucaucuaguucuaucaaucugguaucuucugcugaaucaaaaucaaccugaaaaucauuauuuuuccccaauuaauuugcauacaaacaagaucuaauucugaaauuucaacccuuaaaaucuaagaaaaacauaccuuaucuguuuucucugugccuuuaucaggaaacaacuagaaaaaaagaaaacagauucuuaaugaaaauguccacuaugaauuuaauagacauuuuuaucuuacauucugauuuagaaaaaaacuaccccuuuucaguaccagcugauacaaaacaugcacaguauauuuuuaggcugaauacauacucuuaggcuaaagcauaauuuuuuacuuguggcuauuaggauagaaaacuauuuugauuaguuguuuuguaaaccuuaagacaaaagaugaccaaucacaagguuaucuggcuucucaaauaaaaaauuucauuauuauuaagccccuuuauuagugauugacauuaaacuucucauauaacuggaagauacuggaauaucaauuuuguaaauaaacaaaaauguugaauaguuuuaauuauaucccuggaauuuuggaucacacugauaggagaaaauuauuuaaaucuucuaaggcauaugaaucaugagggggccauaaaaauuaaugucauaauauucaacuuuuuuuggauacaaucucaaauguuauauaauauacaguuugcauaaacaauuggccccaagaucuacuuagcaaaaauaagaauuauauuaaaaguuaggaaaaauuauaacuaagucaagaaucaauuuuaacuuccuuaggauggguggguaaagcuuuaaaauuuaacguauuuccacccuccauuagaacaaaagaaacauauuaggcaaaagaaucuggaaagacauuaaaacaaaagaacauagaacuucuauuacccauaaaacuaaacauuuuuuaauuaaaaaaccuaaaucuuaaacuaaaucuuauucauuuaaauuaaaaaaauauaaacucacaaggcucaagaaaauguucuuaguuuuacaacucaauaguuguaaaacgaaagugagauuuaaagagaaaauuuacuggcugggcauggcggcucauccugcaaucccaaggauuugggaggccaaggcgggaggaucacuugagcccaggaguuugagaccagccugggcaauacagugagaccucaucucuaccaaaaauuaaaaaaacuagcugggcguagcacaugccuguagucccagcuacucagaaggcuaaggugguaaaaucacuucaggcaagaaguucaaaguugcaaugagcuaugaucaugccacugcacccuagccuggguaacagaaugagaugcuguuucaaucaauggaucaaugaauaaagaauagaaaaauuggcuauaugugguagaaacuugaaaccacaaagaauuuuauucauauauucagcccagaaucgguaacacauacacacacauacacaacccuacucuguuuuccuuauaucacucuagacuaacaauaacaaugauaauuacacagguaaggcaaacuuuuuuuucuaaacacuaguauaaguacaaacuuuuaccuuuucuaugcagucaucaaaaaaugcuaauccaguaucuuuaucacuuacaaaacugcauucuucaaugaaacgaauaaaaaucuguguuuuggauaaaaggguauagaauuuugcauaggcacgaucucgacuuuuuaaaaauccugaggaaaacaaaauauaauuaaauucaaauuuuaaacuggaauucgauauuauaggaaacauuaaacuuguacuuaucuauauuacauucucuuuauauauacauauauauauccauauuuaaaaagaagcuucuauagguugaguaucucuuaucugaaaugcuugggaccaaaaguguuucagauuucggauuuuuuuuuuuaagauuuugaaauauuugcaugugcacaaucacauaucuuggggaugagacccaaguaaacaggaaauucauuuauguuucacauauacauuauacacacagucugaagggaauguuauacaauauuuucaaugaucuugugcaugaaacaaaguguguguuaaguacuuacguguagaauuuuccacuuguggcauaaugucagcccucagaaaguuucagauucugcagcaucucagguuuuggauuuuuagauuagggaagcucaaccugugguaacugcauauauagcuccuucugccuaauuaaaccacgaaaaauacuucuaucaaacucuucacugaaaucuaaauccccuauaaggaaccuccagcucuacaacuuuuaaguagaaauuucucugauacucugcauacucuugaguccauggucaauuuccaaagagucaauguccuuccucuuuaauguugcaagaccauuauuucuguauuguguuuuuaaaauuucugcucauuaaaguuucaagcaucugacuauuccacaauuuccucuauuaaucguagacaucuauugauuucagggacacuccuucauucacugaagaccaaggcaucugauucaaggucuccuccuuucuaauuccuaccaccaucauucuuccacacccagaagcacaaaccaugaaaacacuuuagauucuucuucauuccuuuuuuuuuuuuuuuccagacagagucuagcucugucgcccaggcuggagugcaguaaugugaucuuggcucacugcaaccucugccucccagguuuaagugauucuccugccucagccuccugaguagcugggauuacaggugcccaucaccacgacuggcuaauuuuuguauuuuuaguagagacgguuucaccauguuggccaggcuggucuugaacggaccucaggugaucagcccgccuuggccucccaaaguucugggauuacaggcgugagccacugcaccuagccucuuuucuuuuaagagaugggugucuugcuauguugacaaggcuggucucgaauuccuggccucaagugauccucccaucucagccucccaaagugcuagaauuacaggcaugagccaucaugcccagccuucauuccuugauuuucagugauccuaugcuccauccuaccucaaucaccaacuucaacacacagucacagucccuugacuuuccuugccagcauucaaaacaacauugccucucaaaucucuuuuucacaucacucccagcccauuagcucugccuaucuggucuccuuaauuaaguauuucuacuaaguguuuuaggguuuuuuggguuuuuugugcagggagcagagagggaaggcucauggaaaucuccaauccacuggcccccuuauuuuuuuuuuuuuuuuuuuugagaugaagucucacuguauugcccaggcuggagugcagucaaucuuggcucacugcaagcucugccucccggguucaugccauucuccugccucagccuccugagaagcugggacuacaggcgcccgccaccacgccuggcuaauuuuucacuguguuagccaggauggucuccaucuccugaccucgugauccgcccaccucggccuccgaaagugcggggauuacaggccugagccaccgcgccuggccuccacuggcccuuuuacuucuauguacauccucccaucuucacuucuuucuccguccaauacugauuccaugcuauauccaucauuucaauuacuguuuugucaauacucucaaccccucugcucuuuugucuuuuugguuaaaccuaccuagcauaacccagcucuggaggaauguacuacuugccuucucuggaucugcauuaggguggcugagcacaaguuaaggggaaaaaaaguuccacaacuaggcagaucagaagcacuuauaccuucaucccucaccaacaacccuacuacauuucuggaaucaauuuaauuuuccucuucacauguuuucacaacuauuuccaauuuguaugcgcucucccuucauguuuuuugugcccccuccgcaccccgaaaugagcauacuucagugcaaugaaaaugcagaucauuaaauagaaacuauguacacuaucucacuacauaauuuaugacucuuuaacagcuauccuuuauuccuucugccuuuuuacaguggauaugucccuccuccuaucuaaggacaaaccaucacaugacuucaggauuccagccccuuccaguguucucaggauaaaucucccucucuauuagcuauuucucuuuuuuuuuuuuuuuuuuugagauggagucucacucuauuacccaggcuggcguucaguggcgugaucucggcucacuacaaccuccaccucccagguucgagugauucuccugccucagccuccugaguagcugggacuacaggcaugcgcuaauuuuuguauuuuuaguagagacaggguuucgccauguuugccaggcugaucucaaacuccugaccucaagugauccaccugccucagccucccaaaaugcugggauuacaggcgugagccacugcgucuggccucuauuagcuauuucucaucagcauacucaagucucuuuuuuccaucuaaaaaacaaaaacaaaaacaaaacaaaacaaaacaaaaaaaaaaaccuucgaucugcuccuucccuuuuuucuguuguuuuacuucuuauaaagggcauggccauucacuugguuguuaaaggcaaaaaccucaaaggugcucuugauaucucccacucuaccuuacauuccauauucaaucaccagguucuacucaaucuaauuccuaaaaaaaucacucuucuauucacacuaucaucaauuaauccaggucaccucuaauaaucccuagaaccaaugugacaacuuccuaauuaguagauccaugcuucaaugucuccagugcaaucucuguauggaagccaaggagauucuucuuuuuaacauuucaaagagugacuuuucaaaaaaugcaaaucugauccuauuaccuaaugaaauauccuuuacaggcuuccaauuacucuuaggauaaaaacugaaaccagcacuaauccuaaaagauccugcauaaccugguuaaugccaccauuucaaacaugguuuucucugcagccuuucuuucuuugaugcugugguccugacugccaucccuuuuagauacuaauuaguagagaaaagcuuaaauaaaauagaaauaaauuauucuccacaaguuauaaugaaaggcuuucuuuccuucuaguggauccaggcaaugaucagcaaaggcugcuagaccaaguaagucaaaggcugaugggugaacuacaaugaaugagugaggguaacaacacuuuaaaccuauuaggaacacuaaaaguaggacagccagacauguaugugccucauaagaugaugcaauaggaagaagugagcaccacguauuuuggcacuucuugccaagagaauuaaaccugaauuuaaccaagccccuagaucugcacuguuuaauucaguaaccacuaccuucauauggcaauuuagcacuugaaauguaacugacccaaauuaagacacacuaacuaaaaaauacaugccagaauucaaagaugugggccgagcgcaguggcucacgccuguaaucccagcauuuuggaaggccgaggcaggcagaucaccugaggucaggaguucgagaccagucuggccaacauggcuaaaccucaucuccacuuaaaauacaaaaauuagccaggcaugguggugcgcgccuguaaucccagcuauuagggaggcugaggcgggagaaucacuugagccugggaggcagagguugcagugagccaagacugcaccacuacauuccaccugggcaacacagcaaagacucugucuuuaaaaaaaaaaaaagauguuugugaaaaaaguaaaagauuucaucaaugauuuuaaaaaucugacuacaugcugaaaugcuacuauuuucccccuauuuuuuacuuuuuuauuguggcuacuaaaauaauuuaaaauuuuauauguggcuuacguuauauuucuaccggacacugcagcucuugaaccuaccacaaguuuacaggaauacaaguggcagaagaaaugguaaauaacaacauaaggauaaauuaagccaaaaucacauauacaaaaucccuaguuaauuccuauugcuuuuuuugggcccaaacuuaaaaguagcacacuaaaggauaccuuaggacacuaauauuccuuguuauuucuucaaggaauauuucucugaccuaacuagcacucucacuguaaccaauacuuuccuucgaaacacacuuauuaagauaguuaguauuacauuuuuuucuugucuaaugucuguguccccuaguagaccaaaugcuggacuguuuacaauaaaacuuuagggccuagaaacugaguaaguaucuuuucaaauuccuuuagugaugucacuuccguacaauccauauucuucaucuggcauuuauaauuacccacaaucugagccuaaucuuauuuucagccuuaucuuccacagcaccucuaaagcucaucacucuggucaaauuguaccaucuaaucuuuuuucccaaaugugcugucaugagugaaacugugucccccucaaaauuuauauauauauauguauauauauauguguguauauauauauguauauauauauguguguauauauauauguauauauauauguauguguauauauauguguguauauauaaguauauauauauguguauauauauguauauauauguguguauauauguguauauauauacacacaaauguuuauauauacuauauauguuuauacauauguuuauauauauacauauauaaauguguauauauauauauacauauauguguauauacguguauauauauacauauauuuuuuuuuuugagaugaaguuucacucuuguugcccaggcuggaguacagugaucuuggcucaccgcaacuucugccucgcgggaugaagcgauucuccugccucagccuccugaguagcugggauuacaggcaugcaccaccaugccuggcuaauuuuuguauuuuuaguagagacaggguuuugccauguuggccagacuggucucaaacuccugaccucaggugaucagccugccuuggccucccaaagugcugggauuacaggcauaagccacugcaccuggcccaaaauuuauauauuaaguuccuagccccuaguaccucggaauguaacuauuuggagacagggucuuuaaagagguaauuaugcuaaaaugaggauuauuggguagauccuaguucaguaagacugguagccuuguaagaagaggauauuuggacauaaaacaaacacugaaggaagaccacauggagaaaauaccuaucuacaagccaagggaagaggcuucagaagaaaucaaaccugcuaacuaccuugaucucaguuuaaccuccaaaaccacgagaaaauaauuucuguuguuuaagccaccuagucugugguacuuuguuauggcagccccagcaaacaaauccgcagaccuugugcuuuuccucuugaggcuauuuccauuuuguuauuaccaugaaugauaauagcuguuaucaugaauauuuuaaaguacuuguacuagcacaauugcuucacauauauuuucucauuuaaucuucacaaccaugaaguagguaucacccccauuuuauuaaugagaaaacuuuauuuauuuauuuauuuuuauuuuuuaauuuuuuugagauggaguuucacucuugucgcccaggcuggagugcaguggcaugaucuuggcucucugcaaccuccaucucccgaguucaagugauucuccucccuuagccucccgaauagcugggauuacaggcacacaccaccacaccuggcuaauuuuuauauuuuucguagagacaggguuucaccauguuggccaggcuggucucgaacucguaaccucaggugaucugccugccuuagucucccaaaguguugggauuacaggcgugagccacugcgcccauuagagaaaacuuuaauaagcuccaggaagacuuuauaaauaacaaaguagaaauucuaacucagauuugacucuuaaugccuauggacuuccagaaagccuuuucuguucuucuccauuuaucuccauucuacccauucuuccaagucaugcuucuuccacgaagucuuccaaaacacccauuuugaaauacuggaauauuuggaagaacaucccuuuuuuuucugaacucuuaaaacuuccaaauuaaaacuguguaaaauauguuuucuugaguacuuguucuauuuuuaaaauaucuuaauuauuuuccauuuaagaucccauagagcuagguuuuauacuucuuuauauuccuacauaauaacuagccaguaaguaguaacuaaauauuuaagugguaaguuacacuaaagcagaaaagauaaaggacaaaaggauuauugggaaaauacagauuuuuuuuaaaguaaucacuagguaaaaagcacagagaaguaaaauaauuucacauaaauauugauauagauguaagauugcuacuacauauauaacaguagcugaauaacaacaaaaaucucuauaauucccuaaaacaaaacauacuaaaaauaacgaguauacguuuuucccuggaacaaaguuacauuagucaaaaaugguuaaaauguagugcccucauugcacaaacuaauuguaaagccaaaaguguacacaucuggccaagugcaguggcucacaccuguaaucccagcauuuuggaaagccagggaggaggaucacuugaggccaggaguucaaguccagccuggccaacacagcaagacucugcucuauuaaaaaaaaaaaaaaaaaaaaguguacaaauccaaggaacuaugcaaaauugaggaaauaccugaaggcaaaucuccaguuauguucuacuaaaauaacugacuacaagauauuguaaauauagguaacaucuuugacuuuucauaauuaaauaucucuaguuucagauuucucaggagaaaaaugggcuauaaaaauuacaagaaauucuagucauaaagcuagguuacaaauacauggagguucauuauauuugaaugugaauuuguaauaauuuauacaauaaguauuucuuggcagcaacaucaaauauaaaauauuuuucaccucaauaaaaggaauuguacuuucaaugcuacucacccugucggucaaacaaugaaucagcagcuguggcuuuauuugaaggagccucugugauuggucugagauauguucuauauccuuuuaaaauagacgccauaaagcgcaaaaaugccucuugaauuuccaucucaagcugugucaucuucuuuugccaggagaaaucugcuucaauuggagucaugucaaucgcugagccuucuugaguuuuuuggugaacuaacaaaggaaauaaaaacagaaaaugguauuauguuaaauuuaagaagaauuuucucguauacauuccuucauuaauaauauuccuuuucccucacauuaccugaagacagcuggggauacaauuucuuuaaggugcuaaguagauuuuugcacggcuuuuugggaaguugcuuccaguucauguucuucuuuucaucugaucuauuaaaucagaacaaaauucauaaaauguguuauucauaaucugcuuuuacuagacaaaauucuugcaucaaccuaaaacaagaaaauggaaaagauguuuuuacuacagucuuaacugaugcaaacaauuugaauaagugaauuucaaggaaguucucuuuucauucaaucgaccucugucaaauuuagccaucucauucuaaccuuccaacauauauuuucaauguuggaguuaggaauacaacacugaagucuagauucaaaaguuacauuuuagaauuauaauauucuaagugucaaaccuaguugacaugagacuucaaacuaccuacugguaggcuucaaaaaugcugugugcccaaagacaagaacuggaauuuaaguaaggauuaaaagcacauguaguucauccagcccucacaguuaaaaauaaucauaacgccauuauucaauauaaucuaugaucaugaaacaauaaaaaccaaagccagaccagccuggccaacauggugaaaccccgucucuacuaaaaauacaaaaauuagccgggugugguggugugugccuguagucccagcuacucaggaggcugaggcagaagaaucacuugaacccaggaggcggagguugcagugagccgagauugcgcuacugcacucaggcuugggcaacagagcaagacuaugucucaaaaagaaaaaaaaaaaccccaaagccauagagaugaccauuuuuaaagguauuacuaaaagcuucuuuuuccaaaauuuuauauuccgaaaauauaaaauauauguguguguguauauauauacacacacauacauauauguacacguauauauacacacauacauauauacacguauauauauacacauacauauauacauguauauacauacauguauauauauauauauuccaagaauauaagaauauaaaauacagcagacaacugccuaaaaagcccucuucuuacaaaaguuagcauaaauauaacaaacuuucuuuaaaauucaugguuaagcuggcaagaaaauuggggacaucuucacggguugaaaacccagaguaacaccaaggccacaucugcccugaagauuaacagacagccuuggauuuuaaaggcuucucacagaacaggacacauaguuucagucucaccaagaaguauguuagaacugaaacuuccaaauaaaacugguacccuugaaagucuggcucagcuuuuucuuuucuuuuuuuuuuuuuuuuugagacggagucucugucguccaggcuggagugcagugguacgaucucagcucacugcaaccuccgcauuccagguucaagcgauucuccugccucagccuccugaguagcugggauuacaggggcgcgccaucacgcccagcuaauuuuuuauuuuaguagagacaggguuucaucauguuguccaggcuggucucaaacuccugaccucaugugauacgcccaccucggccucccaaagugcugggauuacaggcaugagccacugcacucagccugauucuuuuuuuaacccaaaaugcuacaguuguaagcccuuuaccuaagucagugaauugcuuagguuucucuaaauguagcauggcauaaugaaaagggcagagauuccagcuuuaggaucaaccuggaacacugguuguaccuuuauuaaugaaaugauuuuuuaaucagguucuauuuuguauuauuuuucuuuagcacucagugcaguucacaugcaguuuuuuuuucuaagcaagucauugcauuuuggaaucuuuuuuugcauacuuacaucuuuuauuuuaacaaaauaugucaauguuuuuuaaauuucaauagguuuuuggggaacagguggugucugguuacaugaauuaguucuuuaguggugauuucugagauuuaggugcacccaucacccaaguaguauacacuguaccccauguguagucuuugagcugucgcccaggcuggagugcagaggugcgaucuuggcucacugcaaccuccaccucccagguucaagcgauucuccugccucaggcuccugaguagcugggacuacaggcguguggcaccacacccagcuaauuuuuuguauuuuuaguagagacgggguuucacuguguuagccaggauggucucgaucuccugaccucgugauccgccugcaucagccucccaaggugcuggggcuacaggcaugagccacugcgccuggccucauguguagucuuuuguuccucaaccuccuuccacccuuucccccaaguccccaaaguccauuguaucauucuuuuuuuuccccucucuugaggggaagucucguucuguugcccaggcugcaguggaguggcacaaucucagcucacugcaaccucuuccucccagguucaagcgauuuuccugccucggcccaccagguagcuagcauuagaggcacaugccaccauaccuagcuaaucacugcaucauucuuaugccuuguguccucauagcuuagcucccucagcuuggauuuugauuaggggagggaucuccccugagaauucauuacuauaugccugccaacuaauggguuaugaguuugacagcacgcuacuggcauggcacaagaaacuguaagucaaaauaacuaacuucaagugcucccuggcuuaaugccaccagaauggaagcaaacauaauauccucucuguaaggauaaacgucuaauaaaagagcuaacacuucccuugugucugguacuguuaaaagacauauuuuaacgucucuugaaacugugucuuaaaagugauggcaugucaaguuuaacucugaucaacuucucucauuuuauguaaucgcugucuaauauuuuagugcuaucuuuuaaccccacccccaaauaaaauacugucauuaucgucuggauuaacauccauuuguaaucuggcccugacguuuacuaucugugugaguuuguauacaucagucaacuagucuguuacucaauuuucugaucugcaaaaugaggacugauaauguaccuaauauacagggcuacuguggguagaugaacuacauuucaucuaaucuaaggggccaucaauuguaaaauucauuguuuuuguaccaauuagaguaagaggauauugccaauuaaaguauuuuaaagucuacuuuacugcuuaaaaaaagaguaaaauauuaauuuuaaguucuaaguacccauauuaaaaaauuaagaggaaucauuaaaggaacauaaauaugaaauuauagacacacauaauauaacauuuagguaaguagaugggaaaaaaacagaauaauucauucaaucugaaagagagaaaagaauaacagcagaacaaaaaggacaaaauaagacagaaauguucaaauauauaacaauauauguaaauuaauggacucuucaauaaaaagacaaauguuagauuggauuuuuaaugccaguuauauacuaugcacagaauaucugaaauuaaagggaugggaaaagauauaccaaacauaauauaucuaacauaacguauuaaugagaagaaaagcacaaacuaacaaaaagagcaucagugauuuuuuuuaaaguggcuacaagacaaaaguauucauuucacugcagaaccauuuugaacuugagugucccucauaacacagccuuaauuaaguacauaaagcaaauguccaaauaacuauaaaaugcaauugacaaauccaccaucacacugggaguuuuaaaacuuuaguaugaucacacagcucaaaaauaacuuaaaacacauacacacacccuuguuccaugucugcucagcucccucacccccauaauacauaaucacuaguuucuugugcauauuuuaaugugucuuuauuccaaaacuagcagauacaaguaaauacaacuauucccugccuuuucuuuugcacaaguagcagcacacugcaauacacaauuaccaccuugauuuuuuucauuuaauaauuuguagccgggcaugguggcucacaccuuuaaucccagcacuuugggaggcugauauaggcauaucacuugaggccagcaauuugaaaccagccuggccaacauggugaaaccccaucucuacaaaaaauacaaaaauuaaguggccacgguguacacgccuguaaucccagcuacucgggaggcugaggcauaagaauugcuugagccuggaagguggacauuccagugagccaagaucgcgccacuacacuccagccugggcgacagagcaagacucugucucaaaaacaaacaaacaaaaacaaaauaucuuuugugauuuuuuucccaauacagaaagcauccuugcucauuuuacagcgcuacaguaguauuccacuguaggagccauuuaacaagucugggacaucuggauuuuucuuuuucuauuuugaacaaacaugauuucauacaaaauaaaauguuaggaucaauuccuagaaguggaauugcuguaguauauauauuuguaauuuugacaaauguugccagauauccuccauagaagcugucaucauauauaucucacuucuaacugcagugaaugcauaaagacugcuuauuucccaucauccucaaauagcaugcuauuuaagcauuucauuuugaauuuuuuuuuucuuuuuggccaaucugaaaagugaaaaagcaguaucaacaugaagaacuaauguggcauuucuccuauaaugagugaggugcuuaagcauuaaauaagcuuaagcuuauuugauuuuccgugaaaagucuucauagucuuugccuauuuuucuauagaguuauuggucuuuugacaauuucuaggaacucuuucacauagaauauuuacaaaaacugacgauauacuuggcuucaaagcaaaucucaacaaguaguaacagagaauguucugaucacaauucaacggaguuagcauuuaagagaaaauaaacuuugugggggccaggcgcaguggcucaugccuauaauucuaggacuuuaggaggccgaggugggcggaucaccugaggucaggaguuccagaccagcuuggccaacauggugaaauccugucucuacuaaaaauacaaaaaaauuagccaggcaugauggugcaugccuguggucccagcuacucagaaggcugaggcacaagaauugcuugaacccaggagguggagguugcagugagccaagauugggccacucuacuccauccagcgugggagacagagcaagacucugucaaacaaaggaaaaaaacuuuggaaauucaaaagacaaacuuuaauguaauacauaagucaaauaaauuuuuuugauaaaaauaaagaauauuuaaagucuacaaaaauaaaagcauuauauacaaaguaugguccgcaacuaaaaagccauacaucaggccaauaucauuuaugaacaucaaugcaauuaucuuaaauucuuagcaaauuuaauccacuauaaugauguuuauuucaggaauacaaggacugucuacuacuaauugauuuuauaauguaauuuaccacacagaguaaaggagaaaaugcucaucucaacagcugaacaaaaagguuuuuuuuuuccuuucacaucagacagguaauaugccaacaucaaguuguaggaggcacaucucacacaugugcgugaacauccaaucaucaacgcuuaucaacuauaagaagaucacaaaaaguauuuauaaaauucaguaucuacuuaugauuuaaaaaaaauuuuaaugacauagaaguagaagguaaauuccuuaauuuauaauuaagauaucaaaacucuagaggaaggauaggcaaauuuuuacugaaagaaccagacaguaaauauuuuaggcuuuaaggaccauacagucucugucauaacuacucaaaugugcuguugcaucauggaagcaggcaugggccauauguaaaugaaugagcauggcuguguuccaauaaaacuuuauuuacaaaaacaagcuuugggccagaugucaaucccuguuguauaucaauaaucauacuuuaugacaaacugcucaaaguauccccuuugaaauuagaaacaagacaagauaccaacuauaacuacuucuguucaacauuacacuagcgauccuagcuggagaauuaagauaaaaaauuuuaaaauacauuaggauaguguaaguagagaaaugugauguuuauaggcagaaaauugaagauaauauacaaauuaaaaaaggaauucaacuaaguugcuagauauaagaccacuauauaaaaaucaacuacauuuccuagcaacaaguagaaagucuaauuuaaaauaccaucuacaguagcaauaaaaacugaaagauacuuaggaauaaauaagucuaacaaaagaugugaauuaucuuucuggagaaaacacaaaguucaccaaaaaauucugaaaagaccaaugaagugaaauaucacauucaugggucauauuucuugugcauauuuucaacgugugucaaaaagguaucaucugccuccaaacgaaucuauaaauacaauauauauuaaccacuucagguaaacauuccaugauguauacauacaccaaagcaucacauugcaccccauaaauauauacaauuacgauaucaauuaaaaaaaauuuaaaagguaaaaaaaaaaauucuaacaaaaaucccaauguaauuuuguguggagcuuaauaagaugguauuaaaauuuacauggaaaaacaaaagaccaaauagagucaaaacaauuuuuaaaaagaacaggaguaaggggauucaccauggacauugccaaaaaaaaagucucauaccaugacuuuuuaaaacaguuuuauuaagauauaaauucauacaccauacaauucacacauuugaccugugcaauucaaugguuuuuaucauauucacggaauuguguaaccaccacuacaaucaauuuuuuuuuuuuuuuugagauggaguuuugcucuuauugcccaggcuggagugcaaugacacgaucucaacugacugcaaccucugccuccuggguucaagcaauucuccugccucagccucccggauagcugggauuacaggcaugcaccaccaugcccggcuaguuuuguuuuguuaguagagaugggguuucuccauguuggucaggcuggucucaaacucccgaccccaggagauccacccgucucagccucucaaaguacugggauuacaggcgugagccaccacucccggccuacaagcaauuuuagaauauuuuuaucaccucaaaaagaaaucccauagucacuuagcuuccaauacucccauccucuucauuccaaggcaaucacuaaucaaucuacuuucuaccucuagagauuugucugcuuuggacauuucauugaauuauaauauaaggucuuuuaacauaauguuuucaagguucauucauguuguagacaacuuaauuuuaaagccauuaagacaguauaauacuggcaagagauugaagcaaaucaaaggaaaagaauuagcccagauacauauuuauacaaauguagaaacugauaugucacaucaaguuuagcugaauuaaauaacuaaaugagagaggcaaaccucacaacuuaagaaauaaccaugauaguauuucauggccucaaggcaaaauaucucauauacaagaaccaaaaacaguacuccauaaagagaaauuaauaaauuugauaaauuaagaugagccccuguuuaucaaaagauaccauaaacacaauggaaugacaggucacaaugugggagaagcuaucuggaaugcauacagcagacaaagaauuaauuccagauuauauauacaauuucuacaaaucaaaagaaaaagacaaacaaucuaacaggaaaauguaccaacaaaaggaacauccaauucacaggagaggaaaaccaaggggcacaaagauaugaaaauccuccauuugcuacuaauaaaggaaaugugaauuaaagccacagugaaauaccauuaccaucaaauugguaaaaaauuuaaaagucaccacaaguguuggcaaagauaugaaacaaagagaacucucaucugcugaggacggaguaaacuugggagaguaaucugguauuagcuauuaaguugaaaaugcucauucccuaccaagcaacauuagcgcuuccagguauaugcuucagaggaauuccugagcauauacucaaggaaauauauacgaugaucagaacagcuuuguuccuaacaucaaagaucuagauacaaccuagauguccaucaacauugaucacuguugaaaaugaacugaaugaaccucacaaagaauggugagcaaaaaaguaauucacagaaaacuauucaaguagaaaaaaauuuauaaguaugcaaaacaaaauuuuauuuagauuaauauauauauaauaaauguuugaaaaauacauguaugugauaaacuccaaaucuaagaugaugguuggauuuggaguuuauccaagaugaugguuggaucuggagcuccucucugggagaaaggagcaaaauaugguuguggaggacuaucuagggauuucagauuuauugcuaauauuuucuuuuuuuuuuuuuuuuugagacagagucucgcucugucgcccaggcuggagugcaauggcaugaucuccgcucacugcaaccuccaccuccucaguucaagcaauucucuugccucagacucccgaguaguugggauuacaggcgcccaccaccaugccuggcuaauuuuuguguuuuuaguagagacggaguuucaccauguuggccaggguggucuugaacuccugaccucaggugauccaucugccucggccucccaaagugcugggauuacaggcaugagccacugugcccggccuauuucuuaauaaaguuguggugaauagauacaaguuauuuacauuauucuguauaauuuggagguauuucuucuuuuuuuuuuuuuuuuuuuugagacagagucuugcucuguuacccaggcugcagugcagugggucaacaugggucacugcagccucgaccuccuggacuacagugaucuuuccuccucagcugccuguguagcugggacuacaggcacgcaccaccacuccuagcuaauuuuuuauuuuauguagauggagucucaccaaguugcccgggcuggccuuaaacuccugggcucaagugauccuccugccucagccuccgaaaguacugagauuaaaggugugagacacuacaccugggcacauuuuauaauucuuuaaacacaauugagcaugccgggcacaguggcucaugccuguaaucccagcacuuugggaggccaagguggguggaucaccugaggucagcaguucaagaccagccuggacaacaugguaaaaccucaucucuacuaaaaauacaaaaaaauuagccaggugugguggcacacgccuguuaauucccgcuacucggaaggcugaggcaggagaaucacuugaucccaggaggcggagacugcagagagucaggauugcaccacugcaacucuguugccugggcaacacagugagacucugucucaaaauaaauaaauaaauaaauaaauaaauaaauaaauaaauaaauaaauacaauugugcaaacacuucacauuuauuuuagaaaauaauguuuugauuaccagaaguuuuauaaaaguuacucaaaacugcgcaaaauuaagaaucuccauauuauuuuauucagaauaaaaauaaaauaagguaaaaaaucugaguauuaacuucacaaauaaucauuucuaaaaguaccacaaugaauacauuccugaaauaauuguuuuucagggagaguagccuacaaacaauaaaaugugugcuacaaaaaacuaauucaugcaaguuguucauuacuuucaagcuguaaguaaaucuaaauauacauaaggagccacuauagcuauacaguuucaaaauacaaugguagauccaugucaaaauuauauuuuaaguuauagcaaauguuuucuuccucccuuagguuauuuuuuugguucacauaaaaauauuuucccaacgaauucuacuguuggaacuauucaggccuuacccaaaauauuucucucuucauuuucuaccaaucucaaacaguaaagaauaaaagcguucuacggccuggaaguuggcaccaacauaagaacauuuuuaauacuuacuguccuuucccacuuuugguggggaagugguaacccuuaaacauccauccagaacuauuucuuuuauuaauguaguuugcuacucucugaacccucagcuguaccacugcuguacuuaauuaucaccuucagcaaacacaaacuaucacugauuuuuaauauaaauuucuaagcaguaaacaacagauccuuauaaaauuaaaaucccgacaacuaagcaaaugguauaauaucacccuauacuguagccaaacuuuaucuccaauggguaaacccauuuuacuuacauauggauuuugaauuaaacccagaaagcauaucaucucuugagcucugaaagcaguguuuaaccauuacuuuuccaacucauagucucuucugauaaacauaaauaucuccugcuuacauuuaauauuguuacccaaauauaaacuauuauaauacugaacauuuuuuuuucccaaaucacacagcauucccagauucugauaccugcccugguugagagcugcuguauuuaagacgaagauuuaacaacuaccaaaaauagcauauuucuagaugcuuucaaagaacuguaacucuacauagugaaaaauauaaaugggagauaauauaaaaugaaucaacuuacacauauaacauguucguauccaagucaaugcaaacaacaucuuguggugggucaugaagaucaaaauaccuugagucaacuccaacuauaaaugguaaaggugcacuaagcacugcagccagugaaagaggacaaaggggaauauaugggcauugccacugaaauggaaagaucaucuggggaaaaaguuuuaaaaaauuaaccaaauuuuaaauuugcaauaaaaaauauauaaguaacuaguauuacugaaaagggaccacugaaaagcaguuaagucuguuuuguuuaccuuaaacuucauuccaaaacuaaaugacuauaaaauacuacuaagcaaugcuaagaacaaauguaauuaaaauuuucaagccaugacgaugaucauaagcacaauaaaaauacuaacagcuuuuugcauguuaauucuucuaguaucuauacaaagcacacauuccaauuuuauggaaagaaucaaaauaaaauaaaauggccccaaauaucauaaaauaaacuuauuaucuuuaacucuuacacauuucauucaccuauuaauucucaaaauuaccucagaucaaaauccaacuaaaagcauccaggauuuaaaaaaaaaaaaaaacuaauuauuuuccagggaaugcuaacagauaauuaaagagcucaacaaaaaaaaauucauggccgggcgcgguggcucacgccuguaaucccagcacuuugggaggccaaggcggguggaucacaaggucaggagaucgagaccauccuggcuaacaaggugaaaccccgucucuacuaaaaaaaaaaaaaaaaaguacaaaaaauuagccagacgugguggugggccccuauagucccagcuacucgggaggcugaggcaggagaauggcgugaaucugggagguggagcuugcagugagcagagacugugccacugcacuccagccugggugacagagugagacucggucucaaaaaaaaaaaaauucguaacucuucaaauaaacaucagugauguuugacaucuuaaaaauacugucaauuggcugggcacgguggcucacaucuauaaucccagcacuuugggaggcugaggugaguggaucacuuguggucagaaguuugagaccagccuggccaagauguacaaaccauguuucuacugaaacacaaaaauuagcugagugugguggcacaugucuguaaucccagcuacucgggaggcuggggcaggagaaucgcuugaacccgggaggcagagguugcagugagccgaguuugcaccacugcacuccagccugggcaacagagcaagacucugucucaaaaaaaaaaaaaucaauauaaaauauuccucuaucuagacaugauaagacagaaaaagaaaaaagagaaaaaaacauuccucaagaaucuuuacccauuuuccuuuacaaagcuuuacuucaauugcaucauuuguggguuuuuuuuuuuuuuaaaaaagacagguuuugauguuuuuuaaaaaagacuaaaacauguuaaggccaaaugcagugauucucaacacuuugggaggcugaggcaggaggacugcuugaggccaguaguucaaggccagccuggacaacagagugagacccucaucuccacaaaaaaauuaaauaaaugaauaaauuuuacaaaaaaaaauuuaauaauuagcuaguacuaaaauuuuacugaugauaauguuuuucuucuacuauaaaaaucccuguuaucuuuuaaggucuaguucaauuaucacccuuaucugucaucacucaccccaaagaaaugccuauaacgcuuacuaccccugccagcuauuacagaggguuauucaggauuggaauuuugucuucaaacauuuauuuacuuaauauuugggcacuugcuauguaccaaucacuguucuacauaaugagagcuuaacaauaaaugaaagagaucacucuccucaugagguuuauaguuuaggauaaaagucagcaacuuuuucuguaaaagacaguaaauauuuuaggccuugugaaccauauugucucugucacaaccauuuaacucugcugucaugcaugaaagcagucauaggcaauauaugaauaaauggccuguguuccaauaaaacuuuauagaaacaaguggcaggcaggauuuggcaggcaggauucggccaccauuugcaaacaccuugucuagcaggaagagagaaaauaaaugaaaaacauaaggaauaaaauauuauacuacagguugagcaucccuaaccugaaaauccaaaauccaaagugcugcaaaauccaacacuuuuugagcaccaacaugacacagaaaagaaauugcucacagaagcauuuaggacuucagauuuuuagauuagggauguucaaccagcauguauucugcaaacaugccaaaauccaaaaaaguccucaauccaaagcacuucuuuccaagcauuuuagauaagggauauucaaccuauaugucagaaaguaauaagugcuaugaaaaaaaaaaaaggaaaaguaaagccaaguaaaggacauuagaguucagagcagaagagaagaaaagcagguucuauuaggacaaacagaacaggacucauuaauaaagugacaacagagcugaaaccugaagaaggugagagauuuagccaaggggauauauaagagaagagugcuuuaaugagaaggaacagcuagggcagaggccuuaagguauggggaaugccuaaugcucccgggaugguaaggccagaaugcuggagaagagugagcaagaggaagaggaguggaaaauaagaucagauugcugaagggcagagccacucacaaaggacccugcaaggacuucagauuucuuugagugacaauuaucuucuauucaacaaaagguauguuacaccugcaacuaucacucacaaaggauccugcaaggacuucagauuucuuugagugacaauuaucuucuauucaacaaaagguauguuacaucugcaacuaucacucacaaaggacccugcaaggacuucagauuuccuugagugacaacuaucuccuuuucaacaaaagguauguuacaccuccaacuaucuaagaaaccuuagaaaaaaagcuauaugcuagcaaaauaugauauccuucucuucaccuuugccuuuuugcaacacuauagggucacuuuuuauaaagcacuuguacauuuuaucaaucuuugcuaugggucucccuuaauucuuugauauucuuugauauuuaaaucauucuccuuuugaugcauuuguuuuguaaccauucuuuucaauguucucuucuucaaaugguaacuggcauaacuaccaaaucaugacuuauaaauaauuuugcaugcaauucagacagcucuccaacaucaguugcauaaaccucauauacucuggcauuuuucauaugauuaccaauuccauguagcacuuuuuucagcuguucuugcaccauacuacugaaauccaucaaaagacuuggccaccacgauucugacaaaggggcuucaauaaacacuguuuuaguaaggaauauuuuggugggaacuuauuuuuuuugagacggagucuugcugugucaccaggcuggagugcaguggcgcaaucucagcucauagcaaccuucaccuccuggguuuaggcgauuuuccugccucagccucccgaguagcugggacuacaggcgugcaccaccacgcccagcuaauuuuuguauuuuuaguagaaauggaguuucaccauguuggccaggauggucucgaucucuugaccucgugaucugccugccuuggccucccaaagugcugggauuacaggugugugccacacugugccuggccugggugggaacuuucuagaacuggucaguucauuaacaaauauuuucauauucuaacaacuuuugcuuucacacacaacugugaugacuuggaaaaguaauacuuaaugaggauccuccuggaagcuuucucauaugguuacuauuguuuucaguccuaacagcacuucuucaaccagauuaagaucuuggagacauaccccauuuguuguuuuaacaaguauuuacugagggccuacucugugcuaggcaacuguaacaagugcugaaaauacaggaguaaacaagagauuagguccuuacucccaggagacuuacauucuuaaaauggggaagggaagagaagagagucagcuauuuuaaauuaaacaacuaaugggugauaggguuggagaaguggaccaucuaaaguucuauacaauggccuauaaagcccuauacaaucagacuucauucuucagucuuuuuuuuuuuuuugagacggaguuucacucuaguugcccaggcuggagugcaauggugugaucucagcucaccauaaccuccgccuccuggguucaagcaauucuccugccucagccuccugaguagcugggauuauaggcaugugccaccacacccggcuaacuuuguguuuuuaguagagcaggguuucuccauauuggucaggcuggucucgaacuccugaccucaggugauccgccuaccucagccucccaaauugcugggauuacagguguaagccaccaugccugucaaucagacuucauucuaagugcaaugggaagccaaaggguuuuaagcagggaacaacuuuaauuucuuaacaauuuaacaauuuaauuuuauuuacgcuuuacacaagagcuaagccucuguauauuauccuauuucacaaucacuuagaauuuccuguauauuacugauucacaauuauuaaaaguuaaaauagggagaaauuaaccauguaaucauuugcauaauuuuagaacagcugaaauuggccagagccucucaauacaaccagcuucauucucagguuuuauuauauaaucauauaguuuuuacucugggaagaacucaaaaauaugaaaaauuggaaauugacguuuuuccuaaaauagaaaucaccuuuguuuucuuuauauuuccuacuucucuuugccagcagauuauauucaacuuuuacugggcuggaaauuuuucaaaguuccuuuuuuuaaauuuguuguuguuuacaaaguugcuguuuuugaagaaaauuucccuuuggaguaaaaauuaugucaguaauuuuguacuaaaaggaaaauucuauacuuacagcuacaacagcuucagcuaccccagucaagacagcuggccuaagagaaugcagcagaauuuuacucucaaguaaaacaaagagcagcaguguugcacaauucucaggacccagauucauuagcaaggugcuaaaguuggcuccacuagggaaaaaaaagagaaaaguagaucauugugaacuauuuugcugaaauauguuaagauuugcuuauuaaaguaucaacagauugagagucuaguguuaauuucuagucuuuacuuauuuaucaaugaaaaguagcaaauuuaauaagauagauaacggggugauuuaaacucauccucugguaauaaaaggcauuuaucaagaaagauuuuccugaacagccauuugaguugagcucagaagaauggagacaaggaugggagugaaggggugacagacaauauaugcaagggcccuggggcaagaaaaagcuguugucauagccaagaaauugaaauaaaucuauugugacuaaagcauaguaagggaaagggugaaaacagcaacagauuaggcugaaauugaaauauacuauuauauuugcguuuucaaaaggacacacuggcuacaggguggauaaagaacuaaaggaagauaaguaaaaagguaccaauuaagaggcuaauagugaaauagucugguaagacaucaaggaagccuacuaugaugcagaugaaaagaaguaaaaggauuugagacauuuaaaagguuaaaaucagcucaccuuaaaccuuuaguuaugaacuggauaugggaaggggagaugagaagaaaagggaaguauccucuacauccaaucuugcaacucucuuaauuguucccauuuauaaaauagccccaccauccacccaguuaccaaagucagaaacauuaaggcuauuuuugccuaguuuuaacuaauaaaguuaauuguaaaauaacaaucacuaauauauuaauaauauacuaaucacuaaaauauuuuaaagcauucugcuccaacugaauaaauauaucauuuuaaauaccaguaauuaccuuagugguaaagguguagaaacuggcugugauaauauuaaugcaucauggacugacagcuuaaaaaaaaaaaaaagauaaauuaaccaaagauaaauuaaccaaaccaagagauaaguuucaaaacuacuuuugaaaucuauauauuuagaucaaagguaauauugaaaacauuaauaauuuaauaugcaaacacacuuuuggaaacagguacuaaaauauaaaaugauagcuguauuuacucagaaguguuacauuaguucuuuuucauuaaaugguuaauuugacugaauuuugauucacuuaauugguuaaaguacaauuauuuaaaauuuauggaacuacugcuucugaaaagcuucaaauucauuuacucaacagacuguaggcacuuggcaguugcuuggcacguaaauacuuguggaacugaaauaacauucaagaucaacaauaucugacuuaaucccaccauacauaauguuaagaaugucuuagaaaaacuuuuaaauggcuucccucuauagaucagugcuacugaaaguauguuaaguaugucaguaaguuaauuguuaugguccagaaagauacaguauauaaaugaagagcaaaccauuaagcaacuuuuaugacaaucugaccucucuccuauauccaagcaugugaucaguagaacuauuauuauagagaggauauagaccuguucauguugcauaugucacaagcuguacaccuaccuacgucugcuacuuacugaaaauaaaaagaaacugguccuuuagcacaguacuauuauagaccuuguuuaaauuaaccuccuccaaccauugcucauuuuauauucaauauuuauuagagaaucugguauuaaaaacaugcccaaacauaaucuggguuuuauguuauuaaaacuagcuacauaaaggucaugcaugggccaaaaaugaaaauguuaugaaccaaggguuauaauuauuccaauucaguacacucaaauccaaaacccaguaagaaaggguguucaguaaagcuacaaagcacagaaaauccaaggacuuuaugaaugcauauugcuccaccucaaacccaaagguauacagaauccacucugcaaugacucaggugagcauaugcaaaguucuccccaaauauacucucuuuugauuaccuggacaaggauucucggucuuuguggugaaggaaaagggauguuuugcauaaaaugugaaaugugccuagaaaaaaaaauuugaaauaaauauaauaauuacuuuucuaaaugcaucacaguuuuuaacaaaucuuaaauaucacuauauaucaucccagauaugacauggccauuuaucuaaaauguaggcuaaguaaguaaauuugcuccauguaaaugaauuuauccaugcccauuaaacuucugaaauacacaauguauuuccugacuuaaagucuauuuauauccccuaucauuacccaacaaauaaaaauaacauaaaaauaguuuucaugaaagaagugaauuuuuauagcccugguuaucugugccaguacagggagcaacuaacugugcuauaaugaauuuacacuaaaauucaguuuaaucccagauuuacuccucuaacacuggaugaaccaccuacccauucuauuuuugcaccuauaaaaauugcuucuuaaguuucuccaaaguuuggagcucuuaggagccauaaaaacgcaacauauuacuucaacugaaaaaaauauugauuauauacauugauuuuaucacaagcuauucauagaaucuuaauuuuucaaaagguugcuaacuugacacuaauguuacauuuuacuucaauaaacuuuaaauuaaucugacagcugaaaguuaaacccagaacuauaaaucauuaaacugccauuucaagaguacaaaaugaaaguugcaaccauauuucaauaucaaauuaugaugaguuuaugcacaguacuucacucuuuuuaaaguugauuuuuggacagcauuauuuuuaaacccucacauaauuaccccuaccuuauccacuaaacuaguauguuucacugauauucuuucugcuauaauguaaaaguucugaaauuguaagaaacaucuaagcuuacacauacuuuaauacauuacagcucuugacacuuuuuaguuuguuagcaggauacauaaauuauaaacuaucauaaacagaagucaaugcgccacuagaaaucagaaaagaugcuuuaaaaaagaguagcucaacauacauuuuucuuucuuaggaaagaaagaucgcaugacaaaaagaauuaaaaauuaaagagaaagcucaaauaauucugucaaugcuaaaaccaaaacuccacuuuuaacaucaauuaacucauuccgacuaauuucuacaucacuuuagagagguauuacgguuagaauuuggaauggccacuugcauuggugggugugugugcagcaguaacuauuugucucuugguuauuagagaauaaauaggaagaagaacacucacaauauaauuuauaagaguuacuucuucagcugaauucucaaaggauuauuauuuggccaaccuuaccacuacuauccaauuuuaagcucacagucaaugauucaggcgaagaagggaguaaguaaaaaguugguggcucaugccuguaaucccagcacuuugggaggcugaggcagguggaccaugaggucaggaguucaagaccagccuggccaagauggugaaaccuugucucuacaaaaauuagccaggcgugguggcaggugccuguaaucccagcuacucgggaggcugacacagagaacugcaugaacccaggagguggagguugcagugaaccaagaucacaccacugcacuccagccugggugacagagcaauacuccaucucaaaaaaaaaaaaaaaaaaguucaguuaaaugcaggcuuccuucccuuccaacuuugcugcuaaaaauuacacaaacaaauguauauauuuauauacccaguuuuccaccagccaucuuucuaaucauuauacauacuuuucaaugggaagaggaugugguccagacacagaaaguuuguagauaaacauaagaaauuuccuaaaagcuucaaaaaaaggccagugugagaguaaacaaaugcauuuguuuguauugauggauuuggagaccauuuuucucuccacaggcgucaacaagcccaggugcauaagcuguuucucugauagaaguucccgagaguaagguucauaaaacugaauggcagcuccauauaccuaaagaguaacagaauucuguuauaagauuugaguuuguuugaaaaaauuaacuucucuuuuuuucuuauuacacaagaaauauuugcuuggaguacacuuauacagauaaauuaugaaaaaaaaaaucucacccaaauuucugucccagagauaaccagauuuugauauaaaucccucaagauuuuuuccacugcaauuuuauacauucaacuauguaucuuauacaaaaauggaugguaaccucuuacaacuuaagcauuagagaaugaacucuaaugaucucacucaacuuaaguuuuuuguggauuuuucuuuuucuuuuuuuuuuuuuuuuugagauggagucucacucagucgcccaggcuggagugcaguagcgcaaucucagcucacugcaaccuccgccucccagguucaagugacugcuucagccucccgaguagcuggcauuacaggcaugugccaccacaccuggcuaauuuuuuuuuuccuuuuuuuuugagauggagucuugcucugucacccaggcuggaguacaguggcacgaucucggcucacugcaagcuccaccuccuggguucacgccauucuccugacucagccucccaaguaacugggacuauaggcgcccaccaccacaccuagcuaauuuuuuguauuuuuaguagagacaggguuucaccguguuagccaggauggucucgaucuccugaccucaugauccgcccaccucggccuuccaaagugcugggauuacggcgugcgccacugcgcccggccuaauuuuuucuauuuuuaguagagacgggguuucacuguguuagccaggauggucuuuaucuccugaccuggugauccaccagccucagccucccaaagugcugggauuauaggcaugagccacugcacccggccugugauuuuuuuuuaauuggggugaaauauauauaacauuaaacguaccacuuuaaccauuuucaaguguacaauucacugguauuaaguaccuucacaaugcagugcacccaguagcacuauucauuuccagaacuuuuuucauuaccccaaacaaaagcucuguaacccuuaaaugguaacuucccauucucuugcccucaauccaagucccugguaaucucuauuguacuuucuaucucuauaaggguagcuauucuagguaccuccuauaagaggaaucauacaaaauuuaugcuuuugugucuggcuuauuucacuuagaauaauguuuuuaagauucaccuauauuguagcaaauaucugaauuucauuccuuguuaaggaagaaaucauaauuccaucauauauauauaccauauuuuguguauccauucauacguugaugcacguuuggguuguuuccaccuuccgccuaucgugaauaacccugcuacaaacauuggcguacaaguaucuguuugagucucugcuuucaauuauuuuagguauaugccuaggcaugaaacugcucgaucauaugguaauucuaaguuuaacuuuuggaggagcugccaaacuguuuuccacagcagcagcauuugacuuucucaucagcaauguugacagguucaauuccuccacacccuuuccuuguaugacacaagauaaagcugacacuccucugucuucaaacucuuuauuccuuugcugucuuugacaguacaaauuucucugcuuucuggcuacuucucucuuuccuauacuagauccaauuaugucacccaucauuuaaauacuagcauucccuaagguucuaacuucacacuucuauuuggaacauuucauucucucaugguuuuaacuauaaucauuauacuaacaaaacacaaaucuuuaucucuaggucuaccugaccucuccccugaaccucagacuccuauuuucaaaaugacuacucacuaaucuccaccuggaugucauacaggcaucucaaaccaauauuuucaaaagugagcucaucaucuaaacacuucauccaauauuccuaaucuuacucagucaugcuacacaauucccaagguagaaacuucgaagucauguucaauuccacuuccacuuaccacauaucaaagcaacuacugaagcccuaacuggucucaagucagaagagaaaguauuuuagugaaaaauacacugaagaaacaguccuucagagguaauaucucauccuucaaaaguuccccauuacagguaaaaugccacaguccguguaaguggcaugaugcucucaauuccucacaguaccugcuguugcuuuucaacaauacagagcuaccaggcauauagacuaguucauaauuuugugcuuuuauguauuuuguuuagccuugguacuuccucugaucugcccauuccuuaaaacacugcaaagaaauucuaucacuauacccauccccuucucccagcaaucaauccuuaccucuguguuuuauaaaucuugccaacuguuuagucauuauauauaucacaggaacccuugccuuuacacacacauucccagauacaauuauuucaaagugaucucaaaguuuuuaacccauccccuucucccaacaaucaauccuuacuucuguauuuuauaaaucuugccaacuguuuuuucauuauaacccuugccuuuauacacacaauauucccagauauaauuauuucaaagugaucucaaaguuuuuaacaagcaaugacaaauaccuaaauuuuacacaccucaaugcuuacauguugauauccccuaaacaaugaaaaagccaagcagaucaccuaguacccacaucucaaaugagacuuuauuguucucuacugccaaagcauauuagguaacuaauguuugaagaucuuaaaauuuucaguuauauuuacuacuuucagcaggagaaauuguaaaugauuauuaagcuaacaaguuaguagugggcaaucaaguuaauauaauauugaccuucacucaguauuuucuauguuccaggcacuaugcuggauacuuuacauauauuaucuuuaucacaguaguuauaaagguguagccuguaccuguagaaugaggucacagauguauuuuguuucaucugcaugagucaguucagauuauauauuuuuucaauaaaaucgccuauuaaauuuccuuagaaaguuuucaauuuuugcugggcgcauuggcugacaccuguaaucccagcauuuugggaggcugaggcagguggaucaccugaggucaggaguucgagaccagccuggccaacauggugaaaccccaucucaacuaaaaauacaaaaauuagccgggcgugguggcaggugccuguaaucccagcuacucggggagccaaggcaggagaaucgcuugaacccgggaggcggagguugcagugagcccagauugugccauugcacuccagccugggggauaagagugagguuucgucucaaaaaaaaaaaaaaaagaaaagaaaguuuucaauuuugaaauuucuacugcuaucagcuuuuuauacugaauauuguuuauuuuugccuucucuucuuuauaaaucaguuuaugucauuauuacuguuauauacaauauauguuuuacauaagacaauaaaugucuuuucucucuaguuguuuugucuccgguguuccaugauagcaccaugauauaauaagaggcgggauaggccaggcauggugccucauaccuguauaauccaggacuuugggaggcugaggcagguggaucacuuuaggucaggaguuugagaccagccugaccaacagggugaaauccugucucuacuaaaaaaaaaaaauacaaaauuagcugggcguggugacgcacaccuguaaucccacugcuuaagaggcugaggcaggagaaucacuugaaccugguagguggagguugcagugagccgagaucgcaccacugcacuccagccugggcaacaagagugacauuccgucucaaaaaaaaaagaggugggauuauuuauuuauuuacuuauuuguuuauuuuucucugcugcagauucagaguacaucuuuaaccugaagacucaauuuuuucaucaaccuuggaaaacucucaaccauuagcucuuaggauguagccuuguccuuuucuagucucuccuucaguaacucauuaaauaucuauuagaccuucuaguucuaucugcuacauuuuaaaacuccuuuuauguuuuacauuuguauguaccacauuuaagguaaccuaucuuccacuucauuaauuaucccuucauguaugucuuaucucugcuauuuuuuuuuuuuuuuuuuuagaaagaguaucgcucuguagccuaggcuggagugcaauggugcagucucagcucauugcaaccucugucucccggguucaagcaauucucaugccucacccucccgaguagccaggauuacaggcguguaccaccaagccuggcuaauuuuuuguauuuucaguagagacggaguugugcuauguugcccaggcuggccuugaacuccuggccugaagugauccaccugucucagccucccaaagugcuggaauugcaggcgugagccaccgcaccuggccuuaucucugcuguuuaacccauucacugaauuuuuaauuuuaaggaccauauuuuucauuucuaaacacuugauucuuuucccaaucuauucauuuuucaaaauauccuguuccuuccuugauauuuugagccccuccauuaguucuuaggucaucucaaugauauuuuaauuuauaacauccuuuauauugucauucugucauuucaaugucuugagggucuaacccugcuuuuuaauugugucugucgauucuuucuaugguaccuauguccuugaucugucauaaucaucucaucuugacaccuggguuuugaaggugucuauccagagagacuuuaucuuugcuucuguagaaguuccagagguaucaauauccugauagcaauuuucauguugauuucucaccuuggggaugacaguguaaauuuaaaccaaaauguaucauguccaaauaauccuaacauucaaauaaaacuuguauuaaccuuuuuaugaaauaaaaacauggacaaaauguguuuaaucaaugagacaaaaacauaccuuuuuggcugaagaaccugucaagacaaaaguugaaaaaacuggaaguggauauuugguuucaggaucccagcacucaauaguagcucccauaggaaggcagaaaagagguacaucugauucuga

SEQ ID NO: 191382 - RNA, 25271 nt, Homo sapiens
cagaaacugcauuagcugaugccuugauccugagcggaauucccagccuccagaacugugagaagcguuugcuguuguuuaagccauucgguuuaugguguucuauuauagcaaccugagcuaagacauagggcuuggaaagauauuuaauuuucuaaacauaucuaauguuuagggugaguauuauuagaucugaagacagacaucugucuaugaaauauguuauucuaggcaacuguggaauauauuuuccaucccucuucuccuacagaucuauuugggaacuuggaagugaaaaagaauacauguaauuuagguuaucaaguuugguuucuuaauuuaauugaaucuauugcagcuaaucuccuauuucucauuaaacuuacaggaaaauaaucagacuucauacaauguaaguauaacuuguauaaaauccaaaugaagcaggaauuuuggugaagcaggguauggagaauauauaugucuuaaaaauacaaugugugaaaaacauagccuguuaugucuagaguuuuggggguaugugcaguuauuucauguaauggauuuuuaucaaauacaagguauuuuuccaccagaauacuuccuguguuuuauuuacugcacugaauccacagccugucuuuucucgugucacacuggaaugcuguacuucacaucuucuuuuuuuuaaugggaaagauuccgaggaugucucuucuuucugaguauagaugacuguagguaaaauacauaccuaauauggagaaagaaguugcaaaaguaaguaagguuaacuauuucucuggaagaaacaaugcuuuuaaaauacagucagagugcugcccaaauccagggagaagacacuugcaagggagaugugagaaggaauguuuaaagaaguguccagauuuuaugcagaaagagagguaaaucaaacucuuccauccuacuuuuuuuaaugcaaggaauugucuuccuuucuuuagcauagcucucuccaccuuccucuaaaguuucacauuuuugucuuuucucucuauauguuguucauauguuugauaucuguuaccuucuagagauaaucauuauuuuggagauuugugaagguuagagcugggaaaacaaaaauuuaauagugaaaguuuuuuccccaauuuccuggaaaaugauuagguuuaaugaucaaauuuauucaaggguaaguuuuuguuccauacauuucucuugagucuguaacaccgacucccauuugccugauaggaagugccagcuugaaaagccaaacaaacaagaaacaaaauggauauaaauggaaacaucagaaauagccaauucuucuuaguuugacaucuagguuuuauuuguagauaccugugcacauggucaaaacuucuauaucucauacauaaugcagcuauauuuucugauaguaaaauuguucuuauuuguacagugaaagugaaauauaugaucccaugaugcccugcaaaaagcauuauaaccuccaggggcuuuacuagcaagaucuaguucaugaugucaggcuuccucuuuggucucucccauguuuaccaaccuguauauuaagguagacggcaagcacuaaccaaaaaguacaggaaaaaugcaaaaacaagaccaaaaaagccacuuaccuauaaagagcaucaugagauauauuuucagcacauaugggaaauagauggauaagucaaagggcagcuugguggaauaagugccaaaugauucaaaauaaggcagcgauugauagauggcaaaugcuguuaaaaaagaaaggcaucauaaagguauuccuccuuaaguuguuacagggauguguauauaugucuucauaguuguaggauauuuugaauuugauaaugacaguuuuguaauaguugcugaaucuuuuugcuaaaccuaguuuaauauagaaaucugugaaaugauuaaguuggcaaggugcuuacagcaguaugacuuguugaauguuuguccaugguauaccuuauugugccuacagaagaauuuacaauguuucuuaaaauguuaucucaaaauacauuuguccaccuagccacaaauaggggugauagagagaugaacuuggaaaauggugcauauauuuuccucuuagaguuucacaacacacauuaacauaguagaacacauauuaacauugugagaaauucuguaauaaaaaaauaccaccuagccuuuccucaauguaacuggccuuagaauaucuccuucuuccuucuuaaccaccaguaguauuuaauaaguauuuugaagaacucuaugagaaaugcuggccuaaauuauuuugagggagggggcugguaucagguaaaaaaaagauuaaaguucaguaacauuguaucccauguauagauauuuuugguaacauuucaugcaaugaaauguuaauaugcuaacaugauguaagauguuaucauuaggguaagcugggugaaggguacaugggaauggugcacuauuuuugcaauuucuuaugggucaaaauuaucccuacauaaaaaguuuuuaaaaagagaaagaugaagaaaaggcaagaguucacaacuguuagagccaagcagagguaugaguagcaucagugaaggaucugccacugacaccaaauaugcaguuuaagguuaacacaggccgcaccuaugucucuagcauuuuaucaguauaauuaguugauuuuguuauuuacauaagcuuuguuuuugucuuauaucugucagaugggaaauuauaguuauuaaaauuauuaaaauuaaaguuaucgaaaguuuaguagguuuauuuaacugcgcaguuuuauacuuugggacaucuaacauauacagaaacacagaaagauaaaauuacaauuaucuguauuccaccauccagagcauuauugacauuuuugucauauauaucucuagacuauuuucugcauauaccuuauuuuguaauugcaagaauaaguuuaugaaguuaauaaaagaauaaggguuguauggcaaccauauaagaacauggcuuuccuagaaaagacaaggauuagaauuauggaauaacaagaaugcaaaaguuuccuauacauuuauccaccccuuauuccuaggaagggauuagucauauuucuaccuuauuccuuuauauauucuuuuaaauuugauuaaguuuuaauuggcaaaucauaauuguauacauauaugaagcacaaugugauauuuugauauauguguacaauguggaaugauuaaaucaagcuaauuaacauaucuaccaccucgcuuacuuuucguggugagauuugaaauguacucuuggcuauuuugaaauauacauuauuaagcacagucacccugcugugcacuagaucucaaaaauguauuccuccuaacaaacuuuguacccuuugaccaacagcucccaauuuccuuucuauauucucuacaguacuaugauuuaacaaagauaauguauuugauauuucaaugagagguuacuugauucuuaaagaauggacaaucagguucuuacuguuuucaagacaauuauucuuuagauccacuuggcauagucuauuccaaaauuaauaauucuuccuuuugaaucaaaacaaauuuagaaauucuaacaugauuuacaguaacaagcucuuuuuaucugcucaucaguagauagaaaauauguguuuuuguuuuauaacuggcuuuuauauacuuugguuauuguuaaugucgucaucauuuuauguuaaacaccauguccuuauguuuuucccuuaguuaccuuaacaugcuuucuuauuuuaugucuucaguuuugaaaacuuuaaucaugucuuacagaaugcuccuuaccagucuaccaaauccauugcagaagaaagcauauauucuccaaauauccucaagcucugcugacugaugaucugaaugauuugaucuuaaguuuuagguuuauauuuaggcuauauaauuagccuacucauacucaauaauucauucuguguucauugagcauguauacuggugcauaaaagagaggaaggaagcaaagaaacagacucagacauccugguaccccccccccccccagagcuuacagucuagucaaggaaauggacauuaaucaaagaaucauacaaauguguaauuaugcugauauaagcccuguuaagacagcaguccccaaccuuuuuggcaccaguuacugguuuuguggaagacaguuuuuccacagaccagaggaagaaggaugguuucaggaugguucaagcacacaacauuuauuguguacuuuauuuguauuauuauuacauuguaagaacaaaauaauuauacaacucaccauaaugcagaaucagugggagcccugagcuuauuuuccugcaacuagaugguuucaucugggggugaugggagacagugaaagaucaucaggcauuagauucucauaaggagcacacaaccuagaucccucacaugcacaguucacaacaggguuugugcuccaauaagaaucugaugccuccacugaucugacaggagguagagcucaggcgauaaugugggcaauggugaguggcuauaaauacagaugaagcuucaccugcuagccuacugcucaccuccugguaugcggccugguucuuaaugggccacagacugggaucauggccuaguuugggggccccugcuauaaaagauucaugauacuguacccaggggaacucaguugaggaagucagggaaugccucccucagaaaaugaugauuaaucucaagguagaguuaacuaguugcugagagaggguaggauacauaguaaaugguaagugggaaagacucaccagaggggacugaauuucugugcauuaaaaguuaaaaaucauagaaucucuaaauguuaacuucuuuuuggugaauaagcagacucugagagguuaaaugaguuacccaaaacucacacagugaguuaaugaagugaaggccucagaugccguugcuuuuuguccaguauuuugucuacugugcagagcugcuucccucuucaacuuugccucuuugcaucaagggaaauaugccaguaaggauacacugagugagcuaagcauucgcaaaaauaguaauuuaaucaucaaaaaauuuagugaaccauuauaacuagauggcuuuugucaguaagcaauacagcaagucacucuuuucuuaccuucagcaagaacacacaaaggauaaauuggcauccauaguguuugacugagccaugucaagacagcauaggauauuccuaugacugauaacaugcuauaaguguaccugaaaggagaugagaagcucauaaacaucauuuucugcuaauaucugggaaauaggagaaacuacuguguaauuaaauacagagauacaacuggaaaguguacaaauuguauauuuuauuuccuauaauuuaaggaagaguuuuuuuuaaaugggggaaagggaccaugucaaucuggcuugucucaugugguagaucauuaauaauuauaaagcuaaacagagcaaguaacucuuacucccuccucagaaaaauacaguuacaaauuuccuugauuagugacuucaauuucauuaaaaagccaagcucauuuuuugcagcaagcagcuagguuuuuuaaugacagacauacuuguaaauaucucaggaauucauuuaaaaauaaaaugugacuuccaaaucuuuauuuggcauccuucugcuucugcaguuguacuaucuaugugaucaauuaaagaacuggccuugggagcugauuuggguauaguagggagcuuuaagccuaccacugugauguaaaaaguagucuacguuguguuuuauuucuuugaauaggacacugguuuuuaggcuugagcauauaucagaaucaccuagauggcauguuaaaacacagauugcugggcccuacuccaaaguuucugauccaauggaacugugguacaccccagacuuuguauuaacaaguuccaggugaugcugaugccacuggucuagggaccacacuuugagaacuacuaauauagacagacaauaaauacauauggcaaaacuacccaaaaaaccuugaaaacaugaauggggaagaguaaaucucucucaauccaggaccugaauuccaccccucagagacaauagccaaugucaguuucuuagguauucuuucaaaaauguuuuugcauuugcauaucuaugugcauauuuacuauacagaauauauaccagcaguggaggaccucacugaacauagcauauaaucaagcuuuuugaucuuuaccaaucaaagugaaaaaugguaucucaucuuuuuccccucauauuagaagaguggguaagcauguuuucauguuuaaaagccacuuuuggccagccgugguggcucacucacuccuguaaucccagcacuuugggaggccaagcugggcagaugaccugaggucagggguucaagaccagccuggccaacguggcgaaaccccaucuacacuaaaaauacaaaaauuagccgggcgugguggcgggugccuguaaucccagcuacucaggaggcugagacaggggcaucacuugaauccaggaggcggagguuguggugagcugagaucacaccacuggacuccagccugggugagagagcaagacuccaucucaaaaaaaaaaaaaaaaagaaaagccacuuuugaugaaguccaauuuaucuuuuuuuucuuuuguuguguaccuuauaacacagccaaauccagucaucaagauuuacuccuauuuuuuuucaaagaguuucauaguuuuccacuuauaugugagugguuaacuucauuuuuuuguguguguauauccaguugucccaacaccauuuguugaaaaagacuauucuuuccccauugaauggucuuggcauuguugucaaaaauuaauugaccaaaaaugugugagaguuuaucuuuaucaauuuuauuccaugauuuauccuuacacaguaccacacuuaauuauugcuuuguaguaaguuuugaaaugggaaagauugaguccuucaacuacauucuucuaagauuguuuuggcuauucugaguuccuggaguuuaaauaugaguguuagggucagcuucucaauuucugcaaugaaguuaucuggguucuaauagggauugcacugaaucuacagaucaauuuggggaauauugccaucugaacaauauuaagucuuccaagucaugugggauguccuuucauuuauuuagcucuuuaauuuuuuucaacaaugcuuuuucaacaauguauaaauucugugcaucuuuugucaaguuuauuccuaaguacuuuauuauuuuuaugcuacuguaaacagaauuguauucuugauuucauuuuaugguaguuaauugcaaauauauaaaaauaauucauuuuuacauauugauaauuuuuuauguauaagaugucaucugccaauagagauaguuuuacuuguugcuuuccagccuagaugccuuuuauaccauuuuguuuguuuucuguucugccuuauugccauggauagaacuuccaguacgaugaugaauauaacuggcaaguguggaugcccuugucuuguuccuggauauuaggaggaaggcaucagucuuucaucauuaacuaucauguuaguauggauuuuucauagaugcuuuuuucaggcugaggaagucucuugcucauuacuuaggaaaaauaaugcuaggguagggugggaugauaaguuuacccccauuuuacagaggaaaaaaaaguuucuaaaaguuaggugccuuggaauuucacuccuagguauaagggaaaugaaaacaugugcacacaaaagcuuguauauggauguucauggcaguacuacucauggccaaacaguagaaaccacccaaauguccaucaacugauaaguggauacacagaaagugguaaaucaaugcaauagaauuuuacucagcccaaaaugcaaugaaguacugcacaugccacaacacagaggaaccuugaaaacauuaugcuaaguaaaagacgccugucacaagaggccacauauuggaugacuccauuuauaugaacuuuccaggauaggcaauccauagagacagcauauguguaguuuccaggggcugagggaaagagggagaggggagugacugcuacuggguauaagguuucuuuuaugggugaucaaaauguucuaggauaguagugaugauugcacaucucuuuggauauacuaaaacucacaaauuuuguauuuuaaaagggugaauuuuaugguauauaaauuauaucuuaauaaaacuguuauuaaaauaagaaagguuaagugauuugcccaacaucacuuagcaaguaaguaguggagguggguuucaucuagagagaucuucuaccucuauguccaaaaaucuuccuaugacagcaugcuacuucuuucagugcaaauguuguuuuguucuccaauguauuuauugagcuucucugacacugaaagaguaagcauagccaagaguaacauacuagaaagcuucaaucccaaaugauguuccauugucucaugaacagaaguuaugggcuacaaaaguccaugaaguuugccccaaguccacuaaacuaucaauucaaaaaugaaaaauuacuaauuuauauacauaauuaaauucauuuuacuucagcaaaagauuucauucuaauucacucuaggacucaacuuauuauuuaaacauauuuuaauucaguuaaguuauugacaauauaaugaaaaaauuuacauacccuuggcugaaaaacaaacuagggcucuuuuguuaccuauucaaauccagaucucucaaguaggagggacgguucuuauuuaggaaagcugaccuagcaguuaggacaccuccccagagugaggcguaagcacucacugagcaaaggggacuguuugacaccaccacuuguagagguaagacuaggcacaucucacugcaaaguuuuagaauuagcacuaaaaggacuuaaguuagucauuugaacccacuggaauuguaaaugaaugugagagugcauuuucuuccugagaggcccuauauuuaaaagauucuugaaugcacagaaacuaacuguaaauucuggugauacaauaaaagaccugcuuugcuuauuaaagcaaccguacuaaagcaauugugaggaaugccuuuguuaggaaacagcugaggguuauuccaaguugguuuuaugccaagccuucugcagaaaccugaaugugcugauuuacucuuguaauaccacgguagguuuucauuaucuuugauaugcccauuauggagaacacuaaaaauacauuuccauaucaagauaaaauaauuugaaaagggguuauguuuuccucucucguaccaaguaaccucugguuacugcuaguacugguuucacugcagaaagcaauuuagccuuguuuuaagagauuauuuugccuucuuaccuaaccauauccaauagauuccaaaagacgaauaaaacacacaccacauauuucucuuggacuuccucuugacuggugaucaccacaaaaaggaugauuauucuuucugugagcuaacaaagaaacagcaaagucagaaauuaggacaucuauuaggcuauguagguaauuuucuaauuuugaaaaccagaucuccuuucaaaaguauacuuuagcuggaaauauguauacuaaacuguuaacaaugccucccucugagagaguaggguuauggcugaauuucaguuccucauuugucuauauuuuacaaauaauauauaaugaaugaaaaaaugacauauauuuuaugugaaucaggauauuuccuuucuucuugccacaugcauguguuucuagucacuuugacaaggcuuuauugaguguccacugugugucagaugccaaaaugaaaacacagucuuugcuccaaagaggguagcaguggugggagaacugaacaauagccagcacagugugugccagauaugggagcacaggugagcgagauacuuucugccuggagaaagaaugcaaagagauuaaugaagacaugcuacauuucauuucauccaaguuggaucuugaaaaaugaauaagaguuugucagguagacuggguauaacagaaggcauccuaggcaaagggagcagccugagcaaagaggcagagguaugaaaauguagggugcccaggggaguaaugugaaccacuggggggcuagaggggagggugcauagaagggaauaaaaggagaugaaauugaaaacauguuuggagguggguugugaaggguuuugaaagacaggcugagaaauuucaguuccauccaauagagaaacuuguagcuuuuuuuuuucuuuuuuuugguaggggaguaauauaauccuaacccuuauaagcuagcagaaaaugaaaagaauucaauauauuccaagucagcauuuacaaaucauugagacuucacacauuuuuggcuuagccccaauuacuagccucaaaaaauaaaaaaauacauuccuuuuucccaaccuaaauauaaagugccuucuuauguuauauuaauauauccuguacauucuguauuuuguguguuuuuaauaaaauguuuuacuugcucuuaauggucaaaggaaaauauacuuaagauugaacagucaaauucacaguaaagaggggaaugauuuauauuuuucuuuauuuuaaaaguggaucaaggagaaaagacugggauaaccugugacuuggcauuuauaggcugcuaguccuggaaaaucaccuagugcccagaaauccaagauuugccaacagugggccacaugaucagaaauccacguguauaagcuauaucagcauguuuacgacaugacuacaguggugagucaagagggucuauguuuggcuaaggggaauuauauaugauucaaaccuuagucaaaccauggaagcuaucuacauagcuguuuuucuuuuuucagucuuucuuuauaauauaauacucuauugauuuaauuucaauaauaaauucuacugaacugcaauuauaauuacugaacaauccaaccuugaugucaugacaccucucagccuucagauacacgaucauagcaacaaauaaguucuuaggcucuaccucucuuacauuugaucagugcuugguuauuaggaaaaccuucugguuuuugcuagaaaucucaggagauacacauacaugaauggauacaugaauaaaauacagauuucuaauuacauggcuggcuacucaaaaaacuuagacaccuuucaauaagaugaucucuagggucuccuccagauaaaacauucugauacuagcccagccccaccuuuuuggaaacaaggaauuugggaacagaccuggaaacauauauauauccgaagucuccugguuuccagaguuguaagcuauccaugaugucaggucaucccuuaauugaagaggacagaggggaaaaucuccuaaaagggagagacuggagcugcaugaugaaacucacccuguugaaaaucaucacuucacugucuguggcaagguagcgaugaaaucccagcugcacagaaagcagcaacaggauggacccccaaaccaaaccacaacacacauacacacgagugaagacucccucuauauucggugucaaucuaauucguuaacaaaucaucugaugguuauucaacucuaacuugaccauucaauggcaauacaauggggaaauuuaggcagagauguucuuaaauugaaauaaagcuaauauuuauuguuuaccuugugccagguuccaaauauacaccaucucauuuuaucuccauaaugacccuaagaaguaggugcuauuauuguucuaggcguuuuacaaaagacaugcauuuuaccaacugaaagugacuuaccuacaagucuggaaucaacaucuagacaauacgacuucaaauuccugaaauacuaagacucuuucaccauuguuacuugauaugaguuacuccaucaccuaguauccagauuauagccuauucuuuaaaaaagcuucuccuuaaaaauuaagccuuaaaacaagagccuccuugauuuucuuaacaccaaaacaauuuugaagaaaaggcuuuuaauauuuaucagucuucucuaauaugaccauuugaccaguuauuuagagcuugacacauggaagaauuuagcccuuugucauuuuuaacaaacccugugaaaauaugacaaauuacuagagaauggucuuguuuaguacaacucaaacagguagaguaaaagguauaguaaauauccuacaacuuggguuacauuaaacauagugauaaugucaucuacucaaaagugugauaacuauauaauaaaaaugcugggcauuuuuauguucuauuugggaauccuaaacuccagguugagcaaaaauugaaacuaaguuguuacuuuacaaauggcagguagcacuugauuuauaagcuaugggaggguaaaaaugauacuucaacuacaggaaaaauuaauuucuagaaucuuaaaauuaguuuuagucuaaaagacuacuauuuuacuaaaaugaaaaucuaaacucucaauccucugaacuuuucugagaacuucagaaaucuauauauucaaaaacuaccaauuacaugcuucuauaagacaaaugcauuuaaauaauuguauuugcuuccuucuuuauucaucauucaauagauaauuauugagugcacuguucugggucccaagggauauagcugugaacaagaccaagccccugccuucaugauauuuauauuacacuuggugaaacacuaaacaaauguagcauaauaguugagagcucaagagccaaagagcuuaaaugucugcuacaauauucaaaaccuaugugaccuugcauaauuuacuucuguguuaaguaauuauaccagagauaauaauuagcaucuauuguuacauaguaauuauuauauacaggaaaagguuguuguaaagauuaaauaaguuaauacauguaaagaacugagaaaaguguuugacacacauaaaagcccaaauaaauguaagcuaugauuaggaaaauaaguauuuaaauauacuuuaauguagugauuuacauuguauuuacaggaaaacauuuuucuauguagauaaugacugugaauuaaaaaauucaaucucaacaucuguaaaauuacacuagaaauauagcuuuauacuuaucacacauggaucaaaugugaaaaacaggaagauucuaaaaucuuaccuacagagugaauuggacauguaauucacccucaggaggcuucaaaauuuggagaauguuacaacucaacacugucuuuuauaguuucuucucuaacaauauaagccuauuccaagcucaaaacuggugagaaaaaucuaugugauuuuaauggaaagucagauuauuuagucuagcaaugcaaauaagcaccugcuucauggcuaaaaauaaauuaggguaaaaucuggcuuuuugccuaaaaggcaaaaaggaauuccuuugggaauuccuucauauuuguucucuuaagaguaugugacugugaaaucuuuagagggauuuuugacaaacagaucccugcuugcccugaucagaaauagaaguguuacuggcaaauacagaaacaguuuaugugauuugggcucauaaauggaaucuccguaagcacaaucauuuaggaguauuaguuuuuaguguuuugguugagaaauuuuaaaaauugaguaaaaauguguaaaauuaauagugcaggaguguuuauuaugacacagagggaaggauguauaauugaaucauuuuaauucaauuacaaaugaaauauuggcauuuaaagcauuucucaaaaagugauggaguaaucuauuaaggguuuccuauaggggauaucagucuaauguuaugacacaaagguuaguguuggcuauuuuccccucuucuugaguugaaacauccuaaagcagcaugaauaaaaaucuccuccucaggcuucuguacaagcaaacugaacaaagccccuuaaaaucaacauuucaggcuugauaguguuucuguacuauaaaagucaaguuguuuugauuaaauuuacugaaaucaacuaguuuuccaauucaacauuuuuuucuaagcuaauaaaguuugcaagcucauuucggaggaggggauuggagaggagaaauaccuaguuuugauuuauauuaucauuucuuuuaugcuucuuuuggaccauuuuaacuuuuccauuuugaaaaguaaaaguaucaaaguuuacuauauuuucuuauaugauuuuuauugucguguaauuauuucaaaaauuggaaguccauaaauagcuacgcuaugguuuugcccuuuuccccaaagcguauaaaaaaauaaaauauaugucagucaaaugauuauugucuuuuagucaauggguuuuuuccuuuccuuucauauguaauuuuagaaauucauaaugguuucucccuagguaucaaaauaaagaugugcauguaaaacauuuaaaaaugcacagggcaaaccgaguccagcagcacaucaaaaagcuuauccaccacgaucaaguuggcuucaucccugggaugcaaggcugguucaacauacucagaucaauaaacguaauccaucauauaaacagaaccaaagacaaaaaccacaugauuaucucaauagaugcagaaaaggccuuugacaaaauucagcagcccuucaugcuaaaaaaucuccauaagcuagguauugaugggacguaucucaaaauaauaagagcuauuuaugacaaaccgacagccaauaucauacugaauuggcaaaaacuggaagcauucccuaugaaaacuggcacaagacagggaugcccucucucaccacuccuauucaacauaauguuggaaguucuggccagggcaaucaggcaggagaaggaaauaaaggguauucaauuaggaaaagaggaagucaaauugucucugucugcagaugacaugauuguauauuuagaaaaccccaucgucucagcccaaaaucuccuuaagcugauaagcaacuucagcaaagucucaggauacagaaucaaugcgcaaaacucacaagcauuccuauauaccaauaacagacaaacagagagccaaaucaugagugaacucccauucacaauugcuucaaagagaauaaaauaccuaggaauccaacuuaaaagggaugugaaggaccucuucaaggagaacuacaaaccacugcucaacgaaauaaaagaggacacaaacaaauggaagaacauuccaugcucauggguaggaagaaucaauaucgugaaaauggccauacugcccaagguaauuuauagauucaaugccauccccaucaagcuaccaaugacuuucuucacggaacuggaaaaaacuacuuuaaaguucauauggaaccaaaaaagagcccgcaucaccaagacaauccuaagccaaaagaacaaagcuagaggcaucacgcuaccugacuucaaacuauacuacaaggcuacaguaaccaaaacagcaugguacugguaccaaaacagagauauagaccaauggaacagaagagagcccucagaaguaauaccacacaucuacaaccaucugaucuuugacaaaccugacaaaaacaacaaauggggaaaggauucccuauuuaauaaauggugcuaggaaaacuggcuagccauauguagcugaaacugaaucccuuccuuaaaccuuauacaaaaauuaauucacgauguauuaaagacugaaacguuugaccuaaaaccauaaaaacccuagaagaacaccuaggcaauaccacucaggacauaggcaugggcaaggacuucaugacuaaaacaccaaaagcaauggcaacaaaagccaaaauugacaaaugggaucuaauuaaacuaaaaagcuccgguacagcaaaagaaacuaccaucagagugaacaggcaaccuacagaaugggagaaaauuuuuacaaucuacccaucugacaaaggguuaauauccagaaucuacaaagaacaaauuuacaggaaaaaaaaucaaccccaucaaaaagugggcaaaggauaugaacagauacuucucaaaagaacacauuuaugcagccaacagacacaugaaaaaaugcucaucaucacuggccauagagaaaugcaaaucaaaaccacaaugagauaccaucucacaccaguuagaauggcaaucauuaaaaagucaggaaacaacaggugcuggagaggauguggagaaauaggaacacuuuuacacuguuggugggacuguaaacuaguucaaccguuguggaagucaguguggcgauuccucaaggaucuagaacuagaaauaccauuugacccagccaucccauuacuggguauauacccaaaggacuauaaaucaugcugcuauaaagacacaugcacacguauguuuauugcggcacuauucacaauagcaaagacuuggaaccaacccaaaugcccaucaaugauagacuggauuaagaaaauguggcacauauacaccaccgaauacuaugcagccauaaaaaaugaugaguucauguccuuuguagggacauggaugaagcuggaaaccaucauucugagcaaacuaucgcaaggacagaaaaacaaacaccacauguucucccucacaggugggaacugaacaaugagaacacuuggacacaggaaggggaauaucacacacaggggccuguugugggguggggggaggggggaggaauagcauuaggagauauaccuaauauaaaugacgaguuaaugggugcagcacaccaacauggcacauguauacauauguaacaaaccugcacacuguacacagguacccuagaacuuaaaguauaauuuaaaaaauuaaaaaauaaaugcacaagaaacagaaacacagcacaaaaacaaaccuauccccuguggacacaccaccacuacuugauauguguaaugccaauugcucaacuagcuaaucaguuccuacuguugguuggaauuauuucucuugauauuguggaggaccaguuccccccaagaagaauucaguugucacuuaacaaucuuuuuuuuuuuuuuuuuugagacggagucuugcuccgucacccaggcuggagugcaguggccugaucucugcucacuguaaucucugccuccaggguucaagugauucuccugccucagccucccgaguagcugggaucacaggcacgcgccaccacguccagcuaauuuuuuuguauuuuuaguagagacaggguuucaccauguuggccaggauggucucgaucucuugaccucgugauccgaccgccucagccucccaaagugcugggauuacaggcgugagccacugcaccuggcccacuuaacuaucucuugaagguaauaaucaaaaucacaucacaacuguaucgacaugguuuuuuagcuuacuuaaaagcagccacucucuuaacuacaguuucuucauuuaaaaauggggaaacaggaaaaccaagaaugauuacacaaucugaaaguuuuguuucauuauuuuaaagcaggggccucagcgccaucccauaaugagggaauucuaauugucugcauaauucuaauauaggaaggagggagaaaaugaaacuuugggcacaaaggcauguuucugaaccuuuauccaacaccauuuccauugugggaaccacaaaaaggaugauaaauuaauaaaagaaauaggggccaaauaaaaucuuaaaagagauaaaaagaggaagccaaacaaccacaacaaaaauugauaauauucagcucaggaagagaauaauuuucuucccuaacacagugaucucugacuuaucucucccaguaacugaagacuuaaaaaucauuugcacuccgauaacaucagauuuugcaaacucgccuuugaauaaaaggucucaauguauauuugccccuauguuuaaauugccaaaccaagauuugguucuuugauuacaguuauauuucuauaagccauuaaaguuuuaauuagcagugauuaaaaucagguguauauucuggaauuccuccaagaaaucagauuucuaaguuauauaauaauuucuauuacuaaacaagccuaauuuuguaaagcacauaugugcacauuuucuaggcacauucaaggugcucagugaguuuucuuccuuaaaaaauuaucuauucccuguaggugcauucucuacacuggcaauaauuaaauaacacuacuuuugauuuugaaaauguuuaccaugaaacuaguagcagccacuuagccuaaaaaaguaaaaaggccuuuaaaaaauaccaauagaaaacauaacugagauuuuaaaugaauuuagucauacuccaagcaaaaucauuccagaugauagaacacaacuuuuauuuaacguuaguuguuaauucuauuuuccaacauuaacauuaugggaugcugguacuacauguauuuugguuguuucaaaguacaccacauuguaaauaaguaauaaacaccaauaaaucuugcucccagauacuauguugcuguugggacagaucuguauccccguuuauuuuguaaggaacuauacuaaagggaauuccaucuaggucuuagcuaguuaagugacuacuauguuauuaguuuauacaccauuacccuaacuuuuauuuuauauuugauauuucaacauuuuaaaugucuuuauccuaauggauacuauuucccuacuguuacuuaauaagcaaaauuuaaaauauuccauaaacuuguaaugcucaguucuuaaaaggcuccuuaggauuauacuauuuauaucuuuuaagcuuuuaugauauuuuagacaaauuuuaauauaaggaucuauaccacucuuucauuuaacaaaaauuuaaaguguacauuuacauucuaagcacuuugcuaggugcuggcaacaccauaaaauucugacauuuucauuauuuuuacaaugugaaauugucaaaauuaucaauuuuucaaauuuauuuugaggauaccuaaaauuauacucauguagauaccuauuucuguagacuugaaacucguguucuuauaguugccuaaccuuuacugucccauaagaaagggacaacuauaugagcuauauaaaauuuacagaaaaucuuuauuuuuauuuuuuugccuuuauccagcaaugauuuucuacaugaagucacuacuaguaaauuucccaucuuccuucaaccugucuuuacaaagaacaugguaaucuagggcuagaggcauggaagagggaacaaagaauaguuaagaaaauaguaauaauagcugccgaguauuguauucuuaacuaagugccaggaacuuauccauuuucucaguuacuucauaagauacauguuauuuucauaucacaugagaaaaugcaguucagaaugauuaaaugacuuguuuaaauguauacaacuagugcaaaguagaacugggauuugaauccgggucuguguguuccccaagucuauccuuagaugcuguacuagauaaacacaaaugaucuccucuuuccauugacguuuaguaaaaaagagggaaugagcaagaaauggccuaggaguacucuauucucuggauguagaugaaggaagccuuuuguuuuuuaaucaucuacucuuugccagguauuauuugugguguccuuucccucaacagcccaaugguuguucccauaguaugggugguaugaucccauagugguaagcagaaaagccaggcuucaagccuaagucuccaguccuaugccuuaucauugucuucuacuaacccaggcagugacacagugaggguagcaaguggcuacgaaaucuccuuccaggauaggaccaaugcagugcugcaagaucagcaagcaucacugcccucaguguuuccaacugguuauucuaacugggcaguuuuacaauaagguuguccuuccaugaaauuaauucuccuuaucagugaccuaagacaaggguuggcuuucuaacugccauaaagucaagagaagcuuuaaagagaaaaaauguaaaaaugaaacagauucuauaauaauaugugauucaaaccuaccugcaaaaaccuugggagaagaugguuugacucaaugccaacauauaugugcagcaguuccaggagagauacggauuggcaaagucgcaucacaaguccaauagcauaaaaagugucaaccauugaaucuguaucccguggguuaaaaaugcagauauaggaagaaaaaacuggauuauaacccaaauuuaugcagcacuuugaagucaaauggagauuauucacuuccuuuuucauuguacaugugaaaaauuccuuaaguaggcuacuaaauuauuaacaauacaaugcaaacaaacaaagcacuucauacuguagucuauuuuaauugcuccuguuccaaaaagaaaucgaaacuugagaaagauuucauggccaaacauacacauagcauuuauuccccacuuauaagauuauaaagcaauucccacauaagaguaaccuccuagaaucuagaccaccucaaguguaaauagaagugagcuuguuaaggacacuaugugcucacagcuucuccacugacaagaaaaugacaaagaugagaaaaaauauuauuucggagaaacuuuauggaaaugacacuaauaaugccaugauaucaaauaacauagguaucuaggauuuuguuucuauacauauuugguuagugcuuuucuggauuuuguuaaacacuggaacuugggccucugaucaggacuuuugggguuugcauugcagaggguucacaugaaauacugugcacuuggagcugaaauggaagggaaacaaauguuccucuacauaggauaaauguguugcuuuaaguucuaaaaugaaauccugccauguuuagaaacucguagggaagauuuugcucucuuuacugcccagugaugauucacacaauaauaauuuacugagcaguaaggauuucucuucucggcagcuccacaagauggacacuauuaucaucauccccauuucagagaugguuccugaaguacacaguccaugcucuuauccacugcccugcacuugcuguaccagagcauuaugaauuacacagcuccgugaaggaagaagguagcagguauaacacguucaggguuucagguuucuguugagcuacuuacauaauuuauacauugauucaaaaauuguacugaaaccacacuuaguuguuuucagucugucuccugaacgaaucgguuguguuucuuuaauaauaagcuucuacaauuguaauggcaggauaauaacugagaaagaaaugcgccgagccgggcacaguggcucacgccuguaaucccagcacuuugggaggcugaggcaggcggaucaccuuuggucaggaguucaauaccagccuggccaauguggugaaaccccgugucuacugaaaauacaaaaauuagccaggcaugguggcgggcaccuguaaucccagcuacucagggaacugaggcaggagaaucacuugaaccugggagacagagguugcagugaggugacaucguaccauugcacuccagccugggcgacaagagggaaacuccaucucaaaaaaaaaaaaaaaagaaaaaagaaaagaaaaaaaaagaaagaaaagaaaaagaaauacuugaugacuaaggcaacuuuucucacuggaaaggugagacagcauaagccaguccauggcuuguguugccaaugacauguaauaugccugcacugccucagcaaaccucaaagggcuagaagugauggcuuuuuaauaaaaauauaaaagaaguuuucccaucaccuguguuuuccugugcuugaaaacucucaacauuuguaguugaaacucaagcuuuagguuauaucuuuggagguccuuaacaaaggcgagacuauaucuguagauuuucaguaagaaaaagcaacauaaaauagcuuaugggacccugcaaguagaauaacuuccuuaugauacacacgucugaaaugaugagcacagcaugacuuuucccagcuacauucuaaacauuuguuuuuagcugaagccagcaguugcuuagauugucaagucacucaacaguuguaaacugugaggacacuuacccacgugcggauggaacaugaagagaauguuauuuugauagucauuuagucacccaacagugacuuuacuuuucaggaaacuagaggaaguuuaugacuuaaaccauuaaugcugacuccuauauaagugguuagcccucuacaaagugugucauuuacauauuacuucuuaaagggaccaaauagaggcuuggggaauauaaaauuuguauuucacuuacuaguagucuccaguuaccucaaaccuggggaauaauacaaacacuggaagaauuugauucauuccugauuucucugcauaaaauguuaugcugagauuuccucaaaacacuagaaaucugcuaagguuugguacagaauggaaaaggaacaaugaaaugauaccaccucagugccauccaucucuuuuuugaggcaaacugccaacucagggggaagccaaaucccuuucccuuacuuaucccaccuucccccuuccccaagaagguuuugcaauaaacaugguugcuaaaaaauacaaauuuuagagaaggauauuagaagguugagguguguagaaauuuaauauaagcaggaugaggugaaaacaaggauuaaaaguuaaaaauaaaaaaacuguuucggaguuuuaccuuuuccaaaugaaaagaaucugacugucauauuuguaaauauccaagaguggccacagaacuggauuaaguaauagaugaaaagauacgcauucuuccuauaccuauaaauacaggaaaauaccauuaaacacuucuuuuauaaucauccuuucaucacuguacacaugcccuuuaauguacuggccaaccugagaaagcaaaagaaaacuguuucauaucagucuuuuaucugguuacccccaaguacauaucagauuuugaagggagccauaaccuacacuacccgcuaaaguaaauacagaugcuucuucacuuaugaugaaguuacguccugguacaccccaucagcugaaaauaucauaaacugaaaauaucauaaguugaaaaugcauguaauacaacugaucuacagaacaucacagcuuagccuagucuaccuuaaacuugcucagaacaccuacauuagcuuacaguuggguggaaucaucuggcaacacagugcacuguggaguaccgguuguuuaccuuccugaucaugcggccgacugggagcugcggccugaugccgcggcccagcaucaugaaaggauaucauaccugcacaucgcuagccuggggaaagauuaaaauccaaaauuugaaguacgguuucuaaugaauacauaucauuuucacaccaucacaaaguuuaaaaaauugugagucauggaccaucuguauagugaguuugcuuaaaaccaaauauagugcuuuuucaaaaucugcuuucaucuuugauaaaguucuaaccuugcugcucaccaaggaauaaaagaaaccacugcgaagguggcuuugaauauucuuuaaaaaaacaaaacaggcugggcgcgguggcucaggcauguaaucccagcacuuugggaggccaaggcggguuggaucacuugaggccagaaguucaagaccagccuggccaacauggcaacuuacaaaaaaaaaaaaaaaaaagccggaugugguaacguaugccuguaaucccagcuaccuagcugcucaggaggcugaggcaggacaaucacuugaaccugggagguagaggcugcagugaaccgagacagcgccacugcacuccagccugggcgacagaucaaaacucuguucucaaaaauaaauaaaaaauaaaaaacaaaacaacaacaacaacaaaaaauccaugugugcagagugguugacaugucacuauguguuccaguagcucagcuugcuaagugcagaacuugagacacaguguuuuaguucugaagggggguagggaugggaguaauccaaauguuggguaauucaguaauuggacacaccugacuuuugaacacauuaugugauugagguuaguauuaacaucuugccacugccuauuaacauuuugcaaggguagauaguuuccuucaucagauacauaucgaaagcaguuuaguugcucauaccagaagagggaagucaagcuggguuuaacaauguguugugaguugcuggggagaugacuaagagaagauugacagauagaugguuugagggaguuaggaaaagcacuguuugaaauguucccugggaguucagaagagugacgggaguggcccugccaguguggucaagauuuacuccuccuugaagaugugaaaccuccuagaaacaaggaaaauaagcugggaggcagaaugauuuuuauuuggggacauccuccccuauaaaggcaggaacugcuaaaggguuugggaagaggaaauccuccuucagcuuguaucagaauuaccuggcuuguggguuaaacauauacacccccaggcccuaccgcuauaugacugaaucuguuccccgccggaacuaggcccugaaaucuauacgugugauagguguuuccacggcuguuacaucuaaaaaucaccccgcaacucugcgucugagaaagucaagagaaggcuccuggggggagggaaguacuggcagagggcucacaagggcagggguagccaugcagccuguccuucccauucaacuguaaaauggagaaaauaacagagccugcuuccuaggguggucaagagggguaaguuagcaaauaccugcaugagcuccaaggggugccugggcacgguagcgcugcgccuugcuggcgggcggggggugccgcccgcccgcccgccgcagaggggagcucccgccuccaggcccuccacccgcgcccccuccccucgggauucggccgagcgcccuaccugggcugcagccaggcgggcagcgccaagggccccaugggccgccgccgccagggcuuccagcgcgguccaggaaggaguacc

SEQ ID NO: 191383 - RNA, 63335 nt, Homo sapiens
cuccgcacugcucacucccgcgcagugagguuggcacagccaccgcucuguggcucgcuugguucccuuagucccgagcgcucgcccacugcagauuccuuucccgugcagacauggccucuggcaccaccaccaccgccgugaaggugagaugagcccucccagccgcagcgguucgcccugccggaugccuucucgcccccgcgccgggggaccgcgccuccgggggccaugcgcccggcccgugcgucccuugccgccgcggggagggacuggggcgcggcacucgggacucacuugccgcgcgaggagaggguacgcuugcaaaugaucccccugccgcaccgccaacacacacacacacacacacacacacacacacacacacacacacacacacaccaccuuuuggcuuaucugcacccgcacccuguagggcguaggcaccccuuuagagagagaggucguggaugggagaggcugcacccaugccaccaccauuccugagaaccacucuucuuccaagaaagacacccggcuggagucaggagguguccgggcgccugcagcuucugugaccgucuccuggugccuugcgggacuccagcuuccgcucucugacucugcuuguugccugcggcccacgugggagaacugcuuacuugcucuuuuguaugcuuccggcuucuuuuuccuccaaacguaggccuucuccgcgcugaaguuuuccccagcagcguaauacuguaagaauucugagacuuucuucgaaaaggaguacaggcguccguuuuuagggcugcacuguuuggaggccucuggcuugaaacugcuuuguuuugcagccuugcaaguuagaguucaauuuccuugugcccuaggcccugagaggccuugauacaaggggucauugugcggugggaagcuuugugcugaggagggcacgaguucugagaguagcagcuggcuucccugggguuuuaaacacuucucuccugguuaguauuccgagagagaauuacagcacguaaagaaaaauugaugauaaaacuuaagaccucuucuaggcaguuuauuacuggcuaagaaugcguucuuguuugauuuuuagaaauuuuuggccuaugggauaggaaggucugcgaucuucuccaaagcaucucgauucccuacacucgacugcaguuuucccgggagaaggcgaauuucugcggucaguguguaaucagccagauuaguuuauuacgcccuugcagguuuaaaugagccacuuagaaugagaggaauggugaaggguguugcauccagacuuauauaugaaacuuauuuugucauuuugaaaagaaucuugcauccagcaaauauuuauagaaggccucuccccugccuucauuguuuggcggaaacaaggcagaaaugguuuucaugaaacucgugugaaguaugugacuucucuuaggugcucaucuauaaacugagaauuuuacugcagaauuugcuaggagggcuagaauuauauugucuauguugcacaugguagaagcuuauuaagugguagugcuuauaagugggggaacugagauuaauuuugaaugaucuuuuccccaaaaauuauuaaguuauuguguuagguaucauuaggccacaacuuuucaccuuauccuugcaggaauacacuucaagcgccauuaaaaauggagaaaugguguuuaaaacagucuuacuuuaaucugguuagcauucucccugccacaggguuucccuucaaauuaaugcagugcauuuaagugcagaaugggcaaugggauucucagagaccugauguaaauauugaauaguguguauuuuuggucuuggcaagcuucuggauauaaaauuaagagguacauauggugcuaggacugccugcugauuucucuuuuaauuuagaacagaugacagcuuugccguagagauuccaugaugccagcaccguauuccccagacuucuaaggcaacauucuguauagaagaugugaggugccaguguccagagcaaaauagguuaauaaaaaccacauccuauucccaaauuauagaaugauggggcuggaguguuccuucaagaccauccauauagccacacaaacccguuuugcggguguaaaguugaggcccagaaaggucagcuaaguauccagaauuacacagcuggaccuagauaaugacagaauugggccuagagccuggcauuccaccaacuagaugugaggcauuucugaaaucugaaguguggucucugcccuguuuucuugugaccuaaugcacaauuaaaaugagcacuugauagaauguccaucuugaagagggaggcagaggguaugcagaaagcaggcugccuccagugcccacugcacaccacccagguauagguauaggaggcacaugugugucugaaccccauuggugucacuggcagguccuuugagagguugcuggauuuaaauacaguaacauguaacacacucagcccaguuccagguacuccuuuaaugucagcccaaguaccucucuucuuaaaauagagauauuaacgggguggaucuuaaauucauucucaauuuuagaggugcaguuaacucaugcaagugaaagauuccacugaguuuuggauuggcaguauauuuggcauaucuuucaaaucuagccaucuacugguggaauccuauucaaaaauauuuauugaauaccugcuagacaauggggaugcagcuuugaguaagcgaggccuuuauuuauuuucuucaaguuuauauucuagucagggugggaaaccaacugacaugaaagugaaacagcaguaagauuccauugggugaggggugucagaaaagacuccuagggagguggauuuuaagcugugcaguagucugccuccaaaaucuguauguugaaaccuaaucgccaaugugaugguauuagaagauggggccuuugggcgugauuggggucauaaagguggagcccucaugaauggaagcagugcccuuacaaaagaggccccagagagcugccuuauucccucuacuaagugagaggacaccaucuaugagccaaaacgugggccuuccucagacacugaaucugcugugaccuugaacuugcuaagccuccagacuaugagaaauuucugcuguuuauaagccacccaguccuaagauauuuuguuauagcagccugaauggacuuaagcugauagugaaaauagggauaaaggguaaagauccaagugaagaccugaggagagagauggggguaggagagcgaaaaccaagaugucgcagaagugagcucagugugguaggaauggaaaucacggaugcacagugagaauuggguggaugcagcucauaaggccauccuuguagaccgcgaucaagaauuuugauuuuaaauguuuuggaaacuguugaaggguuaagagugggaggcagcauuugauuuacauuuuaaaaugauuacucuggcuguuguauacagaauagccugugggcaggggaagagcuaagagaucaggccagaagucuuggugcuggggcugaagucuagggugggagccauggagguggugaggaauaaucagauuggggauagaauuugcagguagaacacagagauggauaagauguggggagugcaggaagaagaacaggaugauuucugcuuuugaccuggaaaaccaaaaagaugaugauacugguggaucauuucaaagugggcgauaaggggccacgagugacuccuuggagccaaggagggugaguguaggauuccuuccucccagauacugcugguuagggggccagaggcugggaugcugaggggccucuuugcuguaggagcagaguggguggcagguugagggagggaggaagccaccuggagugagaguaauucaagcaaucuuuuuugugguucacugcagugagagaugguccaggcagggagugaggauauuaccugggggguagccauggagagaggcagcaggagccagaggcuaugggauuaacacugccauugucugagaggaccucagggagacauuguccuccagcaucagccaagggcaggugguauuccugacagagggccaaaccagucuuuggcacccagauacagggcauucuggagggcuccugcaguguaccauggcuccccugggcagccucccagcuuucauucugggagauuaaaaauaagacuuggccaggcgcgguggcucaugccuguaaucccaacacuuugggaggcccagcugggcagauuaccugagcucagaaguucaagaccagccugggcaacauggugaaaccccauuucuacaaaaaauacaaaaauuagccaggcacggugcugcacgcauguaaucccagcuacucaggaggccaaggugggcgaaucucuugagcccaggaggcagagguugcagugagcagagacugcgccauugcacuccagccugggcgacagaguaagauccugucucaaaauaauaauaauaauaacaacaacuuguuaaucaugguugcugugacaaggaggggauauggucccauuguagguugguagugagcuaucaacauaaugauauuaagggagauggacaagucaugguuuguagacuguggaauaugggccuuuacacucccugcuuugcugucuugaguguggccugcaagggccuucagccugagaguccuuguguggcuaucugaaacugaggacaaccugcaggccccaguugaaaaucacaugaccaacaagccuucauuuuuuuugccuagggacacaagggcauuuugggcaggacaauuauuucuuuuguaggacugucccaagcauugcaggacauggaguacaacccuuaaccuccuccacagaaaugccaguagcacucccccuagucaugacagccagaaauagcccuguuuccagauacccccaggagagcuguuugacauuuaguugaggaccccaaggcuaaaucccaaaaaagacuaccugcugaagagagguaggagcagccagguuuuguacugcucagcagaguaaaaggaggaaauaagggcuuuuuuuguugcuuugaggaaguuuauuuugauuuuuuauuuuugccaggagugguaggguauacagaaacagagacugaugguaauacauuauuucauuuuauucucuugauaauuuuauggauuaguaaaaaucuuacccuauagguacagcugaggaagcaguuaaggaaaauguuuguaugcaguggauucuggauccucaccugugguuguagucauggcauuccagccugugccucaaaagcaucuaaagcagugguucucaaagcgugucaugcauucauaucaccuggucauuugcuagaaaugcaaguucauaggccccaccccagucccagugaaucagaaacucuggggcuggggcccagcaaucuagguuuugacaagccuuagaauauucagauguccaccgaaguuugacagccacugaccuagagagcuuuggaaaggguggccaucuacauuuuuaacaaguucuucccuuaguguuauaguuuccuguugcugcuauaacaauuuucacaaauggaguggcuuaagacaacacacaugaggccgggcaugguggcucaugccuguaaucauagcacuuugggaggcugagguggauagacugcuugagcucaggcguucaagaccagccugggcagcauggugaaaccucaucucugcaaaaaaaaaaaacaaaaaaauuagccaggcguggcggugcacgcuuguaguucagcuccuugggggcugagguaggagggucacuugaacccaggagguugaggcugcagugagcugagauuucaccacugcacuccagcagccugggugacaaagugagacucuguuuccaaaaaaaaaaaaaacacacacacacacacacaaacguauucucuuacaguucuggaguccacaaauccaaaaugagucuuacagggcuaaaauuaacauguguaucgggcugguuccucuuagaaaaaccauuuccuugccuuuuucagucuucugaaccuguagaaccaugagcuaaauaagccucuuuucuuuauaaauuacccuaucucagguauucuguuauagcagcagaaaacagacuaagaaaaauguugugcuuguaagagauugggacacggacacauacagagggaagaccaugugaagacacauggagaacgcugccaucuacaagccaaggagacugaccuuagaagaaaucaaucccaaucucaccuuaauguuggacuucuagccuccagaacugugagaagauaaguuucucuugcuuauggggaaaaccuauuuccuugccuuuuucagcuucuggaggcaccagcacuucuuggcccauggccccacaucauguccccuuuucucucccucugcuucuaucauuauaucacuuucuuccucauuugaccuucuugccuccuugugauuucauuuaggucccacccagguaaucuaggauaaucuccccaucucaagauccuggauuuaaucauauuugagguaacauucccagguucugggaauuaggauguagcuaggaucucuugggacaggggcauuguucagcuugccacacucagcccacguuuuaaaaauuuauggucuaggggccgggcgcgguggcucaugccuguaaucccagcacuuugggaggcugaggcgggcggaucacaagauccgaagauugagaccauccuggcuaacauggugaaaccccgucucuacuaaaaauacaaaaaauuagccgggcacgguggcagccuccugucaucccagcuacuugggagacuaaggcaggagaauggugugaaacugggaggcggagcuugcagugagccgagaucgcaccacugcacuccagccugggcgacagagugagacuccgucucaaaaaaaaaaaaaagaaagaaauuuauggucuaggcccuagagcagguugcuuaguucugagggcacuuuagaaccaccugcggagcuuuaaaaacaaacuacgccuugcccaacuaaucagaaucccugaggccugggcuuugguauugaaagcuagagaaggggaauguccuaguauccagcagcugguucaggaggguggguggcucccacuguugcuccacaggcaaaggagagcucuaacaaaguaugcauuagggagaguccuccucuaaaaauaucuggccauuucagcaggugaagugugucuuuaagagggugucugcccuuuagacugauaucuguacuucucaaggggcauuugcucaaauaaaaaccauggauguuuugagcgcuugcaucauccaagcuucucugacuaaaauauagagucacuguauuaguucgcuaggccugcuauaacaaagcacuacagaauggguagcuuaugcaacagaagcauuaucuccucacagcgcuggagguuagaaguccaagaucaaggugagaucaagguggauuucuuguaaggucagucugcuuggcuuguacauggcaauguucuccauuugucuucacagggucuucccucuguaugugguuauaucccaaucucuuguaaggacaacaguuuucuuagucuguuuucuguugcuauaacagaauaccugagacaggguaauuuauaaagagaagagguuuauuuaaaagaaaugaaagggagacgagggagauaggaaaaggaaacaaaaaagagacaaacuuugcuucauaacaacccacucucacuggaacuaauccaacccaaugagagcaagaacacccuccccugggacugcaugaaucccuuaauugggguggauuauuaccauggcucaugacucaaacuccucuuaaagguacuaccucccagcaucacuauauuuggggaccaagccucaacaugaguuuugaagaugaccacauucaaaccauaacaugagguauacugcauuagggcccaucccagugaccucauuugaucugaauuaccucuuuaaaaacggcaaauacagucacauucugagguacugagaguuggaacuucaaccuaugaacuuaggggagauacaauuccauccauaaccauuaccuacaaggguggccuacagagggggugucuugucagagauggagaccccagcuaucccuguggacccuauugcagguuuuuaacaguccucacagccugagacaguugguugcucccucucauacagcuaggcuuccaggauuuugcaaggcccugacaggccucaaagccaugucagccuaauaaugagggccuccgucugcugugcuugccaaaauuguuauggcaaccagagcuaaaggacugcagugcucagaucgggcugugccagcuccagcucuggcucgcuuaccuuaucgugagcuugaggcacucagaggcagcccaucucccuggcaugagcuagucucaaccgcuuggggugaugguauuuugaaaaugccauuauagagugcuggguuccuuacggcagugugcccaggccucaaagugauggugaaugguuucugggacaaagaaggguugguaaaaucuccuguagccagguacuagaagaaauagacagaguagggguuacuaugcacccuuuccacauugcuagaaguaacuguucugaccaggugaacugguauuuggauaaaugcuuucacagucucagagaagucagacccuuggauugauuugcucuugaacaaaaaaauuuuuuuuuucacugugaaaaugcuuucuuuggggugucuuuagaacaugugaugucaagacacaacagcaagcgcacauacacuaagacauggcugucauagaacagauugugcgugaauaaaggguucacaccacuuccacccuuuacacaguaacagaaggcucuaggccaccuaccuccuccuuggcucacucaaacucuuccuccucagccguggccuccugcuacugcugguacucagacaccaggucguucauguugcuuucagccucggugaauuccaucucauccaugcccucgcccguguaccaguacaggaaagcuuugcaccgaaguauaccugugaacugcucugagaugcccuugaucagauccuagauagcaguguuguugccagugaagguggccggacaucuuuagcccugagggugggaagucacacacagcuguuuuuauaucuugggggauccaaccaacaaaguagcugcuguucauauuuugggcauuaagcaugugcauguccaccuccuucauggacauguggccccugaacauggcagcuaccauuacguagcaaccauggcagagguugcaggcagccaucauauucuuggcaucaaagaacugccaagugggcucacgcaccaugagggcccaguacugcugguugucccagcuggucagcagggggaagccauacaugaagugcaggugggggaacaggaccauguuugcggccagcuucugcaagucagcauugaguuggccagggaaaugcagacagauggugaccccacucauggcugcagacaccaggugguucaagucacuguagguaggugugggcagcuuuaggguucugaggcagaugucauagagagcuuuauuuauuaucauugcagaaggucuaguuuugagaaguuugguuugauggucaguccguggaaaaguguggcaugagccacuagcuuuuaaaaucugucaaggaccuugauugacucccuauuucagaacucuaucuuguguaauaaagaaguccuggcugggcagaaauuccaucucaggucuugaacacauuuccuacacagucuagaauuaacuggacugaggacugacgcuuccugcccaggaggccuggcaaggucuugucauuguuuccugaggguggaugaggucauuaagaaagaguuuuccuccccucugagaugauucacucagauaccuggagucacuguuucugugcuuguucugugaccuucgucaugaacuugaccucucugagcauguugucucauaacauggagacaaauaacuuuucuaauaagguauaauguuauggaggacuccaggggauauugggagagggcacaucauagugguuaagccugaaagaccuagauuuguaucccagcuuugcuccuuaugauuggccccuggacgagguuuuuaauuuuugugcuucucuuucuucguuuguaaaacggguaacauucuauagggcccaucuuaugguccugaugaugaaauaagguaaggccacugaagcacuuagcacagugccuuuaacauguaaguccacagacacaguuacuuuauaacuaaggcaguacugaguugacacaaacuuagagacucaaaggaauguggauagaauugggccaucagugcuuggguacuucaucccaguuguacuuugcuguggagccagcagguggcgacauuggccacaucuuggcccugcuggccuccaucuuagagguccaguuuccugggauggcgggacucaguugcuacacuugucccuguaucccucgcacaauguagguuuccguaaacaacuggaccuaguaaagugacuggaugggcuugccugcagaucauuccagagcaguagccacucuugcuuucauguccagggcuacuacauguuccuugcugagggcugaguugccagcuaccuggugcagagucauuaugcagccagguggugcagacugaagcuugggguugcugagagugagcucaggggcucugaaauucagcgggacaccugguuagcauuucucaacaacugcuacaaugcugggcaaguucaccuaaacucagaggguggcuccaaacaaagcccaacucgauuuguguauuugaucccgagcauccaguguugaauccagaaucugagaugcccuggcucagggaacacccagaaacagccaggccaaaguggugauaaguuaaaaagcuaguagcugaauccccagggagcuggcugagaguaauuucagagucagcaguucauaucugugucccaggugaggauaugggcuggaugguuucuuagccuccucaugaccuguggugcuucagagguccacggaaugaaggauaagauggagaagccaggcuaaggaaggauugggauuuccuaaaacaguaugaauuuuuguuauuuucuauugaagugccguaauuuaaauguauugacuuaagugaacacuucuguugauuugaaagcuauaauacugguuacucuuuguucguugacauaaaaguauguuaaccugcugugguuuuaauaauauaccuccacaagauggcgccaacaucaaagccuggcuuugccacuuaaggaaauugugguggacagucacaaauuauguaaccaugucaugggaaacaggcagaguucuucaguaaaaaccucacuaaauuguccuuauuuucuuguuuguuuuuuguuguuguugcuuuuuuuguguguguguuuuguuuuuuucaggaaacugagccagaaagguaaccauuuuuuuacguguugauaggacucaacuuguguaaccugaccugaaaauuauuuaaugcagauguucacugaauucuuaauccuggaauuuuuuucuugaggccuacuuuauuuuauuuaguuacccuugugacaauagauuuaaagcuuuucauugaaaaacaacaaugcucaggucacuucgcauuaauuagguuucuaauaaaguuagccuggcacuguuuacucucuaggagguaccagcccaaggaaauuucccuaaugauuuguuacuuauuuuuaguuuuaacaguuuaguuaauuuuuauuuauuuuuguaauuguucuuguuugucuuucuuaaucaucaaauuagaucaacucucagaggauagugcuagguuucuuuaacucagacaaggacuuucaagauaaucucugaaaaaugcaauacaaugcaugaacuuaaaaaaaacuuauaacuaccuuuugaauuauuuauauuugcauaaauguauuuacugaguaauauacaugaguaugcuauauguauauuuacaacauguaaauaugaauuugcauacauauaugaaugauuguuuucauaaauguauaugcggguaacuuuucaugcaauuucagucuccucugucugcauucucuccuagcucugugauucuaauggcgugggaaagauaaucucucauuucuuuaucaaauagaacagugaggagaaaucaauaccaaauggaauaccuaauauuuuauaucccagcagucuucugaacauuguuuauucuauaguccauuugacagagaaacaaaauugaucagaagguacuuuccacuaccauacuugccuacuuuuagguuugauuuucuaccuugaguugguuaaaauaccucucuaugcugacuuguaauucagacagucagaaguaaaugugauguaguccaaaaaggugcccuacguuuugguuacuuauagaauauagaaggccuucaaauguuuguugauuuuuauggaaggcuuugaaauauuuguugauugauguucaguaauuuucagauuucaaaaaaauaacuagggcuuggcaggaauggagaagagcauaugaauaaaugaauuugcuuagaaucuuauuucuaauaaaaauuaccaaauacaauaaucuucucugucuuuuucucucuuagauuggaauaauugguggaacaggccuggaugauccagaaauuuuagaaggaagaacugaaaaauauguggauacuccauuuggcaagguuaauauccaacuuguggagacauguuuuuuaguuuuuucauuucuccuugcuggcuugauuuuugaauuaaaaaaaaaaaaaagaauugcuuuuguuuuggcagcccagggcugucugcucccagcagagagggccagaaguucugcuguuggguuccaucagcugagaaggugucugaugggcgccucacacuuugauguuuugagaaaauggcuacuuaguauguaaaucacuucucauucuguugcuggaaaucagauacucauuucagaccacagacucauuucagacuguacuuuucaaaucuacauucaaaucuucuaauuuguggccaauaggucacaccacacuaauuaggggacaggcugaugacuaauaggaugaauuauuguuacgaagcggcauuugaguggaaagaauuguuuuggggaauuagaacauaccugauguuaguugaauguguaacugagcuagaaauaaaaugcuccuccuuuuauaggagagguugcuuguucuccaagcccaugucacucagccuaggccggggugagggugucugcauucuccuaauuccauauugcuacguccucugguccaucuguaagaucucucuaucuggcugucccaaccaaacccuccuuuucagcuaaauucuuagguugaccuugugugcucccaguccugcagucauccugguucauuuucuuaaaccccucgguucuaagggucuuuccagccuuuguuaccucaagucauuuccaugaucaucuuagaccugguuaacacaagcagacauuuccagugcugaauucuuagugucaugaugguggcuuguuauccuuucugccuuucaccuucacaccuguucucaaaccugcccaauaaccuugacacaucuaaauuugaccagucuaccaucagaguucccugggguacucguuacaaauagaucugacuaaaugguaccuacacaggugcccaugguaaccuugaguccugugaaucuaugccugcagagggaucaauaaguaauugauuaaaugauuauauugauaaucagaucuugccucuucucuaaguuguauccucagacucuucagauuccaugaguccuguugugguugaacaauuauaauuuacauaccuguuuuuaaaucacugaguuaaaugucauuuuuucauugcaugcagccaucugaugccuuaauuuuggggaagauaaaaaauguugauugcguccuccuugcaagguaugguauuuuaagcuuuuuggauguuacuacuaaaggauaauuuaaauuuaacuuaaauucuggaaagaguaaagauacaggucugagcuuuuauauguuggcagaaucagaacaucuuaguaaccuuuauuuacaauguuuuauuuuugguuaaguuauauugacuuaggagaucaaagaucucaugcucuugccccuuacauugggaaaguagaucagaugacuaaaaucaaagcucugguuuuaguucuaacugcaagaagaaauguuuuguucauuuuuuucccccuucuuauaaagauaaagaaaaacaaugcaucauuaaugaccucuugcugguaguaguuauaugucugugggaaguaggcuuagggcuucugaaguggguuacuugugucugugcuguuguuuccuuaaggaggcuggugcugcuccauauuacagaggaggccaagucauuuuuaucccauuguuagaaguuagucaagauauauguaugaguucucuacuguuguguaacaaauuaccacaaauuuagcagcuuaaaauagcacacaucaucuccuaguuccuguuggucagaagucuggcacagcuuagccaguccucugcuugggguugcacaaggccccacaaggcauauucaaggacugaguccccaucuggagcuugagguccuuguucaagcucguguaguuguaggagaauucacucccuagaaguuacagggcggaggccuuuggcuccuagaggugguucacauucccugccguguggccugcuccacaggcuguucacuugacugcagcuugcuucuugcuauuaggauauggcaaaggugcuagaagucaccuccaugguuaagcuguaccuugcaagcaugcaggaguccggcaggagaaucuccuaugcaugcuugcaagguagagccuaaucgugggagugacuuauagcacguuuaccauuuuucuauuggcugaaugcaagucccagguucacugauccuuuauacagagcaugacagugggguccucacuagggucugucugccacucuacauauuugaaacaggaguggcuucucagaauccagugaaccuaaauuuuaguuuuaguugcucacuggacuggguucuaggagacccccuguguuagucuguggucauugcuagagaaucacuuaauuuuuucuagacucuaggagaaaacaguuggugguguacucaucacggguuaacaauuucuucucuccuuccauaggcauggaaggcagcacaccaucaugccuucaaaggucaacuaccaggcgaacaucugggcuuugaaggaagagggcuguacacaugucauagugaccacagcuuguggcuccuugagggaggagauucagcccggcgauauugucauuauugaucaguucauugacagguaagcagucauacaaaaugcuuuaggcuauuguagcuggucauuuucagcucaaauggacgacgcgugggaaccggcagggcaacugggagggcagugccacagacucgcuugcuuuuuuuuuuuuuuuuuuuuuuuuuuuggagacggagccucacucugucucccaggcuggagugcaguggcaugaacucagcucacugaaaccuccgccucccagguucaagcaaugcuucugucuuagccucccgaguagcugggacuacaggcacaugccacaaugcccagcuaauuuuuguauuuuuaguagagauggaguuucgucauauuggucaggcuggucuugaaucaggagaucacccgccuccgccucccaaagcgcaaagugcugggauuacaggcgugagccacugcacccagccuguguuaagcuuuucauugugaguuuuuguuuuuuaauuuuaauugacaaaugauaaauguauauaugagguauaacauuauauuuugauauauguaugcauuguacaaugauuagcaaagcuaauuaacauauuaccccacauaucaucuuuaguggugagaacauuugauuuuuacuuuaacaauuuugaaauacauaauacguugucauuagcuauaaucaccaugcaguauaaucucaaaaacuuauuccuccugucuaacugaaauuuugugcuuugaucaacgucuccccaaaccccagccccugguaaccuuucuacucuuuacuucuaugaguuugacuuaguuagauuccacauauaggugagaucaugcaguauuugucuuuccauggcugguuuauuucacuuaacauaauguccagguucacccauguuguggcaauugacagaguugcguucucuuuuaaggcuaaaugguauucuguuguguauauauaccacauuuucuuuuuuuuuuuuuuaauuguacuuuuaaguucuaggguacaugugcacaacgugcagguuuguuacauauguguacaugugccauguuggugugcugcacccauuaacucgucauuuacauuggguauaucuccugaugcuuucccuccccacucccccaaccccacaagaggcccuggugugugauguuccccuuccuauguccaaguguucucauuguucaguucccaccuaugagucagaacaugcggaguuugguuuuuuguucuugggauacuuugcugagaaugaugguuuccagcuucauccaugucccuacaaaggacaggaacuaaucccuuuuuauggcugcguaguauuccaugguguauaugugccacauuuucuuaauccagucuaucauugauggacauuuggguugguuccaagucuuugcuauugugaauagugccgcaauaaacauacgugugcaugugccuuuauagcagcaugauuuauaauccuuuggguauauacccaguaaugggauggcugggucaaaugguauuucuaguucuagauccaugagaaaucgccacacugucuuccacaaugguugaacuaguucaccuucccaccagcaguguaaaaguguuccuauuucuccacauccucuccagcaccuguuguuuccugacauuuuaaugaucaccauucuaacuggugugagaugguaucucauugugguuuugauuugcauuucucugauggccagugaugaugagcauuuuuucaugugucuuuuggcugcauaaaugucuucuauugagaagugucuguucauaucuuuugcccacauuuugaugggguuguuugauuuuuuucuuguaacuuuguuugaguucuuuguagauucuggauauuagcccuuagucagaugcguagguugcaaaaauuuucucccauucuguagguugccuguucacucugaugguaguuucuuuugcugugcagaagcucuuuaguuuaauuagaucccauuugucaauuuuggcuuuuguugccauugcuuuugguguuuuagucaugaaguccuuccccaugccuauguccugaaugguauugccuagguuuucuucuaggguuuuuaugguuuuaggucuaacauuuaagucuuuaaucuaucuugaauuaauuuuuguauaagguguaaagaaaggauccaguuucagcuuucuacacauggcuagccaguuuucccagcaccauuuaugaaauagggaauccuuuccccauuucuuguuuuugucagguuugucacagaucagaugcuuguagaugugugguauuauuucugagggcucuguucuguuccauuggucuauaucuguuuugguaccaguaccacgcuguuuuggugacuguagccuuguaguguaguuugaagucagguagugagaugccuccagcuuuguucuuuuggcuuaggauugucuuggcaauguucaugguuccauaugaacuuuaaaguaguuuuucccaauucugugaagaaagccauugguagcuugauggggauggcacugaaucuauaaauuaccuauggccauuuucaugauauugauucuaccuauccaugagcauggaauguucuuccauuuguuuguauccucuuuuauuucauugagcagugguuuguaguucuccuugaagagguccuucacaacccuuguaaguuggauuccuagguauuuuauucucuuugaagcaauugugaaugugaguucacucaagauuuggcucucuguuugucuguuauugguguauaagaaugcuugugauuuuugcacauugauuuuguguccugagacuuugcugaaguugcuuuucaucuuaaggagauuuugggcugagacgaugggguuuucuaaauauacagucaugucaucugcaaacaaggacaauuugauuacucuuuuccuaauugaauacccuuuacaucuuucuccugccugauugcccuggccagaacuuccagcacuguguugaauaggaguggugagagagggcaucccugucuugugccaguuuucaaagggaaugcuuccaguuuuugcccauucaguaugauauuggcugugggguugucauaaauagcucuuauuauuuugagcuacgucccaucaauaccuaacuuauugagaguuuuuagcaugaagggcuguugaauuuugucaaaggccuauucugcaucuauugagauaaucauguaguuuuugucuuugguucuguuuauaugcuggauuauguuuauugauuugcguauguugaaccagccuugcaucccagggaugaagcccacuugaugaugguggauaagcuuuuugaugugcugcuggauucaguuugccaguauuuuauugaggauuuuugcaucgauguucaucagggauauuggucuaaaauugucuuuuuugguugugucucugccaggcuuugguaucaggaugaugcuggccucauaaaaugaguuagggaggauucccucuuuuuuuauugauuggaauaguuucagaaggaaugguaccagcuccuccuuguaccucugguagaauucggcugugaauccaucugguccuggacuuuuuuugguugguaggcuauuaauuauugccucaacuucagagccuguuuguuauuggucuauucagggauucaauuucuuccugguuuagucuugggaggguguguguguccaggaauuuauccauuucuucuagauuuucuaguuuauuugcauagaaguguuuauaguaugcucugaugguaguuuguauuucugugggaucgguggugauauccccuuuaucauuuuuuauugcaucuauuugauucuucucucuuuucuucuuuauuagucuugcuaguggucuaucaauuuuguugauccuuucagaaaaccaacuccuggauucauugauuuuuugauggguuuuuugugucucuaucuccuucaguucuucucugaucuuaguuauuucuugucuucugcuagcuuuugaauguguuugcucuugcuucucuaguucuuuucauugugauguuagggugucaauuuuagaucucucuugcuuucucuugugggcauuuagugcuauaaauuucccucuacacacugcuuuaaaugugucccagagauucugguauguuguguauuuguucucauugguuucaaagaacaucuuuauuucugccuucguuuuguuauguacccaguagucauucaggagcagguucuucaauuuccauguaguugagcaguuuugggugaguuucuuaauccugaguucuaguuugauugcacuguggucugagagauaguuuguuauaauuucuguucuuuuacauuugcugaggagugcuuuacuuccaacuauguggucaauuuuggaauaagugugauguggugccgagaagaauguauauucuguugauuugggguggagaguucuguagaugucuguuagguccgcuuggugcagagcugaauucaauuccuggauauccuuguuaacuuucugucucguugaucugucuaauguugacagugggguguuaaagucucccauuauuauugugugggagucuaagucucuuuguagaucucuaaggacuugcuuuaugaaucugggcuccuguauugggugcauauagauuuaggauaguuggcucuucuuguugaauugaucccuuuaccauuauguaauggccuucuuugucucuuuugaucuuuguugguuuaaagucuguuuuaucagagacuaggauugcaacgacugccuuuuuuuguuuuccauuugcuugguagaucuuccuccaucccuuuauuuugagccuaugugugucucugcacgugaguugggucuccugaauacagcacacugaugggucuugacucuuuauccaauuugccagucugugucuuuuaauuggagcauuuagcccauuuacauuuaagguuaauauuguuaugugugaauuugauccugucacuaugauguuagcugguuauuuuggucguuaguugaugcaguuucuuccuagcaucgauggucuuuauauuuuggcauguuuuugcaguggcugguaccaguuguuccuuuccuccaggagcucuuuuagggcaggcaugguggugacaaaauccucagcauuugcuugucuguaaaggauuuuauuucuccuucucuuaugaagcuuaguuuggcuggauaugaaauucuggguugaaaauucuuuucuuuaagaauguugaauauuggcccccacucucuucuggcuuguagaguuucugccgagagaucugcuuuuagucugaugggcuucccuuguggguaacccgaccuuucucucuggcuguccuuaacauuuuuuccuucauuucaacuuuggugaaucugacaauuaugugucuuggaguugcucuucucgaggaguaucuuuguggcguucucuguauuuccugaguuugaauguuggccugccuugcuagauuggggaaguucuccuggauaauauccugcagacuguuuuccaacuugguuccauucucucugucacuuuccgguacaccaaucagauguagauuuggucuuuucacauagucccauauuucuuggaggcuucguucauuucuuuuuacucuuuuuucucuaaacuucucgcuucauuucauucaucugaucuucaaucacugauacccuuucuuccaguugauggaaucggcuacugaggcuugugcauucgucacguaguucucguacuaugguuuucagcuccaucaggucauuuaaggacuucucuacacugguuauucuaguuagccauucgucuaaucuuuuuucaagguuuuuagcuucuuugcauuggguucgaauuuccuucuuuagcucagagaaguuugauugucugaagccuucucucaacucgucagucauucuccauccagcuuuguuccauugcuggcgaggagcuguguuccuuuggagggggagaggugcucugauuuuuagaauuuucagcuuuucugcccuauuuuuuccccaucuuugugguuuuaucuaccuuuggucuuugaugauggugacauacagaugugguuuugguguggauguccuuucuguuuguuaguuuuccuucuaacagucaggacccucagcugcaggucuguuggaguuugcuggagguccacuccagacccuguuugccuggauaucagcaguggaggcugcagaacggcgaauguugcugaacagcaaauguuccugccugauuguuccucuggaagcuucgucucagagggguacccagccgugugaggugucagucugcccuacuggggggugccucacaguuagccuacucgggguucagggacccaccugaggaggcagucuguccauucucagaucucaaacucugugcugggagaaccacuacucucuucaaagcugucagacagggacauuuaagucugcagagguuucugcugccuuuuguuuggcuaugcccugcccccagaguuggagucuacagaggcaggcaggccuccuugagcuguggugggcuccacccaguuagagcuucccagccacuuuguuuaccuacucaagccucagcaguggugggcgcccaucccccagccuugccgccgccuugcaguuugaucucaggcugcugugcuagcaauaagcgaggcucugugggcgugggacccuccgagcuaugcacgggauauaaucuccuggugugccguuugcuaagacaguuggaaaagcacaguauuaggguggcagugacccgauuuuccaggugccgucugucaccccuucccuuugcuaggaaagggaauuccuugaccccuuacgcuuccuaggugaggcgaugccucacccugcuuuggcucacacucgaugggcugcacccgcucuccggcacccacuguccgacaagccccagugagaugaacccgguaccuaaguuggaaauacagaaaucaccugucuucugcauugcucaugcugggagcuguagacuggagcuguuccuauuaggccaucuuggaaccgccucucccacauuuucuuuaucuguucaucuguugauggacguuuauguugcuuccauaucuuggcuauugugaauaaugcugcagggaccauggaagugcugaugucuuucuugacguaaaauuucauuuccuuauacacucugagaugggauucuuggaucaugugguaguugauauuuucaguuuuuuggggaauuuuaguaauggcuguauuaauuuauauuccuaccagcaguauacaaggguucuguuuuugucacauccucaucaacacuuacuuuguuuugucauuuugauaauggccauuguggccuggcacagugguucacgccuguaauccuagcacuuugagagguugaagcaagaggauugcuugagcccagaaguuugagaccagcuugggcaacauagugagaccuugucucuguaaaaaauaaaacaaaaauuagccauguguguugauauacagccauugucccagauacuuaagagacugaggugggagaaucgcuugagccugggaggucaaggcuagaaugauucaugaaugcaccacuacacuccagccugggugacagcaaaaaagccauucaggugugaggugauaucuuauugugguuuuuauuugcauuuucuugaugauuagugauguugagcauuuuucauacagcuguuguccauuuaugugucuucuuuugaggaaugucuauucaaguccuuugccuauuuuuuuaaucagguuguguuuuuagaacuuucuuucauuuaguuuccuuacguauuuuggguauuaaccccuuauccgagguaugguuuguaaacauuuuuuuccuaucuauaggcugucucuuuauauuaugggaauuuuuaaacauauacacaaaagaauaauaaucagggacucucuaaguuccuaauuccuagcuucaagagaacauuuucuuuuuuuuuuuuuuuaaagagaguauaaauuaguauuuccuuaguauuagauaucuaggaaguucucucuauugucucaugaacuuuuuuuuuaauaguugguuuguucaaauaaggguccacucauuacacacauaagcuuaauaagccuucuagucuggaagauuccaccuucuuuuuuccuuuuccuuuuacugccuauccacauucuggauguuacuaauuguaucaagugucauuuagugucuucucccggccccuguguuugcuauaaacuggauuuaguucugguggccugaucagaaccagguuugaauucuuggcaaggauccuuccuucugcauccugucggaaggcaugugauguccaguugucccuucauaaugcgaucgaucaggugccagaggugcugggguuuuguuuauuauuauuauuauuauuauuauuauuauuauuauuauuuaacugcacaaguaauauauauuguuccuuuacccccccaaaaaaacaacaauaauagacugccaaauuuuuggaccuuuucugcauuuagagguaguugaaaucacaagggaaagugguggucucuaggucagggaucccccaccccuguggcuuguuaggaaccgggcugcacagaagaaggugagccguggggcgagagcgagcauuaccaccugagcuccccauccugucagaucagcagcagcauuagagucucauaggagcaggaacccaauugugaacugcacguggaagggaucuguguugugcacuccuuaugaaaaucuaacuaaugccugaugaucugagguggaagaguuucauccugaaaccauccccucugacccucucuguggaaaaauuaucuuccaugaaaucaguccccggugccaaaaagauuaggggcagcuguacuagggccacccccuccccuauuccugguagaaauaauugccucucagaaugcucugggugaagacaggagccuccugggcuggauggagaguggagaguagcgcagaguuaaaucauuuggggauccuuccacaaucccccauccaaucacccugccuaccaccucaguccaugcugcuccucccaucaguuaucucugagcuuacuguacucacagccugcuccuagagcuucugcuaugggagagaggguuguccaguccaggccacuguggcuucugccuuucagggauucauuauaauuuccagucuaucagaagcauucuugguuguuuccugauggaaugaaacuguuuugaaauugcccauucuguaggucagaaaugguugaauaucagcaguuucaugugguucaaccuaauaaauaaugggguuagacuaaaaugguuacauauuucucaccccaaguuauguccuuauaauguauuuauaccugacauuauauauuugugaccuguuucccucuaagccaugugagaucaaagucacuuucugcccaguuugcaccauaucaccaacacccacaacaguuccuggcccaucuuugcucugucaguaauuuuugagggcuugaacauagucauuugaauagagagauaggcuggaguuuguguuuuggagacaucuugaucaaaaucucaauggcugucaacguccauguguuuggagguaauaguuuaagaaaaugauuauaauaugauugcuaaauagaguggaauacaaaacuccauauucaggaugauccagauguauaaaguauuacagaugauacuguaaagucugaauugggcacugagccuuggguuaaucuguuacuuaaacaguaugacuauacgcuguugcauuucccagaucuuuuacucacaugucuuaaauguagauguuucacauacuggcucuuucaagaaagcaguugggucagaagauggagacuagaaagaaaacagguauugccaucagaucugguuucauucuaucuuagccagguaaccuuaagaucuucuacuauuuuucuguuuaugagacauauggauaaccugcccucuuaauguuuccuuggaaguucaaagucucuaauaagugccuuuugugggaucuugcauguguuaaccuucucaguaacugagugccauuauugagagugugugcauacuggcuggaggguccacuaguugacacuacuuuacaacaacaggaggaaagaaucuguuaaaagaaggaucccuggcagggugcaguggcucacgccuguaaucccaacauuuugggaggcugaggcaggcagaucaccugaggucaggaguucgagaccagccuggucaacauggugaaaccccgucuuuacuaaaaauacaaaaaaaaaguagccagguguggugagcaccuguaaucccagcuacucggaaggcugaggcaggagaauugcuugaacccaggaggcagagguuacagugaaccgagauugcuccauugcacuccagccuaggcaacaagagugaaacuccaucucaaaaaaaaagaaggaucccuaagagaauauaauuuagcaugaaaucucaauuuuuacauugauuacuuauuuggggugauaacguuuugaauauauuagguuagacaagauuuuaaaguuaauuuuaccuguuucucuuuuacuuuuucagugaccacuagaaauuuuaaaacuauguagguggcuaacaucauauugcuguuggaugcaucuuuuaagugcugcugccuuugauugagcugaguggguuccaguuaaccaggcuugagcacauauaucauucauuauguguuugaacaucucauagcagaagaugccuugcauauauaucauucauuauguguuugaacaucucauagcagaagaugccuugugguuaaugcccucuauguguuuuacugauagcacauuucuuaguaaagugaaucuugguguauugagacgggcaucuccuaccuccacuugcugauggcaucagauacaaauaggcugugccauuuuuagccugggguuucccagagucauacccacagccccaacuuguuuaacaggauuguaacauccuguaaagccaccccguggauuauagaauuccagggcagcuggggcaggagcauugaaucaggagguuucaucuugacucuguuuggcccugugcaaaucacuuuacccacuacacguugguucuuucuucccaauggagggcugaauugcaccaucucucucucucauucuuuuguuguuuuuuuuuuuuguuuguuuguuuuuuugagacagucccacucuguugcccaggcuagacugcaguaaugcaaucucggcucacugcaagugugagccacugugccuggccaggcuccuuuucccuacacugcccguguauucucuccagggacuuaccuagaaccacacacauuggccuauugccguaaguuugucagcacguugucucagaaaaaaaaaaaaauccucauccuaaaguguucuucaaaggcuagcgagauuguuuaauaauacggcuauucuuauuuuauagauggccaagcuaaagcacaucauuuucuuuuccuucagugccagcaugagcagggcggggggaccaaccucagauuuaagaaagacauguggcugauuuuuaggguuguuuuuagaaacauuagauuucuucucuaauaaugaaauauacuuuugaaggacucugacaaugcuggaagcucuuuuaagaaaaaugucauucuuaucugaaaaucuuuuuuuuucuucucucucucaugcuacauuacagcugaugaaguuaaaaagccugggcauaagaaaaggggagcccugggugugacugcccuggaaaaagagguagagagugcaguggguucaaguauguuuggguaugugcagucagucuuugugucuuucucauucaaguaaauuccauagcaauuaaagugaaaauaaucaucuuucauuugugaguagagcauccauagaaagcaacauauaucuuggucuagaacuuaaauuccaaaagaauguguuauauuuuucauuuucccguuuuuguugcacagggacgaguuuccugaugcuuccuugccauaggcccugggcucuguguguaguguucuucccaaaccaaaaauuaaaaauaggaaaaucagaaucuauaccaagaacuuugucuaggaggcuugucugcaguagguuucuucagugccuaugccuccugcuggauuguguuugauuaauccauuucuuuuaacuuguacaagguccccauuguuagagccacaagucauuuggccacugaggguaaaagaugguuaggagugggauuuguuccacuucuuugcagcgauuaaacagucaguuugaacuggggaaaguauuugaccuuuagucuguccuaaaagaaugucaucaggcuguuuauacauuaaaaggcucucauaagauauguacucccagauucauaauuuuggaacuucucuccuaugguacacacccuuguauguaugcacaccuggcucucacugagucacuuaugggaaacugaagcaaguuuuucuauuaauaggggaaaaaagaccucauaaaagagucaaaguaaaugagacuuagagaaauguagaagcaugacuaugcaucacugggccuuugcuuaguuuuuauucaucagccauggagaagaaaggcaugacucuuuccugccucccacacccaccggacuuguaaagcucgacuucgaugaugcauuauaaaguggugcacaggauugguuuuuaaugagauuuuugccauuggagcaaagcaagacuguuucccugccagcugcuuuauucaagucaugaggcauuuuguugucuccuccuguacuugugguacaugggcccuccauuuucuagcccaguucuuguuagauaccuuugcacauucauuuguauguauggcagaacugaugauauggccuuucuuucacccccaacuacuaacuguccaugccauuaaagauacauggacaggggauuccagcaauuucuacaguugcucuucuuucucuuuaccauuaauccugaugauuguaggaaaucaguacaccauauuuauuaugcaaaucuaagaaaaacaacuagaucuauaaacuauuugaaaagaugcccacauuguauuuuuuuguuguuuuuuuagauaggaucuuucucuguugcccgggguagagugcaguggccugaucgcagcucacuguagccucuaccuccugggcuuaagcaauccucagcccgucuaguagcuaggauuacaggaaucugccacugugcuugguaauuuuuuuuuuuuaaggagauggggucucacuauguugcccaggcugguuucaaacuccuggccucaagcagucuuccugcuuuggccuccccaaagugcugggauuauaggcaugagccacugcacccagcuacauauuuuuuagaaaaggaucagaugaguaggacuugcucaacugcuaucacugucagaaauaucucaaggugaaacuugcaaacauaucaguaaggagaaggaugagauuucuuuuuuaauagucuucuuuaucaggaauguuuugcagauauugauuuuuuuuuuuuuuacaaugagaaaaauaugaccaaaaacugaauauuaaaggaagcagagugugauucccggugcuaaacaguuucuauaaaauguggcuaauaacauauuggccuguugugccuaaggccuguguuuggguuaugccuucucaaagaaugcaguggaagaaucucagcuuagaagugaggacauccagaauucuuuccuggcugugccgugaaauuccuuugucacuuaguguccucaucugcuaaaugaggguguugaauugauuccuaaaaguucugguauccuccccucuucagauuauuucuucaacuuauuuucuugguagaacugggagagguucgacuuugcuuuugucacgcauucuuacucaucaggaaagucccgcuauaaacacagugcugagggaucaguuaugucagucuguuuccuucucccagagaccagcccugccuugggcuuccccuagaacuuuaugucauagcauaaaggcccgugucugggcccugagguugggaguaugcucugaugucaaguauuugaucauucucuuucugccucuugaugacuagaaagcguuuuaugguaaagaguuacgcaagaagccuuuguuuagcucuuucucucauugcuaaaaauaguaagcuguuuuuaacccuuacuguucuuacuucuucuuacucauuucccucacucuuuagcugagaaugucaccuccaccuuuauagagaagacagaaacuuaagcauaaacucuucaccuuccuucaccuucccuuuccccaguuacuugcgucccuguucuuugucauccucuugucuguagcuguccuugaagugguguccacuauuccccuggaugagguucauucuuacguucuguuccauaaccuaguuguguuauuaacuucccaucauacauccuuuuauuaaaaauccuacacuaccaguuuuugaguuccuauuaggugucacaaucaguuaaucccacuuacggcauacagcagucauuauuccaguuuauacuugaagaaacuuaggcccuuacuauguuucuggcacugcuuauuaucacagcucuagaagacaucuucuaucuaccuuauccuucccuuuuacaaaaggugagaaaacugaggcccaaagagguuguugucaccaccuauguagagugaggauuuuuauuuuugugcuauuguuuagcaugaucucaugaaauauaauagaaaauaaggggaaacuaugguaccuguuuauugagcagccuuccuugacugggauauaaacauccauugguuuuccuccuuuuucaugccaccacaagcacucaggggcacucuugauaccagaacagugggaggaucuuagugauauugguccaaauucauaaguuuucacuucucuuuuuuuugagacaagaucucacucucgcccaagcuggaguacaguggcgccacagcucacugcagccuuuaccucccaggcucaggugaucuugccaccucagccccccaaguagcugggacuacaagggugugacaccauacccagcuaauuuuuuguauguuuuuguagagacaggguuucacuauguugccugggcugaucuugaacaucuaaacucaaggguuccacccaccuuggccuccuaaagugcugggauuacaugugugagccucacuuccuucugguuauagagacagaauuguuccacuucuuagucugauguuucugucagaauuuuuucucaugacugccuauucacgcugcuguuugauucuugggauauauuuuaaaugauggguagauucacuuccccuaaaccguccuccuuaugagcagccguuauucugcucugccaguaaauuaauugacucacgauucugcauguuggggcuuguuguggauacagaccguauucugaaauguccucagaggucgaugauuguguuugcuucugccaggggauggguguuugcccucagcuuguuugcaacaccacauuuccucaaaggaaacguauuaacuaacagcuaucuucaagccaauguaagagucuugauucaagaaacaaccuaccagucagucuauuucuaggcuuuucucccucucuuugaaagugccaguguucuuccuuucacucucuugaacucauuuuuccugccagcacacaucauuuugucuccuuuacuuuuccauaggcuguuuuuuuuuauuugucuacuagcuuuucuuaucacauaucccugcuugacaaccuuaagcaauuuguuggauacccuugauuugaggcccaucaauaugucauacuuugggauuggcagaagaaauguuuagaagcauauuuuccauaaaugauagugacaagugccaagcacuugcuucauguugucucauucaguuuucacggggacuuuauaagguaagugggauuacucccguuuaaggaaacugauauaacugaggugcagagagacgagagugacuuucccagaggcacacagcuagugagugguaaagccaguagauaagccagucccugaaauccguguuuuccaguaggaucccaagcuauggggagauaaaaauuaguccccuugccuagcuagagggcuuuaaagguuaaagcaagaggaagaagcagaccuuaucuuuuaguucuguaaguuuggaguguaucgugggucucacugaaacuagaaaaauugucagcacggcugcauuccuuucuggaggcuuaggguagaaucccuuucccugccuuugccacucaccuuggcauauggcccucauccaucuucagagccagcaauggcaauggaguccucaccucucaucaugcugacauugacucuucugccuccgucuuccacaugugaggacucaugugaagacaugccgcacaccuaguuaauccagaauaaccuuucuauuuuaaagucagcuuguuagcaaccuuaauuccauuugcucucuuaguuccccuuugccaucuaaaguaauauauucauagguucuaaggguuagcauguggacaucuucggaggggccauuauuugaaaucuaaaauggagauguuauugcaucgcagucuauugggagguagccacuggagguuuuugcagccuuguuuuuauauuuaagcaaggguguauaugugugucuuagucuguucagguugauacaacggaauaccauagacuggguagcuucuaagcaacagaaauuucucacaguccuggaggcugggaaguccaaaaaaaguugccagcagauuuggugucuggugagaaccuacuuucucacagauagcaccuucuuauuguguccuuacauggugguagaagggcgaccuagcucucugggaucucuuuuauaaggggucugaucccaaucaugagagaucugccuaaucaccuccaaaaggcuccaucuccuaauaccaucacaucuugugaguuuggauuucagcauaggaauuuugggaggacacaaaacuucagaccauagcaguagggauguugcuaauaccucacgaagaaagaacuuaaagaagcugaguaauuugcccaagaccacacaaaaauucauucgaauccagggacaaaacuauauuuccuguguuuucuccaugucacucagaaaauucagcaugagggagaaauaugauucuuaauauagaaucauauuucuauauugaaauaugauuucaauauagcuguuuuggcuagaacuuggaagugaacaggcaggcuuaauugggcaacaguccccacuuuguggggugugaucggcaggcuuauuccaggcuucuugcugaguuauaaaacuucugauuuaucugauagagaccuucagaaggaggacuggugcuauuaaaauuauacacauuucauucuggaauuucuuuugagggcaucauccacuccccucagcugugauuguaaaccucauugcucuuggucagaauuucauucagcauuaacaaugacacauccuguuaugcugugcagguguauugcuguuuauaggaauuuaaguuuagaucauuaaauguuucaauacugaauguauugacaguuaaguugaugacgcagaaaacuacaaauagcugggcaaacuauaagagguguuucucgucugcaccuucccuucugguaucuugauaguauagcccaaaaaugguuuuaagcccuugcuucucccccagggcuacccucuuugcuugcaccuuacaagguugaguguugugaggccccaucuggugccgacuccaauucugucucuagcccagacccacacuugugagcugcuaugaguuaucugggcaucuugguugacuuaaucuuccuaacauccuuguaaauagguggaugaauacuauguuuuaugauuggaaaaugaagaaucaaaaagauauggcaauuugguuuaaguccacauagcuaguaguuagggagcuuuguugagaaagaaaaaugcaugagaggaaauuaagacuguaguuaauaauuaucaggugcauauuaacguugcaugaagcuuaacuuaaauacauguuauucuuaagguuaaaaaguucaaaacaaaggcggggguuccaaggcaaauggguggggauagacaggagaugggcagagguagaugaaaugcggguguuaugguguggaagucaguuggaguauagccacuggaggcuuuuguggcccuguucauaucauaguuauaagugggauguugcuaaugcuugacucaucaaaggcugaaacaaagccagagcugaaguugaguacgugucaccguuuuauugguuaaucuuucaaaaagagaaaagccucuguuuauacaggcugaaacagucauuugaccuguucuucaacuccaucuggaauugcuuugggguuaacuuagcauuuccccuaaagcgcauaugacaguggguugggaggagcucggaugggguuuuuguuccuccagagcgcugaggccuuauuucugagugagguggccuuggugccagcuaaugccacuguuuagugugugaugaacuagaaguaacagguuaauuuuggccaguagacuugccagcuguguaaacggaaccagugaaacuauuucucagugcugccucccaccccuggaagaggacaucauguuaucuaccugccccuguuggcuucccuugacccaucucucccaugcuguccccuccucccuguguuacucaucaguucaaauuuagaauaauugaaugcacagagaaaguggcuuguucugaaaacuucugacaagaaauuuccaggugacuuggugcuagauuaauuuuagccucucuuauggauucaaaacuguuuugucagaagacuugaacuaagacacuuuagaauuaauuacggcugggaaaaagaacaaucuaaaugaggcagcgaacaaagauuccuaaauauggagcaagacaaguggcucuuuauuucagugggucacuggcaugaaaaaauauaguugggguuacaggcaggaauuacucuuagagacaugggaauuaaaugcaagguaaguaccuuguuuggacccugaaacuaacaaagcaacuguuuaaaaacaaauuuuuuuaagacauuggggaaauuugcaucugcucugagucaaagccugggauuuguguuugugaaaaagcuaauagaggaagcaaguuggacacaauuuaagaaauuguugaaucugggugauguguauaugguguuaaguauaugauuuuccacgucugugaugaugaaacauuuuuguauugacuucuuaagugucuuaccuggccuuucugagcccacaguugaguugcaccugcaauccaaagugguuaccccgucacggcugccagaccacagacacuuuaauucuuguugugcgguguguugcugccagcccagagccaaaaaagcggaauaccacccugaagcuuuuguaaacaauugucuuuagcuuauccagaggaauugagucuggaguaaagacccaaauauugaccuagauaaaguugacucaccagcccucggaggauggaaagauggccuuaaaauaaaacaaacaaaaaccuuuuuugcuuuauuuuguaggaccacuaugagaccucaguccuucuaugauggaagucauucuugugccagaggagugugccauauuccaauggcugagccguuuugccccaaaacgagagagguguguagucuuucuggaagguguaccagaauaaaucaugugggcuugggguggcaucuggcauuugguuaauuggcagagcgaguggccccauacccucacucaaguuugcuuuguauuaugcaaaguuuuaugaagaguuauuuccuguugcuaauaauuuccuguuccucuguuacucucagucauuuuaagcugaaccacucaaaguugcaaccuaccuuuuuaauaaguuuugauuuugcuaucuagauaaaaugauuuaacauagaauaucacauuacucaagaguaugcagucuggagccagauuacuuaggaucaaaucucugcucuucaacaaaguagcuguguccaagaggacaaauuauuugacauauguggguuucaguuaucuuacuucuaaaaugaagauaauuauagcauguaccuuauaagacugugugagggaugagagaguuaauacuuaaugaagucucugaaccaugccugucaguuauggaacauccaauggcugguaacugcuuuugugaauuaaauuacuauuauugaucuucuaaaaauggucagauuggcagcuguugccuuugaccugaguuuggccauuacugcccagccuucugucuaccauuauagccaaaucacagaacuauggggacagccccacaagggccaguggugguauaagggguggaaucacaguuuuaguucccaagcaacaaaaauggcuaccaugacuaagaagccuauggcuugguccacaugugcuacuucucuuauaaucccagguuugaaagucaggugcaacucaaaagaucagaaguaucguuagagauuaacugcuucauaaaaucucccuuaugaguuaacuuagagaauauaaauaccuaaacacguuaguuauucagauaauguuaacaccugcauauagagaguagaugauuucuuuuagcauuuauguuuuauccuacauaaucacagaaaacccauuuccuuauaguuaacagcaagggcaccuaaacugaggacacaggguugggagaaauauuucuagucucaaacaagaauuuggaaucuaaaaccgaguacugagggaagccauuucggagauaccacugcgcauugauuuucucugacuucuaggaaaguacgucuuuuacuugguuuuuuuuuuuuuuuaaaaaaguggcaggcgaaguuuguauauguauguauagcauguuucuggauaguuauccacagaauguaucagaaugcugcuagucuuccucugaagcacagaucuguccacauaauagauuugcuauccugggggaaaugaaguauggauaaaauucuuguccacuucaaaaugggggcagcuugggaagaaauagucuaaggagagaauaugcaugcucguaugaaucugaggucaguucucaggcaaaauacagugacuuggggaacuaggaguagagguagauggggaaagcacaauggagcuguauagagcacauguaaaugugggucuguggugauaauuuccaguaauccaaguuagccucccuugaagccaaauuaauucagcuucauaaagacugagagaauacugggaaaggcaauuuaagaaaauggcaaaauaagcauucagaaagaaauuuuuaaauauuauccaaaaacaugaagaguaaauagugcugccacuugguaauuuucacuuuuaacauccacaugaucuuucauguacugauggaauaggacugucaugaugaauugucaaguggcaagcaagauacucagugguuguaccauauucuaccauuuauguuaaaguauguauauauacaaagaaguaaguauguaaauauuuauauacaaauaaaauauuuuuggaaaguuaacaaaaaaagcugguaacaggaaacagggaagauggcagauaagagacagggcuggccaccacgguggcucacgccuguaaucccagcacuuuggaaggccaaggcaggcggaucaugaggucaggagaucaagaacauucuggcuaacauggugaaacccugucucuacuaaaaauacgaaaaguuagccaggcaugguggcaggcaccuauagucccagcuacuugggaggcugaggcaggagaaucgcuugaaccugggaggcagagcuugcagugagccaagauugugccacugcacuccagccugggugacagagacuccaugucaaaaaaaaaaaaaaguaaagaaaagacagggcuaacgugcagcuuccacaaggacggacagaauagcauauggagacacuaugaucuuuuguuccaagaaccacuguaggaacuuaccgggaaaaccaaaagaauucaaagauccuuugaaagaaguggcacaccacugcaaauucugcaaaacaggcaagaaacugaguucccaaagugugagucggggagaaccuaccucugaauacacauccccacuggggaaaucuaaaaauccagaucauggaggaagaauuuaaccuuaccuagaggugaaacggauuuaggggguuaugugaaauaugaaaguagaaguagcaacaggaagugcuuuggauguacucccagucuccagcuugaguccagggaagccagcccugacuauaucucacaguggcccucagguaaggcagccaguggaauuggagagugauggcagggcgaaggaagcucccaaaugaaaucaguagugguuucagcuggucacaaauuuucucaggcagaguccaagggacuaaugggagccgcagcagauacaagugaguacaggagcugcugcugauggagugggcaggugggaaggggugagguccaaaggccaugcuugcuuucccagugggguagcucacagccuggggcaaggucugagcagggcacugcaggagugagacuagccucaccaacugcauaguagcuggaugaggccucuugcugcuggcucucccccacuacccugguaaaguuuaugauacagcagaggcagucaagaucuccucuggaacauaaacccaguggccugacaaaccacccccaucccccaauuucccacagugucugcagcaagcccugcccaagaagagucugagcccagaaccaccuaacccugccccaaccugaugguauuucccuacccacccugguagccaaacacaaaauauuuauugcccugccuauugccugggaaaccaaaauaguuaccuugggcaucuuagggcaagcuuagagcccccuacuccuucugcagcuggugcucucuugaaagugccaccuccuggcuggaggccagucaacugaggccauuacagcaacucauaaaacaauaacccugaucccaggacggaaaagacaacaccuaauuucacugccugcaacauccuggcuaaccagagauccugaauauguccacaugacaacuucacugcuagcauaagcagcauucaagagagccagcacauuaaacauaucuacaaccaaugacucuugcagaguuuacuucacuucccugccacaucuaccagagcaggugcuaguagccacagcuuggagaccugaagauggaucacaucgcaguacucauugcagacaucccccagcaacagcccagagccugguggccucaauggguggcuagacccagaagagcaauaacagucacugcaguccagcucucaggaagccccaucccuaggggaaaggggagagcaccacaucaagggaucaccccaugagacaagaaaaucugaacagcaggccuugaguuucaaccucuccacuaaaauagucuaccaaaaugacaaggaaccagaaaagcaauucugguaauaugacaaaaugggguucuguaacacccccaaaagaucacaccagcucccuagcaauggauccaaaccaagaggaaaucucugaauugccagauaaggaauucagaagauugguuauuaagcuacucaaggaaauagcagagaaagguaaaaaccagcauaaagaaauuuuaaaaaacaauacaggauauggaugaaaacuucugcagagaaauaucauaaagaaaaaauaaaucacagcuucaggaaaugaaagacacacuuagagaaauacaaaauguaguggaaagcuucaacaauaggcuagaacaaguagaagaaagaacuucagagcuugaagacaaggcucuugaauuaacugaaucaagacaaagaaaaagaauuuuaaaaugaaauuuuaaaagaaauuuggguuuauguuaaauggccaaaccuaagaauaauugguguuccugcagaagaagagaaaucugaaaguuuggaaaacuuauuugaggaaaacuuugcuggccuugcuacagaucuagacauccaaauacaagaagcucaaagaacaccugggaaauuuauugcaaaaagaugaucagcuaggcacauauuuaucaggcuaucuaaagucaagaugaaagaaucuuaagaacugugagacaaaaacaucagauaaccuauaaaggaaaaccuaucagauuaauagcagacuucucagcagaaaucuuacaagccagaagccagaagggauuggagucccauuuuuaaccucuugaaacaaaauuauucucagccaagaauuuuguauccaguaaaacuaagcuucauaauugaaggagagauagucuuuuucagacaaacaaaugcugagagaauuugccacuauugagccaacacuacaagaaaugcuuaaaggaguucuaaaucuugaaacaaaaccucaaaauacaccaaaauagaaccucauuaaagcguaaaucucacaagaccuauaaaacaauaauacaauggugaaagaacaacgucuuuaggcaaaagcuagcaugaugaauagaacaguaccucacaucccaauacugaugucgaauguaaaugaccuaaaugccccacuuaagaaaagauacgcaauggcagaauggauaaaaaucuaccaacuaaguaucugcagucuucaggagaaucaccuagcacacaugaacucacaaaaacuuaagguaaaaggguggaaaaagauauuccaugcaaauggaaaccaaaagcaauuaggaggagcuaguuuuauaucagaaaagaacagacuuuaaaacaacaacaguuaaagcaaagagggacauuauauaaugauaaaaggaguaguccaacaggaaaguaucacauuucuaaauauauaugcacuuaacacuugagcucccaaauauaucaaacaauuacuaauaggccuaagaaaugacauagaugguaacacaauaauaguggggcacuuaaguacuccacugacggcacuagacagguccucaagacagaaagucaacaaggaaacaauggacuuaaacuauaaccuagaacaaauggacuuaacaaauauauauacccaacaacugcagaauauacauucuuuucaucagcacauggaacauucuccaaaauagaacauaugccacaaaacaagucucaacaaauuugaaaaucaaaauuauaucaaguacucucucagaucaaaguggaauaaaauuggaaauuaacuccaagaagaauccucaaaacuauacaaauacuuggaaaugaaauaaucugcuccugaaugaucuuuaggucaacaguaaagucaagauggaaauuaaaauauucuuugagcugaaugauuauagugacacaacuuaucaaaaccucugggauacagaaaaaguggugcuaaugggaaaguucauagcauuaaauuccuacaucaaaaagucugaaggaggacaaaucaacaaucuaaggucacacuucaaggaacuagaaaaacaagaacaaagcaaacccaaaccuagcagaagaaaagaaacagcagagaucagagcagaacuaaaugaaauugaaacaaaaaaauacaaaagauaaaugaaacaaaaauauuugaaaauuuaaaauugauagaccauuagugaaauuaaccaagaagagaaaagauccaaauaagcucaaugagaaaugaaacaggagauauuacaaccaauaccacagaauacaaaagacuauucaaggcuacuaugaacaccuuuaugcacacaaacuagaaaaucuagaggagaugaguaaauucuuggaaauauaccacccuccccaauuaaaucaggaagaaauggaaacccuaaacagaccaauaacaaguaggaagauugaaacaguaauuuuaaaaaauugccaacaaagaaaacauccaagaccagagggauucacagcugaauucuaucagacauucaaagaacugguaccaaucuuacugaaacuauuccaaaagacagagaaagcaggaauccuuccuaauucauucugugaagccaguaucccccuaauuacaaaaucagaaaagaacauaauaaaaaaagacaacuacagaccaauaucccugauguacguagaugcaaaaauccucaacaaauuacuagcuaaccaaauccaacagcauaugaaaaagauaauacaccauggucaaguggguuucauaccagugaugaagggaugguuuaacauaggcaagucaauaaaugugauacaucacauaaacauaauuuaaaacaaaaaucacauggucaucucaauagaugcagaaaaagcauuugacacaauccuccaucuaguuauaauuaaaacccucagcaaaauuggcauagaagggacguaccucaagguaauaaaagccaucuaugggcugggcacgguggcucacaccuguaaucccagcacuuugggaggccaaggcgggcggaucacaaggucagaucgagaccauccuggcuaacacggugaaaccccaucucuacuaaaaauacaaaaaaauuagccgggcaugguagcgggcgccuguagucccagcuacucgggaggccgaggcagugaauggcgugaacccgggagguggagcuugcagugagcugagaucacgccacugcacuccagccugggcaacagagcgagacuccgucucaaaaaaaaaaaaaaagccaucuaugacaaacccacagccaguguuauauugaacagggaaaaguugaaagcauucccucugagaacugaaacaagacaagauucccacuuucaccacuucuguucaacauaauacaggauguccuagccagagcaaucagacaagagaaagaaauaaaggguaaaaaaucaguaaagaggaagucaaacuguugcuguucaccaaugauaugaucguauaccuagaaaacccuaaagacucauccaaaaagcuccuagauaaaugaauucagcaaaguuucaagaugcaaaaucaauauacucaaaucaauagcacuuuuauagaccaacagcaaccaagcugagaaucaaaucaagaacucaaccugcuuuacaacaguugcaggaaaaaaaaaguaaaaugccuaaccaaggacaugaaagaucucuacaaggagaacuacagaacacugcugaaagaaauuauagauaauacaaaaaaauggaaacauaccaugcucagggaugggcagaauuaauauuguuaagaauucuuacaaaagcaaucugccaaaaagcaauccacaaauucaaugcaguuuccuucagaguaccaccaucauucuucacagaaauauaaaaguaucauauuucugccaaaagcaauccacaaauucaaugcaguuuccuucagaauaccaccaucauuguucacagaaauauaaaaaaaaaaauccuaaaauuuaugugagaccaaaaaaagagcccauauagccaaagcaagacuaagcaaaaagaacaaucuggagguaucacauuaccugacaucaaacuauacuacaaggcuauaguuaucaaaacagcaugguacugguauaaaaguaggcaugcagaccaguggaacagaauagaguauccagaaauaaagccaaauauuuacagccaacugaucuuugaaaaagcaaaacaaaaacauacacugaggaaaggacacccuauuuaacaaauguugcaggauaauuggcaagccagauguagaagaaugaaacuggaucuucaucucucauauaaaaaucaaugcaagaugcaucaaagacuuaaaucuaagaccugaaaccauaaaaauucuagaaaauaacaucggaaaaaccuaucuaggccuuggcuuaggcaaagaguucaugaucaacaacccaaaagcaaaugcaacaaaaacuaagacaaauagaugcagcuuaauucaucuaaaaugcuucagcacaacaacaaaaaauaauaaucaguggaauaaaugaccacccgcagaaagggagaaaauauucgcaaacuaugcauucaauagaggaccaauauccagaaucuacagggaacugaaacaaaucagcaagaaaaaaaaaaaaggucgcuaaguacaugaauagacaauuuucaaaacacauggccaacacacaugaaaaaaugcucaaaauuacuaauccaggaaaugcaaauuaaaaccacaaugcgauaccaccuuacuccugcaagaauggccauaauuuaaacaucaaaaaauaauagauauugguguagaugugguguaaagggaacacuuuuacacugcuggugugaauguaaacuaguacaauggaaagccauauagagauuccuuacagaacuaaaaguagaacuaccaugugauccagcaaucccacuccuaugcgucuacccagaggaaaauaagucauuauaugaaaaagacacuugcacaugcauguuuauagcagcacaacuuacaauuguaaaaacuauggaaccaaccuaaaugcccguugaccaaugagugaauaaagaaaauaugguauauauacagcaugggugugaugguuaauacugaguguaaacuugauuggauugaaggauacagaguauugauccugggugugucugugaggguguugccaaaggagauuaacauugagucagugggcugggaaaggcagacccacccuuaaugugggugggcacagucuaaucagcugccagcauggcuagaauauaagcaggcagaaaaaugugaaaagagagacuggccuagccucccagcguacaucuuucucccgugcuggauacuuccugcccucaaacaucagacugcaaguucuucauuuuuggaacucugacuggcucuccuugcuccucagccugcagacggccuauugugggaccuugugauaaugugaguuaauacuuaauaaacucccauuuaucuaucugucccauuaguucugucccucuagagaacccugacuaauacagauuuugguaccaggagugguucuagaggaacagaauauuaaggauggaguucuuuuauugguaugagguuucuggaguugacugcuuaauaugauuagacccaaagaugcuaaggacucuacuucuaauaauauggauaacaccaauaguccuugacuugaacuguuuagagaguuaugcaaaauaaauauauuugagacuccugauucaucacucgugagaggcaaggacucuacauaauaccuuugaccauauguggaaucacccuuagugacucuguacauaauaccuuugaccauauauggaggaccagggaacauaaugaagcugguugguugcuccuaaguucaguggacaaagugaugaaagaaaauaaugaacucagggauuguaucucccagcuccagcagcagauacugagccucagaucugcuaagauuguucugaaugaaagacuuaucuccuguagagaaagagcugaaauuguggaaaaacagacacaagcucuuaucaugugaguggcugaccugcaaugaaagguacaugcacagccucgccaggugucuacuguuaaagugagagcauugauugaaaauaaaugggacccugcaacuuggaacugggaugugugggaggacccugaugaagcuggggacacugaguuugaaaacucugaugaaccuuauuuaccagaagaaacagcuuucccauccccagaaguggcagcauccccucccugaccuaugcugccaucagccuuuucaccuuugucugaggagauaaacccugugcggccugaggcaacagugauggccuccccugaggcaguugccaggcaagauaauguugauucuucucaggagccaccccuaagacucccauuugcuucuagaccuauaacuggacugaaguuccagcaggccccuagaggugagguugagauugugacccaugagguggugugcuacacucaaaaagaaccgcuugaguuuucugauuuauauaaacagaaaucuggagaacaggcaugggaauggauacuaagggugugggauaaugguggaaggaaaauggaguuggaucaggcugaauuuauugauuugggcccacuaaguagggauucugcauuuaauguugcagcucugggaguuaaaaaagguucuaauuauuuacuugcuugguuugcugaaauauggauuaaaagguggcccacugugaacaagcuggaaaugccugaucucccuugguuuaauuuagaggaggggauccaaaggcuuauggaaauucagaugguggaguagauuagucacuuuagaccuauuuaucccugcugguccagaaaauaugcccuugaccaaugccuugcaaaacagauaugugagggcagcacugggaucuuugaagagcccuguaauugcucuucucuguaugucagaucuaacugugguaaugucagaucuaacugugggaaccgcagucacucaacuacaaaacuuaaauacagugggaauaauuggauuccaaggcagcaggggccauggcggcacucagcugucaaaggcaaggugggcauagcuaccauaaugggcagcagaggcaaagcggcaaucagaacagucugacucguguaaagcucuggcacuggcuaauuaaucacagcauuccuagaaguaaaauucauaggaggccuacugcauuccuacuuaauuuacauaagcagaaacuucuaggucaaauggacaaaaaacuaauuugaauuauaaaaacagacucacagccccucaaccaauuuccagacuugagcuaguuuacagacccagaaccccuugaaugaaggggaggccaggucccguugaggaaggaccccacuauauuaccaacaauuuaugcugugaaucuuucucccguccuuccccaaggagaccuccgaccuuuuaccaggguaacugugcacuggggaaagggaaauaaucagacauuucagggacuacuggacacuggcucugagcugauguugauuccagggaacccaaacugucaugugguccuccaguuaaaguaggggcuuaugaaagucagguaauuaauggaguuuuagcucaggucugacgugcagugggucuuaugggugccuggacucauccuguggucauuuccccagugccagaaugcauaacuggcauagacauacuuagcagcuggcagaacccccacacuggcucccugacugguaaagugauggcuauuacagugggaaaggccagauggaagccauucgagcugccucuaccuagaaaaauaguaaagcaaaaacaauaccacaucccuggagggauugcagagauuaguaccaccauuaaagacuugaaagacgcagggauggugauuccuaccacauccccauuuaucucucccauuuggcccauacagaagacagaugggucuuggggagaaugacaguggauuacaauaagcugaaccaaguggugacuccaauugcagcuguuguaccagaugugauuucauugcuugagcaaauuaacacaucuccugguaccugguaugcagccauugacuuggaaaaugccuuuuucucuauaucuguccauaaggaccaccagaagcaauuugccuucagcuggcaaggccagcaguauaccuugacuguccuaccucaaggguauaucaacucuucaguuuugugucauaaucuuauucagagagaacuugaucgcuuuuugcucccacaagauaucacaaugguccauuacauugaugacaguacgcugauuggauccagugagcaagaaguggcaaacacaccagacuuauuggugaggcauuugcaugccagaggaugagaaauaaaucugacuaaaauucagggaccuucuaccucaguaaaauuucuaggggguccagugguguggggccuguggagauacuccuucuaaggugaaggauaaguugcugcauuuguccucuccugcaaccaagaaagaggcacaaugccuagugagccuauuuggauuuuggaggcaacacauucuucauuugaguguguuacucuggcccaucuauugagugacccaaaagggugccaauuuugaguggguccagaacaggagaaggcucugcaacaguuccaggcugcugugcaaacugcugugccauuugggccauaugacccagcaaauccaaugguccuugaggugucaguggcagauaaggaugcuguuuggagccuuuggcaggcccccauaggugaauuacaguggagcccucuaggauuuuggagcaagguccugccaucuucugcagauaacuauucuccuuucgagagacuguccuuggccuguuacuggacuuugguggaaagugaacuuuugacuaugggucaucaagucaccaugcgaccugaacugccuaucaugaacugggggcuuucugacucaucuagccauaaaguggguugugcacagcagcauucaguuaucaaauggaaaugguauauauaugacugggcucaagcagguccugaaggcacuuugcugugcccgugcauggccuccauccuugccaccuggacacuuugggcuccuccugccuuuaagucaacaggcuaagaagggaguuacagugcuggcuggggugauugacccagacuaucaagaugaaaucagucuacuacuccacaauggaaguaaagaagaguacacauggaauacaggagauccauuagggugucucuuaguauuaccaugcccuguaauuaaggucauugggaaacuacaacagcccaauccaggcaggacuacaaaugacccagacucuucaggaaugaagauuucagucacuccacaaggaaaaaaccacaaccuacugagguccuugauaaaggcaaagggaauacagaauggguaguagaagaagguagucaucgauaccagcuacaaccaugugaccagcuacagaaaugaggacuguaauugucaugaguauuuccuccuccuuuuguuaaaaacauguuugugcauauauacaguuguacuaagaaaauaucuucauuguauuuucuuucuccuuuaucauaugacaugagauuuauugacuucacaucaacauuuaaguauugcuaacuuuauguaguaguauuuggguugguguuuggugcauuuccaguugcacaaaggauagcuguauuauguuacguguaauuaugaccuuauuauugucuuuauuugaagauuauguaugaucucaggagauguguauggauucauguggacuugugaugguuaacacugaguguuaacuugauuggauugaaggauacaaaguauugauccugggugugucugugaggguguugccaaaggagauugacauuugagucagugggcugggaaaggcugaccuagccuuaaucuggguggguacaaucuaaucagcugccagcauggcuaggauauaagcaggcagaaaauuguuaaaagagagacuagccuagucccccagucuacaucuuucucccaugcuggaugcuuccugcccuccaacaucaaacuccaaguucuucaguuuuggaacuuggacugucucuccuugcuccucagccugcagauggcccauugugggaccuugugaucaugugaguuaauacuuaauaaacuccccuuuauuaguuaugucccucuagagaacucugacuaauacaauggaauacuacuuagccauaaaaaagaacaaaaugauggcauuugcagcaaccuggauggaguuggagaccauuauucucagugaaguaacucgggaauggaaaacuaaauaucguuauguccucauuuguaagugggagcuaagcuauggggaugcaaaggcauaagaaugauauaauagggccgggcgcaguggcucaugccuauaaucccagcacuuugggaggccgagguggguggaucacaaggucaggaguucaagaccagccuggccaagauggugaaaggggucucuacuaaaauacaaagaaaagaauuagcuggccgugguggcgggugccuguaaucccagcuaaucaggaggcugagccagagaacugcuugaacccgugaggcagagguugcagugagccaagaucgcacuaaugcauuccagcgugggcgacagagugagacuccaucucaaaaaaaaaaaaaaaaaugauguaauggacuuuggggccucugggggaagugggagaggagaaucagggauaaaagacuacacauuggguauaguguacauuucuugggugacaggugcaucagaaucccagaaaucacuacuaaagaacuuauauacaucacaauaaaccacuugcuccccaaaaacuauugaaaugaaaaaaaaaaaaaagccugguaauaaugguuucccuugggaagggacagugguuuuccuuguacuauuuaaguuuuguaccauguacaaauacguguuccaaaagcaguguuacuucuauucauuuuaggaguuaauaugaaaguccugacauuaaaucuguuuaggcuggugaucuaauauugcuaguuccuuggugaggguugugguacuuucacuaccacauccgucuguuuaguaguucagugauuacacgagguaagaaaaugaaaucaucuuaaacucagaccuggaccuugacccuguauuugauauuuuuugcugccuuaagauaguguuagcuguucuugaaggaaugcaaaaugcugguucagguggcugacauauauucauagccuccauuucuuccuccuccucauaagcaugguaccuaucucccaaagugccagagugacagugaggacuugucaagagccauucaucucuagaagcacugugaacuuuagccaagcauaugguucaguuauucaggaucuuuaaagacauuauugaaccagcgggagugggcuuguuaugucuuaacuuuaggggggaaaagggggugggguagagauuuaggcuuuugcauuuauaacauauacuuuuuagggaaaaguguuaauuaagcauaauuuuauuuucagcauuuauaagauaaacaugauguagcaucaacuguucauuguccauagcuugcuaaauuuugaguugccaagacucuugugaaaauucuguuucccauugcaguggcauaguguaaguuauuuuuuaaggaaauagguuaauuuguuuaugugaugaacacaugugcaggugagacuuugcccagauuggagacuuugacuuugagucacuccacuuuauuuauauaguaucccaggaagguuagccaaauauguguagaagcugccaguauuaaugauuguuagaagaccagcuuagugcauacaguguuuacagcgcaccuggcaugcuucuaugcuuguauauaccuuaguucauuuaaucuuccucauacaauugaauuaugcgauaucauuauucucaauuuacacuugagaaaacuaaggcauacagagaugauuuuucaacagugcuucaguaaguuaacaguuaaguugaaaagacuuuuuuuuaauuaaaagggaauauugaauaagcuaagaaaaaaugaagguaauuaauaacuugaagauuagaugugcaguauuaaauaaaacacuggagaaaaggaucgaacuuuucaaugauguuucuaaaaauccaugccuagccuugccacuaaaggaauuccaagauguuuaucccugugaacagaaaaacaaucagcacaacucuguggaaaggcaauaggcaaaagagaaaucacuuucuaaccagcaaaagcuuuuacagaagucuucagauucuguauuuuuaaaaguaaugagaauuaacuuuucagaagccuggaaauagaacucaacacaccuguuugagaagauaagcgacgagaggcaccuuagcuuagccugcgagguuaaaaguuaagacuccagucuguauucucaaaccagcuuagucucuuaaaguuguuaagaagcaaaugagauuaaagcauauaaacaaaugccuggcgaguagaaagagcucagugcuugcuuguguagcuauuaguuucuacaugcaaagggcuggggaaacaggauuaugugaaugagaaaggguccaggaaacacccuucugugguccucuagguuuuuucugagagccuggcagauaguaggcauuuauuauagugacaaaucaucuuuaagaaaucaacuugguaaacauuggggggaagugcagccuuaaguugugcaugugcuaguauguuuugaaguuucugguuuuucuuuucuagguucuuauagagacugcuaagaagcuaggacuccggugccacucaaaggggacaauggucacaaucgagggaccucguuuuagcucccgggcagaaagcuucauguuccgcaccuggggggcggauguuaucaacaugaccacaguuccagaggugguucuugcuaaggaggcuggaauuuguuacgcaaguaucgccauggcgacagauuaugacugcuggaaggagcacgaggaagcaguagguggaauucuuuucuaagcacauauagcauggguuucugggugccaauagggugucuuaacuguuuguuucuauuacguuaguuucagaaagugccuuucuacaagguuuugaaguuguuaauauuuucuguaguuccauuggaagguaagaacaaagaucaaaggaaagaaagagacacuuuuacccaaggaucaguagugaaaauaguacauuguaggcagguagauguguugagaaucauacuaagacuugggccuuauuuucaggauaaagguguauuuugauugccaauuucugcugcuaugcuacuguuuuuuguuuucaagaaggaaaaaaaucuauuaacccuuuccucaugagagggcuguauguucacauccaucuauuuaacguaccguggcuggauacucuguucagcauagaaaugugacaacaaacagagaaguccuuaaggagccgacauucugucggauggagauagaaguuaagcaaaccaauauaagaaagcuaacgguuauaaagaaauagaauggugagguacaaggguacacuaggucaacugaauagaguugaccagaccaaauauuugaaguaugagaagccuuccuguuuuaagugugaugggcaagaagggcaugauugaguagaguggaaaggagggagacuggggagaagggagagagaggagggaugcaauacaguagggccaggccauacagaccaugguaaggguuucagauggaaggacagugagggguucaggcagggaaggcagcaggauccagcuggaauuugaggacacuggaacaaugaggucagcuuccaaaacaaaacaaaacaaaacuuuaaacaucuguguaaguacaggguggaauauaaugaauuccagguacccaucacuuagguuccacaauuagccauggccaaucuugugugauagguaugucccuaccuauuucuccccugcccucauugugaaguaaauauuuuccuaaaaggucuuuuuaaaauuaaguuauaaccaugccaucauuguacaaaaauaaugauauuaauuucuuaauauaaucaaauauucagacuauuccuuuuuccuucagucucauaauuuuuaacaauuugaucaaaucagaaucccuuacaauccauauguuguauuuuaaugauuaccucuugucucuuuuaaucuaauuuucaccucuuucucuuuuuauuccuuguguuacuugaauaaacuagaucguucguccugucauuuaucucauuuuaagauaaagggacgacaaaacugcagucacuuuugaaguaaggaaaacauuuaggggugacuuucugagcacauuuaggguaagugacaucuccaaagaggccuaauauuguaccaccguuuuagagaguuuguuuuacuaucuaauguguacaguguuuugggucauagaugaacacagguucuuuguuuuucaugaauuccuuaugaugacucuucaguguaauaaacuguuugcuuaguacuaggaugccuuuuauguaagagauucgcaaauuauuacauuaagucacaacauaauaucuuauuuggcagcuuugguaaccuaaggaacaacucagccucguaaugucaagaagcugcuuccaauuaauaggaaacuccagccccugccacacccugagagcgguuugcuuccugccuguggcuuucugcucagucuaauaacauaugucuccuccuuuguagaaccagcagugauuuccuuuaguagccaaaugagguuggggaaauagucagcuggagcuacuuuauugaaaagcagagaaauuaagcucuguaaguggaaaggcuugaagacaguguuaaaugcuacaaggaaggcccacagaaagauggcauuauuucagccaaucguguguugcagccuggcauggcaaaaaggauuuggaguucucuaaacccaucuucagauuugaguugcuccauuugcuugucacauugggcgaguuauuucacuuguuuacucuucuguagaaugaagccagggcucugggugaggaguggagguuguuuagucauuguuuagucaguuagaccuugaaagauuacuggaagaauuaaaccaaaugagauauguaaaaaagcuaguauaaugcuggcuuguaagaggguggucaucagaugguggcucugauggaguggggggccugagagguggguaguaucagggaaaagcauuuaaacugcaccuugaagagaggguuuauuuugggaaggucaguaggaaggacauuuugggugaagcccaacagcuggaacaaagagaagggaggucagugucuauacagaaauaaccagucacaggaaaaauauauaaggaaaugaguaaauacaaggcaaauuucuuggaugcuucaugucugcauucaaagacucagcuuaaaacauaucauuuacaugugccuggcagauacccagccugucacugcuuuguguucccauaguagugcaaacuccccucugcuacaguguucaucauuuuuuccuauacacaucuugguguuugugggugggaucuggacuaugcuuaaggaaauagaaagauguaauccuugugucccugaaugcuggauuucuucgaagcauaggaaggcaugucaaguacucuaucucugaugguaauuuuguguucacuuucuucaacuuuuucuuaugaagcuauuuuagucauauacagaaguagcuaauagcacgagcuuccaugaauucagcaucuagcuucaaccauuauauuaacuuacaaccaauaugauuauuacucccaucaauaauuuuauccauaaacacuucaggagguaucuaacaugagcacauuaucauuuucauucuccaauaauaauucuuuaauauacccagccagaauuuaaauuucugguuaaaugccuuaaauuauucuuuugguugcaagcuuuuuaugaaggaaccagaucauuuguccuguugaguuucccacagucugaauugcugaaaucaucuccuuggaguaguuuaauaggcuucucuguccucuguauugucuauaaauugguagcuagauuuagaaauuuaaucagauucaggugucuuaagguagcauuuuauuuuuucaucaggaagcacauaaugagugguuuauuugggauuuuguuugguucgguuugugauguuagcagccaauccauuaauucacugggagccauaaaaauggugguauuuuaauuccauaauauuuuucuuuaguagcuggaauaauuuucuaaggagaaacguaccuguuugguuuuccaguguagcaacaguuuuaacauuguaaucccuucggcuguggacaugaagagaacagccacaucuuucuagaccauauuaacccauuauacaucugagauauuuucuccgauaccauauugaaaucuguauuagucuguuaucacauugcuauggagaaauaccuaaaacuggguaauuuauaaagaaaagagguuuaauuggcuuaugguucuacaggcuguacgggacgugaugcuggcaucugcucagcuucuggggaggccucaggaaacuuccaaucauguuggaaggcaaaaggagcgaggcaucucacauggugggagcaggagcaagagagagugagaggagaggugcuguacacuuuuaaacaaucagaucucacaagaacucacuaucaguaaaacagcaccugaggaugcugcuaaaccauucgugagaaauccaaccccaugauccaaccgccucccaccaggccccaccucccacaauucgacaugagauuuggugaggacacaaauccaaaccauaccagaauucaucagugcuuuucagagaugucacugaguuucucuaggaccuccgugcuaggacuaagaccaucuugauaaaugccgagcuugaacucagggguuuaaacguagaauaaacagacuucacaagucagguuuuucuuagucugucuggacuguuguaacaaaauaccauagcauggguggcuucugaauaacaaguuuauuuuucacauuucuguaaguugagaaguccaagaucaagggacuggcacauuuggugucuagugagagcccacuuucugguagacagccaucuucucacuggaaccucacacgguggaaggggcccucgaagaauagcacuggggccucuuuuguaagaucacuaauccuauccacgaggacucugccuucaugaccuaauugccucccaaaugcccaaccuccaaauacccuacauugaggauucgguuucagcagauaaauuugaggggacacaaacauuuaggcuguagcaaggcuggagcucagaaaaauguuuuaugacaagcaguggaauuuuaaguucuaguaaccuccagugcuauuguuucucuagguuucgguggaccgggucuuaaagacccugaaagaaaacgcuaauaaagccaaaagcuuacugcucacuaccauaccucagauaggguccacagaauggucagaaacccuccauaaccugaagguaagugucagccauggacaaucaggcaugucuguagacucucuauugucuucuuuucuuacuugcauuucaccuuugguccucauguauuuuaugccagccuagauguuuucaacaaguuuuugugacaucuacuacuaccauaccaaccacuugugaaacugaguagucuuauuuucuggcugguagugcaagaccacugaaggcuaggguugagagaguuuuauuaucucguguaccagauucuucacauugcccugcucuguaguaucccuaagucuuacuucagaagauugauagugcuuucucugcauaucgcuuacauuguugacaaagcuauuuucucuuuggcagauccauucaaauuuguggcaauccuuuaaagccaaaacucugacaauaguaccaaaauggugccagaaaauaucugcuuaagguuaaucaugcaucaaacuaaacaguaauuaaugauaaaccaacucuaguauucucagaauauaauuuaaacuaacugauaaacucggaguugcaugauuuuucuuugggcacuuugugacucuucuuaaccacauagggaaagacuugucucaaacugaucagauauugcauucuccuacuauccaaagaggaccauaccccaaagucuccuagaauacaccuguacuuuugggucuucugguggugguggagagaggauuugaaagguugaucuaagcccuccuuaccugaauuaccaccuaggagcucuguaaugagagagccacaguuuuaguauaaugaggacauuguauggugguaagugacugccaaucacugggcauggcagagccuugauuuguaauguuugcuaauuuacgugguacaagugcuccaguacggccaguuucacacuacuaaugugaagccacugaugaguugagaagugauacacacagcucuugcaagcugguacgaacagaauccagcacaccacuguaacuaaggugucucucagcaguuaggacugacggucaagaauguuggaauuuguagcuuaucuucccuacuaagaaacaaaucuauugguuucaacacuguauaccuaggaccuaaauguuauuuaaugaauaaaugauacuccuuucccccaugaaguguuuuaucauaauauauagagaugcaggaaacccuuauuauuagaauuaaaagggaaaaaauacauuugagugcagucaaauggcacaacuggagcuugcauaaaaaaacgcauguugguuugccagaaaugugacuccuacuuguacuauuguuagcaaaaugucauagaaguuuguuuguuuauuuguuuguuuguuugagacggagucucauucugucacccaggcuggagugcaguggcacgaucucagcucacugcaaccucugccucccugguucaagcgauucuccugccucagucuccugaguagcugggauuacaggcauggaccaccaugcccagcuaguuuuuauauuuuuaguagagacuaaaccuaguagaugaccaacaugguuucaucaugucggucaggcuggucuugaacuccugaccucgugauccacccgcuuuggccucccaaagugcugggauuacaggcaugagccacugcgcccagccaaguuuauuuuuuuuaagucucccaacuaaccccacuuugaccauagucuuucaaaagcuugaaguuaauuucucaaauaauauauuuacuguuuuagcuuuauuuuuaaguaaaaaugcuugaagaguagaaaucaguguucuccuuuccuggagcuucugaaauuguaaaauugugugauuuuauuuguaugcauuuuuaaagaggcuuaguuuacguagcuuucaucggauuuucaaaggaggauuuuauauauauguguauauauauacacacauacauacauauacacacacacacauauaaaaccuaaagagagaaaaugaggaauuccugcucuagacaaaacugagaaucuuggucuucaugcuacagcauuaaggaacaccauacuaauaaucccuuuuucugggguaguauuguuagcacugaaauguguaucauucauucccucacuaagucauuucagaaacacuuagcaccugcuauacgucaaggucugguuugcaaagauaaagaguugugaugaugauccuaugguguuuggagauauagacacauaaaaauuucaaugauuucuuacagugggguaaggauaagggauagagguugcauaaacaauaauccaggcugggggcugguauggcaauaagugauuaucagaacaaugcucugagauaagcauuauuaaccucacuuuacaggaaagggaggugaggaaccaagaguuuagaguacccgaaguuccacaucugguuagugaacuugaaaauuuucuguagaauuuauuuaaaguguauguuuccugcguccucacuuugaucuagaaaaucaaaaucuguuuuuuuuuuuaacaaacaucucaguaauuacgccaacaugugaauaucacugccuccuuucuuccuuucagaauauggcccaguuuucuguuuuauuaccaagacauuaaaguagcauggcugcccaggagaaaagaagacauucuaauuccagucauuuugggaauuccugcuuaacuugaaaaaaauaugggaaagacaugcagcuuucaugcccuugccuaucaaagaguauguuguaagaaagacaagacauuguguguauuagagacuccugaaugauuuagacaacuucaaaauacagaagaaaagcaaaugacuaguaaacaugugggaaaaaauauuacauuuuaagggggaaaaaaaaacccaccauucucuucucccccuauuaaauuugcaacaauaaaggguggaggguaaucucuacuuuccuauacugccaaagaaugugaggaagaaaugggacucuuugguuauuuauugaugcgacuguaaauugguacaguauuucuggagggcaauuugguaaaaugcaucaaaagacuuaaaaauacggacguacuuugugcugggaacucuacaucuagcaauuucucuuuaaaaccauaucagagaugcauacaaagaauuauauauaaagaaggguguuuaauaaugauaguuauaauaauaaauaauugaaacaaucugaaucccuugcaauuggagguaaauuaugucuuaguuauaauuagauugugaaucagccaacugaaaauccuuuuugcauauuucaauguccuaaaaagacacgguugcucuauauaugaagugaaaaaaggauaugguagcauuuuauaguacuaguuuugcuuuaaaaugcuauguaaauauacaaaaaaacuagaaagaaauauauauaaccuuguuauuguauuugggggagggauacugggauaauuuuuauuuucuuugaaucuuucugugucuucacauuuuucuacagugaauuuaaucaaauaguaaaguuguuguaaaaauaaaaguggauuuagaaagauccaguucuugaaaacacuguuucugguaaugaagcagaauuuaaguugguaauauuaaggugaaugucauuuaagggaguuacaucuuuauucugcuaaagaagaggaucauugauuucuguacagucagaacaguacuuggguuugcaacagcuuucugagaaaagcuagguguuuaauaguuuaacugaaaguuuaacuauuuaaaagacuaaaugcacauuuuaugguaucugauauuuuaaaaaguaauguuugauucuccuuuuuaugaguuaaauuauuuuauacgaguugguaauuuuugcuuuuuaauaaaguggaagcuugcuuuuuuaacucuuuuuuuauuguuauuuuauagaaaugcuuuuuguuggccgggcacaguugcucauccauguaaucccagcacugugggaggccgagacggguggaucacaaggucaggagaucgagaccauccuggcuaaugcguugaaacuccgucucuacuaaaaauacaaaaaauuagcugggcgugguggugggcaccuguagucccagcuacucaggaggcugaggcaggagaauggugugaaccugggagguggagcuugcagugagcagagcuugcagugagacgagcuugugccacugcacuccagccugggcaacagaguaagacucagucucaaaaaaaaaaaaaagagugaaaugcuuuuuguuugcuucaguuuuuuaucauggggagaucuuuuuccucagaauuguuuucuuuucacuguaggcuauuacaggauacuucaggaucaagauacagaaccuuuuauuuaaagaguuuguaaagucaauguguuuguuugugucucugagauugacuucaagauaauaagcugcuaauuguaaacaaaacaguuacccuccaguauuaauaugacucauuagugugagccauuugggucaaguaugauuaugacccuuggacuuccugauguaguauuaaauuucaacucugguuauccauuagcaaucuguagagaacuuaaugaaccugaacccaggcuucucuagcucugguaacgugugauuguuuucacuacaauaugauacauagaugguaccuuacuuuuccucauucuuaauaggugucuaagaaugucagggcaaaaguaugggcauuuuucuugcuauguucagaaaguacaguucucuccaacuugcagagguacuuuucuugauuaaauagccuucucuagcaacaucauuuucagacuaacuaaaugaaugcaguauacucuuuucuuuguucucaaucauucacuccuuaugcaaagccaauauaauuuuccucauaccuuaugcuugaggauauuguugaagaacacuuccuggaacacuucucacuugugaugcuguacuaauuuuuuuuuuuuaauuuaagcuaguauacuaagugaacaccauggucaguugugagcauuuugguuuccgcaaaggauggauggugagcaucaugggaaagcuguaguuuagugacuuagcccuuagugauuaauagauuugcauguacauagaagucuuuguuggccuuauaaucugcuguuauauuuggcauggauuuucaugguuuugagaaugacauccuggcccugugguccccgagggucaugguccuugugaccuggccccuguucacugcccccuucgcuagcacgaguugcugugcagggcuggagguagcuaccauggcuuguuucaaggaaggaaacucugguacgguggcacccucaggaguggaggacagugaacuuccuugaagagggagugacuaaggugaccuccaaccugcccugagccagcugcccugcaggugccacgugagccugcucuggcauccacaggaugcuccuggagccucuucucuggcugcuaccucagggcaugguuguggccccaccaacaccuauuuuccaaauaauuauucauucuugugacaguggccugaacauguuuuuaauuuucucaacaagcauuuagccagcacuuauccagugaaacaauuugauaagguuucaaggaguaucugauggguuaggaagucacgaaaugaggaguucuugccacauuugcagagucccuccuugauaagguuuggcgguguccccacccaaaucucauguugaauuguaguucccauaauccccacauguugugggagggacccagugggagguaauuaaaucaugggggugguuacccccacacugcuguucucaugauacugaguucucacaaguccuguuuguuuuauaaggggcuuuucccccuuuugcucaacacuucuuccugccaucaugugaagaaggacguguuuguuuccccuucugccacgauuguaaguuuccugaggccuucccagcuauguggaacugugaguuaauuaaaccucuuuccuuuauaaauuacccagucaugggcaguccuuuacagcagcaugagaauggacuaauacacuccucaaauguuuugaagauuguugcaccuuggaacuaccagugugcacacaaucuggcucaauguauauauuggcccagcaaggcaaagaacugaaguuccaggauggaagaaccuguguucuccucauaauaguauagaauaauucaagauaggcaagaaggacagcaguaaaugaagaccauggaagaaaagaaggaaugccaaagaucgaggaaaucuaccaagacuaguaggguaguccagaagaagcuguuucagggccuguugccagcuaugccuuugagaaccucgggaucccaaagaaugaggggaauuucuucagaaagacaaucucggcaugcauuauuucuuuguuuugaagauucacucauguugcaugcaucuguagcuugugccuuuuuuauugccuaguaguauucugucauaugccuaucuuacaauuugauuaucuauucaccuguugaugaauguuugaauuuuuuccauuugaggaauuuuaugaauaaagcugcuauaagcaugaa

SEQ ID NO: 191384 - RNA, 17528 nt, Homo sapiens
auucaaaggaaaaagauuuaauauauucgagucacaucaugacaaaugauacaaacuugugaaauaucauuucuuccucuuuuuguauuuuuuuguagacacuuucgccacauugcccaggauggccuugaacucuugggcucaagugacccaccugccuuggcccccuaaacugcugggauuacagguaugaggaacugagcacuuuucuauuuuaacuaaccuugccaucuuuucccgugcuuuucuguuacuguccccuccuguuuuccuacuacauugacagguuaucuugacaggugcagcccucccccaacaguauagaaguuuauucuuagacaagcuagcacaauauacuuuuuuuugagacggagugucgcucuguggcuccggcuggagugcaguggugugaucucggcucacugcaagcuccgccuccuggguucacgccauucuccugccucagccucccaaguagcugggacuacaggcgcccgccaccaugcccggcuaauuuuuuuuauuuuuaguagagacgggguuucacuguguuagccaggauggucucgaucuccugaccucgugauccacccgccucggccucccaaagugcugggauuacaggugugagccaccgugcccagccagauaauauaaauucuaaaaagacuagucaacugcaguagggagguggugggggggaaguaaaacaaggaauucuaucuguaacugacugugaucaacugaaauaacucacuacauugagaccagccuauuuuuuuuaaacauacccuuuauuaacaucuagguaauaucuguaauauuccuugcuccucauccccaaguacgcuauuagcuguccauccuucuggguagaaguguauuuucguuuuacuuguugauuuuuggaugcaugcugggggaggaaagcauauuguuuguagucacccuggcgugcuaagguauauuauuccccaguaauucucucaaggugggcauaugcaaaacauaaucucuaaauucuucaauacuaagaaauaccuuuguuuuaccccuaaaaucaaaugccauuuuggcuggauauaggauucuaggauuaaagccuuuuuccagcagaacuuugaagacauugcuccauuuacuucuagcauccaguguguccagugauaagucugcugucaaccugauucuuguuccuugguagguaauuucucuucucucucuagaagcccuuauuauuuucucuuuaucacuagaauuccaaaauuucaccaagaugugucuaggagucagucucuuuucaucaauuuuacuagguacucgacaagcacugacaaucucaagacuugaaccuuucuuuaguucugcaaaguuuucaucaauuauuucuuuaauuauguccucugcccuauucucauaacucuccuuuucuggaauuccuaucaaacgaauguugcaacuucuagaucucuccucuauaucucuuugccuuucuuuacuaauuaucuguuuggucauuugcauuguauccuuagagaauucuucaauuugaucuucuagacugucuauucuuucuucaaguauguccauucugcuacucagaucaucuacugaauuuucaauuuccaagacaccugaaugggaacuuuucaaauuuccaaucuccucuuuuaucucucugaugcuauuaaucacacuacuucucaaguuuucuucuguuuccucuguuaagucugcuucuuuggauguuaguucuucugugugcagaguucuguguuucuuuucuucuguuuucuuaaguuuggugacuccuguugaaauacucaaauuuguaugugaaugcuuuuuaugcucaucaugacucaucucuagugacuuugagggagaggccaaacauaaggucagacagggugugccaguuccuugacuugugggcacagcuguuuccucuuccuccuggguuuugugcaccaccugguguuucaccaacuuuuucuucccagaguccccaaccaaauaacuaaagggaauuucuuuuugucuacgugaggcuuuuuucucagucagggagguagucuuuaccuuuccuguuucagagcucuuuccuucuucuuccuccucugauucagaauccucuacagagucaaugaaaguaguuuccaugccaucacugguuaucucaacuucaugcuuugcaucuaccaaaguaugacccugaaagguugaguccuguucugaagucuguuccucuuccuccucuagcccugaggccucauccuccuccaacccugaagccucuucuucuucuuccuccuccagcccugagggcucuuccuccuccuccuccagcccugagguaucuucaucauccuccaucccugaggccucuucauccagcuccucuagcucggaaaacucuuccucuugagucucuaaguuuuucaucuccucuggcuuagcaacuuuuacuucuuuaagaaauaggaagcucaagccaucacugguuauuucuccagcucuaugcuuugagucuauuaggguuuuauccugaaaguuaaacaaagaagaaaaaaaagaguuauuuguuuaaaucauuugucuuuuaaagaauuaaaauuucaauuucacuaauuuuaauauggcuucaauucugacagaaaauaucugaaaaagugcuuaaauauuaauuguucuugaaggccuagguccccaaacaagucaagucucccuaugaucaucucaagauauuugucauuucuuguguaaucuugaaacaaauucugaggucauaaugucuacuuucuuccuucuagaucccugaacacuuacugcuguguaugugauugauccucaguaauuaccuauuuuaaucaauugucugcuuauuguaugugagaguccuaugguaaauaggcauuguaaucuggcuaaaguuuacaaucugcuuuaggaagaucauaagcacacacaaacaaaaaccccaggcucacauuuaccuuucuccacagacaacaaacccaauuaaaaaaaaaaaaaaaaagaccccaauugcaguuuacacucuagccuuaggacuuuaaagacaagcaggcuuugguuaggaauacaacaagcucaguucaaaacuauucaaacccuggcccgauugccacauuugcuacuagugccucaauuuuccuuauaaagcagggucuaauggcagcaucacuccaggauuuuuguaauauaaaguaagcaagguauugagcuucugaugaugucugcaauauaaauguuggcuccuaauauuccuugaagcccuuagucugccacugagcuuuucaaccuucccaaacccaccagacagguuaggugccucaucugugaaacacuggaaggcagcuaauuucugagauuaaauacugauucuuaaauaauuuguugauucaaguguaccuuuuccuuauggauucucacuuugcagagguuacacuuggaaauguuggaaaggcagaggagaagcguucauuugaaaacauguaaaaaaauauuggcuuacgaauauagaccuuggcugggcaugguggcucacaccuguaauuccagcacuuugggaggccaaggcauguagacugcuugagcccaggaguucgagaccagcaugggcaacauggcaaaaccucgucucuauaaaaaguacaaaaauuagcugggugugguagugcaugcauguggucccagcuaucaggaggcuggaguaggaggauuacuugagccugggagguggagggugcagugagcccagauugagccacugcacccccaccagggcaauagagcaagacuuuaucucaaaaaaaaaaaaaaaagccccuuccagcacagcagccauuggagaacagcagccacugcucugugugaccccaaggcuuugggucucaacaagggcaacaaggugaucaagaacaugagcaaaagcccaggcacugccgcuguuucaggcaccugaccaaacacacuaaguuagugugggacaugaucugagagguguguugcuucgccacguagaguaucacaccacggaguuguucaaggucucaaaggacaaacaggcccucaaguucaucaagaaaagggugaggucacacauucacaccaacagggagaggagcugagugccgucuuggccaccaugaugaaaccagcugccaagaaggacuaaggcccccuugcccucugcccauaauaaaaccuucacagaaaaaaaaagugcccuuuaaaucauuacuuuuaauaucaugcuuuuacuuuuaaggaaucauuuuuuaaaauuugauuuaaccggcugggcccaguggcucacgccuguaaucccagcacuuuggguagccgagguggaucaccugaggucgggaguuugagaccagccugaccaacauggagaaaccccgucucuacugaaaauacaaaauuaucugggcgugguggugcaugccuguaaucccagcuacuugggaggccaaggcaggagaaucacuugaaccugggaggcagagguuguagcgagccgagaucgugccacugcacucccaccuggccgacaagagcgaaacuccaucucaagaaaaaaaaaauugauuuauccuucaaaauaaccaugccuacuauuacauuuauacauaagcuuuauacauuuauacauuuguaugcuuacccuuuuuucuugaauuccauauuuucuuccuccuugauuuauuucuuccuuuugugggaguacaucuuucaguaauucuuucacagaagauuuuuggcuggcaaauuuucuaaggcuuugcagaucugaaaaugucuuuauuucaccaucacauuuaaaugcuaauuuaacuucacacagaaauuuagguucaaaaucauuuucucucagaauguugaagacauuacuccauugcuuacuaauauccaguguugcugaugaaaggucggcuaccaggguaaguacugcuccuucauccaucaacacuuuuucuucucuggaggcuuuuaaaaccuccucuuuauucuucaauuucugaaauuuucuuuccucucucauuucuuugacaaauucauccucuccauccuuccuacucucucuuucuguaaauucuaaauggacauugcgauuuccaucucugucaucuauauugcauaagguuucuuccauacuucccaugacuucguaacuucgugauucacccugggguaauuucuuaccaucauuacuauuguauucguuaguguugucuaauuuaccacucagcucauuuacuucuaauuuaaagguuaaauuuucauuaucaucaccuauuuuagaguuuucuccuucuauuuucccuaccaucccuguuuuuuguaaugcuaaauugauuauuugcugaaacucuguccuacuacuggaguucucugaauucuuuaccucagguauuguagcuuuucccccuaaaacugcuuuuaggucauuuuuaagaguuucccucaucuccucaaacaucaggucuugaauuuccauuaagaccuuaaacuuauucauaauugcugauacguccuugcauuuuaaaucuaauaccggagcuauguccuuaucaguuucuguuaacugcucucuuuucauauaggugauauuuuccuuuuucuuugcaagucuagcaaauuuugauuguacacuaguagauacaucagacauuguggauauguugucaagacuggauucuguuuuuaauuccuacagaaugauuuuuguucuuacaggccugcuagacuucagaaguuaaaaaaaucuuaaaauacgucaaucugaaauacaaaaaaaugaaaaauuacuuacuaaagaauucucuugagaaacuugguaagaauaugagcuuaguuaagaaaacuaugcugggugcacuccauaauaaauuaauaaaaaguucacuagcaaaauggguaagauuagaaaauuagaauucaaaauuuauaaauuaucaugaaaauucccuuuacauagugauuugaaugcaauaaauuaaccaaagagcagauaacuaagaaugaagcugucugauuugccauacuauuaacuuuguugucuguguucucuauaaugagauuaauuauaauagauguuauucuuuaagaaaccaacauauguaucauaccaaaucauccaaaucuaagcuaacuugaauagaaucuuacgcaaaauugagaaauaguugucccuuuugaauugcagagauuguuaacauuaagacuuuuucugaaaaccaauuaucaagucaauucaaaaugacuuucuuggccaggcaugguggcucacaccugcaaucccagcacuuugagagguugaggugggaggaucacuugaccccaggaguucgagaccagccugggcaacauagggugaccugucucuacaaaaaaauaaaaaauuagcugggcauagugacacacgccuguggucccagcuacuugggagguucagaugcaaggaugacuugagccuggaaaguuaagacugcagugagcugugauugugccccugcacuccacaccuugggugacagagugagaccuugucucaacagaauaauauuguuaggcaggcacaguggcucacgccuguaaucccagcacuuugggaggcugagguggguggaucauuugaggucaggaguucaagaccagccuggccaacguggcaaaaccccgucucuacaaaaauacaaaaauuagccagguaugguggcacgugccuguaauaccagcuacucaggaggcugaggcauaagaauugcuugaaccugggaggcagagguuucagugagccaaguucaagccacugaacugcaggcugggcaacacagcaagacugucuaaaaaaaaauauauauauauauauauauauauauagagagagagagagagagagagagagagaaagagagagagagagaaagagaguuuucguugguuuuauuuuguuuuuuucuuuugacagucuuguucuugucacccaggcuggagugcaauggcgcgaucucggcucacugcaaccuccgccucccagcuuuaagcaauucucccgccucagccucccgaguagcugggauuacaggugccagguaauuuuuuuuuguauuuuuaguggagacgagguuucaccauguugguggcuggccucgaauuccugaccucgugauccgccugccucggccuccaaagugcuggaauuacaggcuugagccacugcacccagccaagaauauugauuuuuagaguacagggagaucuagaaaaggcuucccuggugaaggcaggugaaucacuugagcucaggagauugagaccugccuggguaacauggugaaacugucucuaacaaaaauuagccuggugugguggcgugcacuguagucccaguaauaagggaggcugagguaagaggaucacuugagccugagggaggcagaggaugcagugagcugacaucgcaccauugcacuccagccugggugacagugugagacccuguccccuccccugcaaaauaagaaucacauaagcagcuaaaaugucauucuugucagggcaaaagauauaugcucagcacccaaccaagaauuucaagcagggcacggugccacaccuguaauccuagcacucugggagguuaagguggaaugauuacuugagcccagaaguucaacaucagccugggcaacauagugagacgcuguuucuaaaaaauaauuucagaaauuuuucauugcaauaaaaauugaaucaggaaaaaggauagcauaaaaguaaaagauaaauuaaacuuaaaaacuucuauguuuaauguuuaaauacuaaagguuaaaguuauuuaaauuuuaaaaugacuauucagucaaacuaauggagaaacuuaaaauacuaaaucaaaaugauaacuaccuaucaaaacuuggggaauguagcuaaaguggugcuuugaggaaaauguauagacuuaaaauuuuagaauuuucuagaaagaauaaaaauuaaaguuaaauuaccagaucaagggcaaaaucuacccaagaaaccaaaagagaugcgcgcaaaucaaagaaaugaaaaacagaaacuuauagagaauuaacaaaaccaaaauacaaauaaggaauacuaugaauaacaaggggacacaacuacagauaaagcaugguucaaaaaugggagcaccauucaacuuucauaauuaaaucagaaaauuuagaagcaacuauuaucuuagcugugcccaaacucuucuagagaauagcgaaaaaaggccaggcacggcgacucacaucuagaaucccagcaccuugggaggccaaggcagguggauccccugaggucaggacuuugagaccggccuggccgagauggcgaaaccccaucucuacuaaaaauacaaaaauuagcagaggccaggcgugguggcuuacaccuguaaucccaacacucugggaggccgaggcagguggaucacaaggucaggagauaagacaccauccuggcuaauacggugaaacccuuucucuacuaaaaauauaaaaacaaaaaauuagcugggugugguggcaggcaccugcagucccagcuacuugggaggcugaggcaggagaauggcaugaaccugggaggcagagcuugcagugagccuagaucgugccacugcacuccagccugagcgucagagcgagacuccgucucaaaagaaaaaaaacauuagccagacgugguggcacgcaccuguagucccagcuacucaggaggcugagguauaagaaucacuugaaccugggagguggagguugcagugagccaagaucacgccacuguaccgggcgacagagugagacccugucucaaaaaaaaaagagaguagaaugauaguuaccagagccugggaaggguaguagguggguggauguagggaauagggaugguuaauggguacaaaaauaaucuaguauuugauagcacagcaggguaacuacacucaacaauagcuuauuguauacuuaaacaguauaauuggaauguuuguaacaagaagaaaugauaaauguuugagguagugcauaggauacccccauuuacccugaugugauuauuacacauugcaugccuguauggaaauaaauauauacaucuacuauguaaccauaaaaauuuaaaacaggccaagcgcaguggcucacaccuguaaucccagcacuuucgguggccgaggugagugagcggauugcuugagcccaggaguuugagaccagccucagcaaugcagugagaccucaucuccaguuuuuuuaaaaaacaaauuaggcugggugagguggcucaugccuguaaucccagcacuuugggaggccgaggugggcagaucaccugaggucaggaguucgugacuacccuggccaacauggugaaacccugucucuacuacaaauacagauuuagcugggcguggugguggguuccuguaaucccagcugcucaggaggcugaggcaggagaaucaguugaagccaggaggcggagguugcagugagcugggaucgugccauugccuccagccugggcgacaagagcaaaagagcaagacucugucucaaaaaaaaaaaaaaaaaaaaaaaauuaaacccuggauguggaaguugcaaugagcccagaucacgccucugggcuacagaguaagccucugucucaaaaaaauaaaaaauaaaaaauuuuaaaugaacagcuaaaaaaaaaaaaaaagaaaagaaaaagaaaaaagcaugauaguuacaaaaaauuguuuaaaaaacacggcacucauuuaucacaaaguaacuuccaaaauaugagcaacaggagguaagggggacaaauguauacagaaaaucuugauuacaccagaguaaaggucaaaagaggaaacauguaaaacauguaaaugauuacuaaaaaagagaaggaaucaauauuaauuacacauuucacccucagccuuuuuuuuuuuuugagaugaaguuucacucuuguuguccaggcuggaaugcaauggcaugaucucggcucaccgcaaccuccaccucccagguucaagcgauucuccugccuaagccucccaaguagcugggauuacaggcaugugccaccacgccuggcuaauuuuguacuuuuaguagagacaagguuucuccguguuggucaggcuggucucgaacucccaaccucaggugauccacccaccucggccucccaaagugcugggauuacaggcgugagccaccucacccagccucaucccucuuaauuaaguaaauuuuaaaaacccagcaccaguagugucugaaucuaaucaaggacugagaaagcaaccaaauaguccaccggacagguccauaggacccuauacaggacuucaacaggaauaaaggggcccacucucauucaggagacuaagggaauucacuagaugcaauguacgcucccccuauuuuggaucucuauuugaaugaaucaacuguaaaaugcagggaguacugaauauggacugauuauuaaauauugaggaauauauauuuuauuaacuguaacaauacuguauuuaguuaagaaagucuccuuauuuuauaagagcuacauacugaaguuuuuacaggugaaauggcaugaugucugggauuuacuuuaaaacacagcaaacaacuaagaaagaaaaaagagagauuaaacaaaugggggaaaauauuuguuuuugaaucuaggugaugaguucuuacuuuuauugauguuugaauaugcuaauuuuuuuuuuuuuuuuuuuuuaagcagggucucacucgccgagguuggagugcaguggcaccgggucuagccugauaaugcuucuaauauuuuuuuuuaaacugaaaauccuuaaggaaaaccacugagcucucccuggugaaauagacuucuacuugacuugccaagaugacacagaaagcugaaaacaaggguaaacuucuacaggcacauaaggacaaauuuuucugauaacaauugugccuuuauuguguccaauaaacgcuacaauaaauguacuugaggccgguugcaguggcuuaugccuguaaucccagcacuuugggaaguugaggagggcagaucaccugaggucagcaguuccagaccagccuggccaacauggugaaacccugucucuacuaaaaauacaaaaauuagcugggcaugauggcgggcaccuguaaucccagcuauuccagaggcugagacaggagaaucacuugaccucgguagacagagguugaauuaggguuaacgccacugcacuacagccugggcaacagagcgagcaagacuccaucucaaaaaaaaaguaaaaauaaaaauaaaauaaaacaaauaaacuaaaacuaaauaaaauauuuuuaggaaagacaauguaaaucaauaguaaacaugugaaagguggcccaaucccaggaguugaguacauaauaaaaaaacaaugagaccacuuuuacccaucagaaguaggaauaguuauuaaacauuucaggaaacgaaaagccuauuauuaaagucagaaauaauacauauacucuccccuugagaaucuaccauuaggaaugaaaccaccuguacacuuaggaauacaugaauagaaauuuuaguacugaguuuuuucuggccaaaaaauacuagaaaacaauguccuuuaauaagagaaggguggaacaaaugaugauuuaugcacacgaugggauuauauagaauagauauaacuauauauaaguacauaaauacauuaauuuauaaaauauacauuauaauauacauuauggccaggcacaguggcucacgccuguaauuccugcacuuuggaaggccaaggcaggcggaucaucugaggucagguguucaagaccagccuggccaacauggugaaaccccgucucuacuaaaaauacaaaaauuagccaggcgugguggcgggcuccaccagcuacucgggagguugaggcaagacaauugcuugaaugcgggaggcggagguugcagugagcugagaccacgccauugcacuccaaccugggcaacaagagugaaacuccgucucaaauaaucauaaccauaauauacauuguuauauauauauacaccauguuaugauauauauacucuauauggugcauacaauauguucaacguacauauaaaaauuauaccauacauaauaagaguauauuagaaucauacccauugguuaaggaugucuuugguauacuagagggaaaaaauggugcagaaaauauagaguacaauccaauuuuguaaacacauauacaaaaaccauauguacaguaaacacaaaaagauuauauuagucaggagaaugcaaaucaaaacacauuccaguguuugaacacccugauuacagccagugcaggggcaaauauccacccuggccacauucauagugacccuggggauuuuuugaccuuuucaguaauuaaucuggccagugcccuauuaucuaacacuaccuuuuuuggguaauguguuuuccaagagucacucuauaguacaugacaggugcaaugagaaacucgaaauuaaguuauuuuuuuuaaaagagacagggucuugcgauguugccgaggcuacacucaaacuccugucucagccuccugaguagcugggaauacaagcacgcaccaccaugccuggcuuaaaacugaaaauuacagccgggcacggugggauuuauuauuuguuguuaacuguaucaaaugcugauuuuuuuuuuuuuuugauacaagagucucacucuguggauuaggcuggagugcaguggcacaaucuuggcucacugcaaacucugccuccuggguucaagcgauucucccgccucagccuccugaguugcugggacaacaggcacacgccaccaugcccggcuaauuuuuguauuuuuaguagagacgggguuucaccauguuggccaggcugguuucaaacuccugaccucaggugauccaccugccucagccucccaaagugcugagauuacaaacaugagccacugcucccagccucaaaugcuaaaugcuaaauuaugauuagcguuuaaugacaauaaauauaugugaccuuuuucacauccaagauaucagauacucugaauucuagccagacacuacccaggcacucuggguucaaaaucccugaucaagaagaaagcagaggcugguacaaguuuagcaaauuuugucucaggguuggaugguagccaucaaaagggcucagggaccagacguccuggcuucugccugcagucccagcuacuugggaggcugaggcggucagauuauuugagcccaggaguucaagguuacucuaagcuaugauugcaucacugcauuccagccugggugacagagcaagacccugccaaaaaaaaaaaagugauuagggagaccggagauuuucaccaguguacucccaaguucugcuuuguauuuuaaggagguuacuuuaaaaguauacaauacaggagagcaccgguuggaaagggcaagaaauguuuagcacuucccucaagggacuggggguugggagggcggauaaacuuccuuuaauuuuagggauggaaaaaagcuuguugauuugcauugccuuggcuugugacugccaucuuuucauauguuuaucugcuugcauuuccuuugugguguauuaccuuuucaacacuggcagccuguucuuaucggcgggguggggcggcggcggggggucgguguguguguuuuucugaauuugcuggggggauuauggacuucucuuuucuucuuuuuuuuuuuuuuaaauaagaacaauuacuagucccucaccucagucucuauuaucugaccucugaggccacccaaaguuuggugugguaucucucacaacguacaggugacuuuuguguuuuugcuuuuuuuuuugagaucucacucucgcccagcguggcaagcaguggugugaucacuguucgcuggucacaaacuccagggaccaagugauccucucaccucagucuccugaggagcugguauuacaggcaugcuaccauaccaagauaaagugccugguuuuuaugggugcaugggaggacaauaaaggagaaugccaacuucgacuucuaguuaguacgucucucuccuuggguauggggacauuuacuuuuuuuuaauagcuuuauacuuuuaacacuauuuucuuuuuuucaauaggccauuuguaaucuuccaguuauauaugcacaccucacucuucuaugugugacaugccauauuuugaacauauuuugguucaauaaguaauucccucagcagugggcauucaaguaauuuacaggguuuuguuuuguuuuguuuuguuuucuucuguuuuugagacagagucucacugucgcccaggcugaagugcagguggcacaaucucagcucacugcaacccccgcuucccagguucaagugauucuccugccucagccucccgaguagcugggacuacaagcgugcaccacugcacccagcuaauuuuuguauuuuuagggauggggcuucaccauguuggccaggcuggucuccagcuccagaccucaggugauccgcccaccucggccucccaaagugcugggcugggugcgguggcucaagccuguaaucccagcaccuuucggggcagcaggagcacuugaggccaggaauuugagaccagccugugcaacauagcaaaaccaucucuaaaaaacuuuuuuagauaauaaaaaauuuggaauauaugagcuucuuaaccuacuacuaaacaagauugaguagcaggacuaaacuauauauauauauauauauauauauauauauauauaauuuauuuuuuuugagagggcgucucacucuugcccaggcuggagugaaauggcaggaucucggcucacugcaaccuccaccucccagguucaagcgauucuccugccucagccucccacguagcugggacuacaggagcgugccaccaugcccagcuaauuuugguacuuuuuaguagagaugggguuucgccauguuggccagacuggucucgaacugcugaccuuaagugaucuggccuccucaaccucccaaagugcugggauuacaggugugagccaccacaccuggcccuaccuuuuaaucuugaaguagugagaaugcaaaaccugcaacaacuguuaugugaaacaaaaugugguuucuagcgaugacgaacuguggguucugcuaauagcaccagacugcaaaaggguccugacccacacuagauuauaaguagggcucauuucuuuaucagacccaaggucauuucccuuguuucacucuaaaauaccccuccccaguccaggcgcagugacucacgccuguaaucccaucacuuuaggagauggagguggaaggaucaccugaggucaggagcucgagaccacccuggccgaauggcaaaaccccgucucuacuaaaaauacaaaaauuagccggguauaauggcaggcgccuguaaucccagcuacuugggaggcugagggaguagaaucgcuugaacccaggaggcguagguugcagugagcggagauggcaccauugcacuccagccugggcgacaagagcgaaacuccgucucaaaaaaugaaauaccccaccccaaccccacccgcacacuuacccgccacuaauccuaccccuaauccacuaaacuacuuaccaagucucagcaguucauccgccucuguaccuucgcugggaagacgaacuccgcagagcaggacucgggucuacucuaagcugugccuuggugccuagaauucaagucaaguucauaacaccaaaguuuaagguuuauuuaauguagaaaaucaccuuauauugaagacugggaaaaaaaagcacuuaucuaugcauguguuugcuuaaaaaggcacacacaauuagcagagucugggguguaagucgggagagggcugcagggaaugggaggacccagagguggaucugaggaggccagggaggggccggagagaaugguuucuucuuugugagaguuggggucuauuauuauggaaggcacgcuuuccuuuugcaauuugaacaagaauucgauuugccuaacaaucggaggaaauugaagaaaaugcaaaaguuauuacuuccaaaucaauuuuuccagucacauaauuaaacacuuuuuuuuuuuuuugagacggaguuucgcucugccgcccaggcuggaguguaguggcccgaucucggcucacugcaaccuccgccuccccgguucaagcgauucuccugccucggccucccuaguagcugggacuacaggcgcgagccaacacacccggcuaauuuuguauuuuugguagagacgggguuucccaaguuggccaggauggucucgaucuccugaccucgugauccgcccccgccucggccucccaaagugcuggaaaauaacacgcccggcccuccaucuuuuuuuauuugagacaguuucgccccuguugcccagucuggagcgcaauggcgcgaucucgucucagugcaaccucugccucucggguucaagcgauucuccugccucagccuccugaguagcuaggauuacaggcaugcgccaccacgccuggcuaauuuuguauuuuuaguagagacgagguuucuccauguuggucaggauggucucgaacuccgaccucaggugauccgcccgccucggcuucccaaagugcugggauuacaggcgugagccacugcucccggccccuccauccuuuuucuaaagcuaggacuugucaagcaccaccucauuuucuugacuuuauuuuuucuucacagaacuacuuucauguuuccaauuuggggauagauaagucuuaggagaguuuuuuucucauugcgccacggacaguaagggaaagagcagggagucaagugagggggccaacugccugccccuacccgggccccacgcacgcacccggaucagccuugccuggggcaccucgggccucacguaccugggccagccuuacccggggcaccccgcgcccuucgcgccuggaccagccuuauccggggcacccuggaccucacgcuccuggaccagccuuacuuggggcgcugcggaccccacgcgccuagaccagccuuacccggggcaccccggaccccacgccccuggaccagccuuacccggggcaccccggaccccacgcgccuggcccagccuuacccggcgcgccccggaccccacgcgccugggccagccuuacccagggcacgccgggccccaugcacccgggccagccuuaccuggcgaaaaaggaauccgccuggacgacugaggagcgaacaaagugaggauggagccuuguaacuaaggacugagaggauucccgaucucuggggcuggcuccuccccuccuggugugu

SEQ ID NO: 191385 - RNA, 70973 nt, Homo sapiens
cggaaggccggaggggcaguccgccgcgggggcgagcgcgcaugcgccuuccugggacccacggcaggcgcgaaucccagcggccggcgggcggcgggguaagagcaugggaucccggagguuccggaccccaggccaguguggggaggugccgggggcucggacgcgccacgagccggcgcagagcuggcgacccgucucccagcuccgcuccacucccagggacgcgacgcgaggccuccccagcccuuccugcagggucgcuugugggucgggugaggggacgcggugauagugguggcacuugcaggcuggggcgguccuggcacccuuguccuugcgguucugagggccuggcccucaagaggaggggcggagaaacgcgagaagggaucccuuucgccccauauacacgcccgggauagcugcacuccccgguguuguguccacugcgguggaaggaccuuucagacuaaaaggagcaaagucgguucugggauggggacggcgggcuuggcauuugucgagaugcaccgucagggcaaaggaggacgaaaagcgcaucuacugccugccuagcaacuucguggccaguggauggguuagaaaauuacuguuuucugauuuacagguggaaaaagucgcaaauaacccuuuuucugguuuaagcagaagagagucguuaaaagccucgcauaauaucuuuaaccacacagggcucaguaaaauuaggguaccuccccgcuucguacacacagacgcacacagcuccauucagcaaauacuucuuggguaccugccuucugcuaacacuguucuacaaguggggaacagagagcaacgacuaagacaggaggaucccugcucacagggagccuuuagucaacacauccaaguaauuuccuuuuacacuuuuuuuuuuuuuaauugagacagagucuugcucugucgcccaggcuggagugcaguggcacgaucuuggcucacugcaaccucugccucccggguucgagcgauuuuccugccucagccucacgaguagcugggauuacaggaacgcaccaccacgcccagcuaauuuuuguauuuuuaguagagaugggguuucaccauguugaccaggcuggucucgaacuccugaccucaggugauccaccugccucggccucccaaagugcugggauuacaggggugaaccacugcgcccagccccuuuuaugcuuuuuaaauuggaauauaccauauagaaaaauacuguacgcaaauuauaaguuguaacuuguuaauuuauccuaaagucaacacauuuccuaaccacuacucaaaucaagaaggaagauucacagcauuucagaacaccucucugggcaccccucccaaccaccaucccuucuuuccuccccaaagguaaccucuuuccugauuuuuaacaccauagauuaguuuugccuauuuaugaaccuuucauggaaccauaugauauguauucuuugguguccagcauuuauacugaaaauuaugugugugagauugcaccaugucaugugaaaauacaaauccuguuagugaaaagaauuaggaagcaaauugaagguaaugauacaaacaguaaggggaggaagcuuuaguaggauagucagggaugaucuuucugaggggaugauuugagauuuggcaucaaugacaaaagauuagccauuccaaucaguucuggaguuaucccgugauguuuuuauuuuaaauaagaaaauaauuagggccgggugcaguggcucacgccuguaaucccagcacuuugggagaccaaggaggguggaucaccugaggucaggaguucaagaucagccuggccaaucuggugaaaccccgucucuacuaacaauacaaaaauuagccaggcgugguggugggugccuguaaucccaacuaccugggaggcugagggaagacaaucgcuugaacccaggaggcagagguugcggugagccgauauugugccauuguacuccagccugggcaacaagagcaaagcuccaucucaaaaaaaaagaaaaaaaaacaaauaaaauaaaauaauuuuagaucauuagguggaauguaccaauuuugcccuaaauuuuuuaguugauuuauuauauuuucugaauauauuuaaaguguauccugugguuaaaaugguccaacauuuuucaaagagaagaggaaaaugucaauuuugucgauuugcuuuuuauuuuuuuuuguuugagauggaguuucgcucuuguugcccaggcuggagugcaauggugcgaucucggcucacugcaaccuucaccuccuggguugaagcgauucuccugccucagccuuccaaauagcugggaucacaggcgagcgccaccauaccuggcuaauuuuguauuuuuaguagagaugggguuucaccauguuggucaggcuggucuugaacuccugaccucaggugaucugcccaccucggcuucccaaagugcugggauuacaggcgugagccaccgcaaccggcaucaauuugcuucuuacuuuaaaaccccaaccuaaggaaaacuguaaaaaaaaaaaaaaaguaagugguuaauugaguuuuacugcuuuuguauuuuuuucucacgauuugggauuauucuuaaugauucuuaaaaaggcucauuucucuaagauggaaaguuggugugguuaaugcaaguauauuuuggaagaaaaguaaaaaccaaacuagauaaauuguuuauuggaagacuuucccaaacuaaauacaaagacaagauuccucuuucucgcuguaccaaagauaaaucaugccuuugucuacgguugugguuuuauauuuaccuguaggugaauguguucuaaauagaauugacugugucauuaucuacauauguguuguuuuucuuuucucagaaauauucccuugugagaguaaaucuuuacuauaucuuuagauguauugagucccauuuaauagggagauccaccuuuugauguauauucccaacuaaaggacuagggaauaaggaacuuaaaauaccacguuuccuucacauuccuucccacuaccccuccccucgaauucucuauccuucuacuugguuuacuggguucauuguuguagguacuguacucagcugaaucuugauaucuuuuuuuuuccccuuaggauacuucuacauagacauaaucaaguuuugacuauuuggaaaccaagcaucauuaaaauucucucaaacuccuaauugcgaagaaucgauaacauuucaagaagugauaacauuucucugaacaagaaaagaagugauugaccacguuuuaaaaguacucuggcacuggugcuguguuuucuuccccucccuaaauuugaagaacuauggagaaaugguacuugaugacaguagugguuuuaauaggacuaacaguacgauggacagugucucuuaauucuuauucagguaauacauuuuuacugguuaaaaaaaaaacgaaauuuuccuuugaauagguguuuguuuggggaaaaguuuaccauuuucugaccaguacagagaagaauuucaggccuuuuugauaugguugagaaaauacauuuaaauguccaguucuaauagaaagaauauggauaacagcuaaauagaagcaugcgcuuugugaugugagaaagcaaaaauguguucuaacagguaagaugacaaauugagaaaugauucuguauuaaacauugaagaggaaaaugagcuagcacuucaagggagggguggagucuguuuaggguagagaagcauauuacuggauuaaagggaagcgaucagugaacaagaauaaaauugggaaugagagagggggaauugauggagugugguccugguguguuggauuggcuuaaauguaacucugcagguaccuauuuagcacgucucauguucccggcacugugcuagcuucuaaaaauacaagaugaauagccaauacucagagggcccacauuuuauuuuauuuuauuuuauuuuauuuuuuugauacggagccucgcugugucgcccaggcuggaguucaguggcgcaaucuuggcucacugugaccucugccucccggguucaagcaauucuucuaccucaaccuuccgaguagcugggauuacagaugcacgcgaccaugcccagcuaauuuuugcauuuuuaguagagacgggguuucaccaugcuggccaggcuggugucgaacuccugaccucgugauccacuugccucggccucccaaagugcugggauuacaggcgugagccaccgcacccagcuagagggcccacauuuuaauaguuaaauggucacaacagagggugauaauuauaauguaggaguaugugugagguacagaguuaauagagagguaaaugaucaagaugcauuagagaaaacuucaggaaagauguuugcauucaagauuugaaggaugagucagaauuuucuaggcaaaugaaguggagaagguauuauagagugcaggaacuugugcaacagacauggugucacagagcaugguuauuauaaguauuguauuugaguugcaugaaacauaggaacaaaaaggaugaggagagagugaccagagaauagguuauacaauuagcugggcaaauuauuucguuguagaaaaauaacuuauguuagugaaaaagggucauaggaaaaagagauagguaaagagaaaaaugagacaauaauauuaauaguuguaagagcuaugauauauacacagacacauauauauacacagacacacauuuacucucuacuuacacauuuacuauauacgaagauacauauauggaaauuuauauauaugugugucuauauaguaaauguguauauacacagacacacacauauauagguauuuuaugcauaccuauauaugugugugucuguauauaguaaauguauauauacacagacauauauauggauauacacagacacacauauauauaaauaucuguauauauguguguauauagcaaauguguauguagagaauaaauguguaugugucuguguauaucguagcuuuuuuuugagaaaaaaaagcucugucacccaggcuggagugcaguggcgcaaucuuggcucacuguaaucuccgccucccaguuucaagcuauucuccugccucagccuccuaaguagcugggauuacaggugcaugccaucaugcccagcuaauuuuuguauuuuuaguagagacgagguuucaccauguuggucaggcuggucuugaacuccugaccucgugaucugccugccucggccuccugaagugcugggauuacaggcaugagccaccgugccuggccuguagcucuuacauauagauguauacacacacacauacauauauguuuuguaagacuuuuuuuuuuggagacaggguuucacuuucaucguccaggcuaaagugcaguggcacaauguuggcucauggcagccuccgccuccuuggugcagugauucugcugccucagccuaccaaguagcuggaaauacaggcgugcaccacgacgccuggcuaauuuuuguauuuuuuguagacacagggucucaccauguugcccaggcuggucuugaacuccugagcucaagugaucugccugccccagccucccaaagugcugggauuacaggugugagccacuauguccagucaauauuuuaaccagacuauaguuucucuuuucucuuaaaacauuuuuuuuuggggggaggcuaagguggguggauugccugagcucaggaguucaagaccagccugagcaacauggcaaaaccccgucucuauuaaaaauacaaaaauuagccgggcgcacaccuguaaucccagcugcuggggaggcugaggcacgagaauugcuuaagcccaggagauggagguugcagugagccaagaucaucccauuacacuuuagccugggcgacagagcaagacucugccucaaaaaaaaacaaaacaacacacuuuuuugggcuauuuuuauuuuucaauuuaauuuaauuuacauuuuuuuuuuuuuuuuuuuugagacagggucucccccuguugcccaggcuggagugcaguggcaugaucuuggcucacugcagccuugaccucuugggaccacaggcauguggcuaauugucuggcuaauuguuuugauuuuuaguaaagaugaggucucacuguguugccuaggcuggucuugaacuccugggcucgagcaauacuccugccucagccucccaaaguacugggauuauaggugugagccacugcgcccaauuuuuucaaauacucuggcuuaauauaguuucucuuuauucagcaugaauuuaaaggauuuauagaaagaacuuguaagaacuacuauauuuugaguaugaguauuuucuuuaguauuuaccacaaccacugaagacagguaauaucuucgauuuacaaauggaaaaugagacaaccaauaaaugacaacugggauucaaauauaguuguauuuaauuccacaaucagugcucuuaugacugugcucuguggcuucugaaugaguucgaggaauauggaggaaguaaaaucacuuaaauguagcaguugacuugggcucaaaucuuagcucuuucaccuguuaguugccugaucuuggggaauuuauuuaaucuccuugagccucuucuaucaagugggguauuaauacauacuuuaagaggguucuuggccgggccguggcucacgccuguaaucccagcacuuugggaggccgaagugggccgaucacaugaggucaggaguucgagaccagcguggccaacacagugaaaccccgucucuacuaaaaauacaaaaauuagccgggugugguggcgggugccuguagucccagcuauuccggaggaugaggcacgagaauugcuugaaccuggaaggcagagguugcagugagccgagaucacgccacugcaccccacccugggugacagagcaagacucugucuccaaaaaaaaaaaaggauucuugugaggauugagauaauauguauaaauuauguuuucuuuuuuaauagugcagggcuauaacuagcacauuuauaguucauaacucaucucauuugauccucacaucagaucauuuagcccuaaaaugucugcuaugcaggaaaaauaggucuugcuggugauuaagucuuuaggccuggucuuuagggugaccaagaauaauaaaugguaucuuccuuagagaaguuuacagucuaguggauaagguggacauguaaauacauacuacauaaaaauguaggcugagcacaguggcucaugcuuguaauucuagcgcuuugggaggcugaggcagggggaucacuugaggucaggaguuccagaccagccuagccaacauggugaaacccccuuuacaaaaagaaaaauuaggcaugauggcacaugccuguaguccuagcuacucgggccucugagguggguggauugcuugaacccgggaggcggagguugcagugagccagagauggugccacugcacuucagccugggugacagagggagacuccauuaaaaaaaaaauguagugugauauaggcaaauacuuuguuucuuuucuuuuucuuuuuucucccuagacugagucuugcucuguugcccaggcuggagggcaauggugcaaucucggcucacuacaauauccguuuccuggguucaagcaauucuccugccucagcuucccgaguagcugggauuuacaggcaugugccaccacccccggcauuuuuuuuuuuuuuuuuuuuuuuuuuuccaguagagacaggauuuccccauguuugccagccuggucucaaacuccugaccuuaggugauccgcccuccuuggccucccaaagugcugggauuacaggcgugagccaccacgccuggcccauuucuuuuacuuccuuaaaaugccuuugucagguuugauaucaagguuaagcuagccucauaaaaugaauuagggaguauucucucuuuuuguaaaaucuggaauaguauguaagcuuggaauuguuuguuccuuagauacuugguagaacuugauaguaaagguauuugggccuggaauuuucuuuguaaggaaaauguuuagugauuuaauuuguuuauugguuauaggaccauuuaggcucucucuuuuuucucgaauuauuuuuguaauuuauauuuuucuagaaauguuuccauuucaccuaaguuuuaaaauguauugacauaaaauuauucauaauguuuucuuaccuuuuacauuuucugcuguaucaaugauuauaguuccuuuuuuauuucuuauauaguuagugguguuucauuuuuuaaaacaaucagucuuauuagggguuuauuaauuuuauuaguacagucaugcauuguuuaaugauggggauucauucugagaaaugcgucaauuggcaguuuagucauuguucaaccauuguagagugacuuacaccaacucagauuguacagccuacuacaccuaggcuguacauuauagccuauugcuccuaggcuacaaaccuauacaacauguuacuguacugaauacuguaggcaguuguagcacaugguaaguauuuguguauuuaaacauaucuaaacauagauaaggugcaguuaaaauacaguaugauuaucuuaugggaccaucauuguuuauacaguucguuguugacugagaugucauuauugugguacauagccguauuuuucaaauaacuaaucugagcuuugcccauucucucagugauauccuugggguuguucuuuuuuaaauuuacuaaauuggaugcuuuagcucuuaaguuucagucucuguaacacuaucauuuaagcuauacauuuucuuuagaguaccaucccacaaguaauauuuucuaauuucuaaugugacaucuacuuugacccaugaguuauuuagaauuauguuuaaaauuuuuuaaauauuuaggcuuuaaaaauuaccuuuuugauauuuuaaauuuaaguagaugguagaaagagaaucuuucuguguacuacuaauucuuugaaaagcauugaaacuugaccuaguauguaaucagcuuuuguaaauguucugugugugcuugaaaagaauguguaaucucuaguuuaauauucugcauauauucaauaacccaauauuauuguuuugauacaaucguuuuuuauauucuuacugauauuuuaccaauugaucuaccaguuauuaagagagcuguaguuucucuuuguaguuuugucaacuuguauguauauauuuuguaucuauauuacuaggugauuuagaauuguuuuucuuuuuuuuuugagauggaaucucacucuguugcccaggcuggacggcacaaucucagcuuacugcaaccucugccucccggguucaagggauucuccugccucagccucccuaguggcugggauuacaggcgugcgcugccacacccagcuaauuuuugcauuuuuaguagagacgggguuucaccauguuggccaggcuggucuugaacuccugaucucaggugauccaccaccucggccucccaaaguggugguauuaacagguagaauuuuuuugugugugaccugaauuucauaucacuguugcuucccuguuuguuuacaguaaugcuuuuuuguuaaaguuuguuuccucuaaaauuaauauagccauaauaguuuucuuuaguuugauuuuugcuuguuauaucuuuuucuguccuuuuauucuuuacuguauguuuagauaugucuaagcaauuuccuuccgcaauugcuguuucccuucucuauugguuugaaagcuauauuuuuauuuucuucuuucaggacuuaucuggaaauuuucaguugcauauuuaacuuaacaaagccuaaaguuaauauuuauauccucuugaacaaugcaaagacuuuagaauguuuuaauucugguuacagauccucacuucccaaguuaaaauguuacugucuaggauuuuguuucuuccaugauuuuuaauccuauaaauuaggcauuaaugacuuguuuuguacaguuaauauugguuuauuauuuauuauuuauuuauuuuuagagaugggaucucacucuauugcccaagcucaaguacaguggcaugaccauaguucauugcagccuugacuuccugggcucagaggauccuccugcuccagccuccccaguagcuggaacuacaggugcuugccaccacacccagcuaaauauauguuuuuuuauuuuuaguagacauaagguccugcuguguugcccaagcugggcucaaacuccugggcucaagggggauccucccaccuuggccucccgaagugcugggaugacagguugugagccacugugcccugcauauuuauuuaguuuuacccuuguguuuagcauuuucuguucacccuucuuacauauuguaucuuucuuugagaucauuuuuuucuuccugaaguacaccuuugggaguuuuuuuuggugagagucuguugguggcaaacccaguuuuugucugaaaaugccuuuauuuggcuuucagucuuaaaguuuugcuggguauggaauuguuuugaugguuguuuucucuuaguauuuugaaaauaccauugucuuuuaauuuguguugauguuuggacaucagcugucauuuuaacuguuauucuuuuguagguaauuugccuuuccuuucuugcugcaguuucacuaugauauaucuuagugaauauuaaaacauuugucauccuaggauuuucugugauuucugucucuaaggaaugguauuuucugucuguucuagaaacuuuucagcuacugugucuucuuauuuuucuuccuuuuagaacucugauuagauauauguuggaucuuugguuaggaauuccacagauaguauaggccauucacuaugugccaagggcuggugaugcugcagagaauaaaauagacaauaaucucuuccccucauugacuuuauaguucucaguuaucucuucaaauauuguaucuuccucauuuuuauucuuguacaacucuuguuagauguauguugggucuuuucauucugucuucuguguuucauaaucucuuguauuuuccaucucgggguuucuucacagugcuuccuuuauaaucaucaaauuugguuuccuguucauuaguuuuuagcugugcuuaauuuguuuguuuuuuuuuuuuaacuccccauugaauguuaagguuucaguuauuauauuuuuuauuuccagaaguucucuuugguuccuuuuuagaucuugaucauuucugauagucucuuguuccuucagcauacuuucaaggucuucuuuuguauuguuaagcaguugaaccaugcuuauuuuauguuucuuaucuaaaaauucucguaucugcauucugauuucauaguuuuuuguuucuccugacccuugcucaugguauuuuguuucuucaugagcuuagugauuuuuaauaaaauagugaguuuauguaauuuggaacuuuuaucugugggaauucuuugaggcuugaguuuccugugcauuuuuccacauaggguuuauguugcuuccugguaggcaccuggggcacuauuaacaaaaaucaaacuaaauuagcaacuuaaaguuucuuugggucauguacuuggugugaauucaggccccaaccugggcaaaugcaggcauaugguuaggaguuuucauaggacucuuuuucguuuuuccuguacuaccaggagccaaggccgagaugaguacuaucuucacuaucucccuaaaggcauuguauuuuaaauuguaguagaggguucucugaccuugaauuccuaccuguucaggucccaggcuuugccuccuuacugacugcacagggcuccugguagccaggcuauugaccaccagagaucauuggauacccucaaggcaaaugcuuacuucucugaaucuacacuuugcuguuguuucuggggccucuaaggaauucuuucauguuacugcuaguucagccauauauuaaaauuauauauuuauaaaaguaggauacguaauacuauauuauuaauuauauaaaaacaaauauaaaucauacauuauauauaaaacauauauaaaacauuauauuauauacauuauuuauucaauguuaacuaggauuuuuacuggagauguuuuuggacccuuugucuggcauauugcuggaaaccgaagugccaucuauauuuuuaaaagcuccauaaguuauucuaguguuuacagaggguuaauagacaugaugguugaagccagggguugaggggcaaaagcaacagguuuaagaguugcuuuugccccucaacaaaagcaacuuuugugcaagaagaaaacagauuuaaccacuaaucaucuccagagagaagggagaaugauuaaaggagacugagaagaaacuguguaguaggcuuagcaucuggagaguuuguuuuucuagaagccaagaaaccagacaacuuuacaaaaugaggaccggccaacagugucaagcuauagacaugucaaaaaggaugaaaauuuaaaauagacaagggaucuauaggagaccaugugaaccuccugguugccagacuguaaugaacugaggacugaaugguaguuaucaaauggacauagcaacuuucaggacguuuguucgugaacggaagaaaggaaguaguuugguggcugaagugggggaagaagggcugaggaaagguccaauuagaaguuguuacauaaaauauguaacuuauaauauuacuuuuaguccauaauugguccauuggaaagucauccccuuuucugaauuugguacuaauucauggugauuauuuaguuugcaaucuuuuuuccaguuuuccuuuugucuccuaauugugacacauauauuauuuucucguuuauuuuaaggugaaguugaaaagaacuaaaaucagaguauaggauaaaauacuacaaauuuuuaaaugauacuauuucaguauugcugguauauauaaucaaaugcuuaaugggaauucaggaggggacaauucauccaauacuucucuauuccugugacuuacauauauuacuuaaccugacauuucuuucaugaacugaauuuacucaauuacuuuucucaucuggaaaagaaaacaggacuccagcuacuuauuuuaaacccugcucuuaaauugucccuaggaaaaucaacagaaucagauuccuuuuggguuacuauauaagaaaaauauuguuauugcacauuaguagauuauuugaaggcaucuuguagauggcuaugauauauuuuugucauuuuucagauaaggaaaguaaauaugcuaaacauuaagaaaaaugguggcugggcccaguggcucacaccuguaaucccagcacuuugagaggccgaggcagguggauugcuugagcccaaaaguuugaguccagccugggcaauacggggaaaccuugucuuuauaaaaaauacaaaaauuggccaggcgcgguggcucacgccuguaaucccagcacuuugggaggccgaggcaggcggaucaugaggucaggagaucaagaccauccuggcuaacacggugaaaccccgucucuacuaaaaauacaaaaaauuagcugugcgugguggcgggcgccuguagucccagcuacuagggaggcugaggcaggagaauggcaugaacccaggaggcggagcuugcagugagcugagaucucaccacugcacuccagccugggcgacagagcgagaccgucucaaaagacaaaaacaaauacaaaaacaaaaacaaaaccccaaaauuaggugggcaugguggcgcaugccuguagucccagcuacugauagugggggcugaggggggaucccuugagcccagaaggucaaggccgcagugagccgugaucacaccacuggacuccagccugggugacagaacaagacccuguuuaaaagaaaagaaaagaaggaagggaggggaggggaggggaggggagaggauuccauuauagaacucaacuccaucauaaagaauauaacauuuuuagcauucacgugugagggacuuaaugugucauuggagguugggagaauuaaugaauaacaucugugauucugcugagauauuguuccuucuguugauuaaaauacuauuuuugguauccuaauuuguauuguuuuguuuuuaagaagugaguuuucacuauguugcccaagcugcaguagagugacuauuuacaggaugugaucaucaggcacuguaaccuugggcuccuggccucaagugguccucccaccuagccucccaauagaaaugcaucauuuuuauguauuguaaaauaucucagcuuguaccacugcucccagcucauaauuucuuuuuuuguuguuuuuuaaaaguuuuuuugcuuuuaauuuguauggguacauaguagauguacauauucaugggucacaugagauuuuuuuuuuaaaaauuuuauuuauauuuuuauuauuuuaaauuuuuauuuuauuauuauuuuuugaaauggagucuugcugugucgcccagaguggagugcaguggugccaucucgacuuacugcaaccucugccuccccgguucaagcaauucuucugucucagccucccagguagcugggacuacaagcaugagccaccacgcccagcuaauuuuuuguauuuuuaguauagaugggguuuuaccauguugaccagacuggucucgaacuccugacuucaagugaucugcccgccucagcgcccagcugauuauuuauuauuuauuauuuuuuugagacaagagccucgcucugucacccaggcuggagugcagugguacggccuuggcucauugcaacucugccucccgaguucaagcaguucuccugccucagccuccugaguagcuaggauuauaggcacgugccaccaugccuggcuaaguuuuuuuuuguuuguuuuuuuuuguuuuuuuuuuuuuguuuuuuuuuuuuuugagacggagucuggcucugucgcccaggcuggagugcaguagcgcgaucucggcucacugcaagcucugccucccggguucaugccauucuccugccucagccucccgaguagcugggacuacaggugccugccaccacacccagcucauuuuuuuguauuuuuauuagagacaggguuucaccauguuagccaggauggucucgagcuccugaccucaugauccgcccgucucggccucccaaagugcugggauuacaggcgugagccaccgcaccuggccuaaguuuuuguauuuuuagcagagucgggguuuuaccauguuggccaggcuggucucaaacuccugaccucaggagauccaccugccuuggccucccaaagugcagggauuacaggcgugagccaccaugcccagccuauuuuuauuuuuuugagauagagucucgcuccauugcccugugcuccagcacaggcuggagugcaguugugaaaucuuagcucacuguagccucugucucuggguucaagugauucuccugccucagccucccaaguagcugggauuacaggugcucaccaccaugccuagcuaauuuuuuuuguauuuuuaguagagaugggguuucaucauguuguccaggcuggucuugaacuccuggcgaucugcccaccuuggccucccaaagugcuaggauuacaggcaugagguaccgugccuggccauuauuuuauuuuuuagauacaguaucucacuaugucacccaggcuggaguacaguggugccaucaugguucacugcagccuugauccccugggcucaagugauccuccuaccucagccuuacagguagccaggacuauaggcacauaccacugcaccuggcuaacaugaaauguuuugauacaagcauacaauguguaauaaucacauuaggguaaaugagguauucauuaccucaagcauuuauucuuuguauuauaaacauuccauuuauacuuucaguuauuuaaaaaugguaaaauaaauuauuguugacugcagucacccuguugagcuaucaaauacuagaucuuauucauuccguguaauuauauuuuugaauccauuaaucuucccuaccccacccacucuucucagccucugguaaccauaauucuguucuucaucuccaagaguucaauuguuucaauuuuuagcucccacuaaugagugagaauauugaaaguuugucuuucugugccuggcuuguuucacuuaacaucaugaccuccaguuccagcuauguuguugcaagugacaggaucucauucuuuuuuauggcugaauccauugcauauacauuuuauuuauucauucgucugcugauggacacuuagguugcuugcgaaucuuggcuauugugaacggugcugcaauaaacauaagaguggagcuaucuuuucaauauauggauuuccuuuauugccugucguuuggauaaaagccauuuuaccugggugagaugaugucucauuguaguuuugauuugcauuucucugaucaucagugauguugagcacuuuuucauauuccuguuugccauuuguaugucuucuuuugaaaaauguguauucagaucuuuugcccauuuuuuaauuggguuauuuaauuuuuuuuccuauugaguugcuugaauuccuuauauauucugguuguuaaucccuugucagauggguaguuugcgcauauuuucucccauucuguggguucugucuuuguugauugcuuccuuugcugugcagaagcuuuuaaacuucauggaucccauuugcccguuuuugcuuugguugcuugugcuuguagaguauuacucaagaaauuuuugcccagaccaauguccuagagaguuuccccaguguuuucuuggagcaguuucauagugugaggucguauauuuaagucuuuaauccauuuugauuugauuuuuguaucugaugagagauagggguuuaguuucauuuucugcauauagauauccaauuuucccccaaagagacucucuuuuccccaguguauguucuuggcaccuuugucaaaaaugaguucacuguagauguguguauuuguuucuggguucucuauucuguuccauggucuagguaucuguuuuuaugccaguaccaugcuguuuugguuacuguagcucuguaguaaaauugaagucaguguaauguaauuccuccaguuuuguucuuuuugcuuaggauaguuuugacuauuuggggucuuuugugguuccauauaaauuuuaggauuauuuuuucuauuucugugaggaauaucauugguaguuugauggagauugcauugaaucuguagauugcuuuggguagaauggacauuuaaugauauugauucuuccaauccaugaacauggaauauuuucccauuuuuuugaauuucuuucaucaguguucuauaguuuuuuauuaagaucuuuuacuucuucuuuuuuuuuuuuuuuuuuuuuuuuuuuuuuuuugagacagagucucgcucugucacccaggcuggagugcaauggcaugaucuuggcucacggcaaccucuaccucccagguuaaagcaauucuccugccucagucuccugaguagcugggauuauaggcgcaugccaccaugcccgacaaauuuuuguauuauuuuuauuuuuuuuuaguagaaacgggguuucaccauguuggccaggcuggucuugaacuccugaccuugugaucugcccaucucagccucccaaagugcuggcauuacaggcgugagccaccacgcccggccuugagccacugugcuuggccugaucuuuuauucuuuaguuaauuccuagguauuuaauuuuauuuguggcuauuguaaaugagauuuuucaaauuucuuuuucaaauuguucaccauuggcauacagaaguacuagugauuuuuguauguugauuuuuuaugcugugacuuuacugaguuuguuuuacaguucuaauaguuuuuuuaugguguuuuaagguuuuuccaaauauaaaauuauaucaucugcaaacaaggauaauuugacuucuuccuuuccaguuugggugaccuuuauuucuuucucuugucugauugcgcuagcuaagacuaacagcacuauguugaauaacaguugugaaagugggcauucuuuuguuccaaaucuuagaggaaaggcuuucaguuuuuccccauucaguaugauacuagcugugggucugucauguauggcuuuuauuguguugagguauguuuuuucuaaacucaauuuuuugaggguuugugucaggaagggguguggaauuguaucagauacuuuuucagcaucaaccaaaauggucauaugguuucuguccuucauuguguugauuugauguaccacauugauugauuugcauauguugagccauucuugcauccgugggauuuaucuguaggguuauggugaaugaucuuuuuaaugcacuguugauuacaguuugcuaguauuuuguuguggauuuuugcaucaauguucaucagggauauuggcuuguaguuuuuuuuucuuuuuuuaauaugucuuucucugguguuguuauuaggaguacugggcucguagaaugaguuuggaaguauucucucuauuuuuuggaauaguuugaauaggacugauauuaggauuuuucuuuaaauguuuagugaaauucaacagugaugccaucagguucuaggcuuuucuuugcugggagacuuuuaauuacugcuuugaugucauugcuuguuauugaucuguucagguuuuggauuucuuccugguucagucuugguagguuguacgugucuaggaauuuaucaguuucuucuaggcuguccaguuuuuuggcauauaauugcucauaguagucucuggugauccuuugaauuucugcaguauugguuguaaugucuccucuuuaaucucugauuuuauuuauuuaagucuucuuucuuuuuuuccuagucuggcuaaaagugucucaauuuuguuuaucuuuucgaaaaccaacuuuuuguuuuguugaucuuucaacuucguuuauuucugcucugaucuuuacuauuucuucuacuaauuuucuguuuauuuugcuguagcuuuucuaguucuuuaagauguaucauuagguuguuuauuugaaguuuuucuacuuuuuugacauaggcacuuauugcuauaaacuuuccucuuaguacuacuuucauguaucccauagguuuugguauguuguguuuccauuuucauuuguuugaagaaauuuuuaaauuuucuucuuaauuucuucguuggcacacugggcauucaggaucauauugauuaauuuccauguguuugcacuguuuccaaaauuccucuuguuauugauuucuaguuuuauuccauugugguuagaaaggauaccugauaugauaucaguguuuugaauuuuuuaagacuuguuuguggucuaucguauggucuaucugugugccaaggagaagaauguguauauucucuagccauuggaugaaauguuguauaaauaucugauagguccacuuaguuuacacugcagauuaagucugauguuucuuuguugauuuucugucuggaugauuuguccagugcugaaauugacaucucuagcuauuacccuauuggagacacucucuuuagcucuaauaauauuuguuuuauauaucuaggugcuccagugcuggaugcauauauauuuaccauuguuauaucucuugcugaauugacccguuugucauuauauaaugaccuucuuugucuuucucuuuuuuuuuuuuuuuuuuuuuuuuuuugagacagagucuugcucuguugcccaggcuggagugcaguggugugaucucggcucacugcaaccuccugccuccagaguucaagugauucuccugccucagccucccaaguagugggacuacaggugugcaccaccacgcccagcuaauuuuuguauuuuuagaaaagacgagguuuugccguguuggccaggcuggucuugaacuccugaccucaggcaauccgccugccucagccugccaaaguacugggauuagaggugugagccaccgugcccagcuucuuugucucuuuuuauagcuuuugucuugaaaucuguuuugucugauguaaguauggcuacuccugcucuuuuugguuuccauuugcauggaauaucuuuuuccauccuuuuauuuucagucuaugugugucuuuauaaaugaaguauguuucuuguaggcaacagacuguucaagcgauucucuugccucagccuguggaguagcugugauuacaggugcacgccaccaugcccggcuauuuuuuuuguauuuuuaguagagacgaguuuucaccauguuggccacgcuggucucaaacuucugaccucaagugaucugcccaccuuggccucccaaagugcugggauuacaggcaugagccaccgcgccuggccuaagugaggugaucuuggcucacuggaaccuccgccuuccagacucagguuguccuuucaccucagccucccaaguagcugagacuacaggcacaugccaccaugcccagcuaauuuuuuguauuuuuguagagauggggguuuggccauguuccccaggcuggcaaauaacaucuuauaacucauuauuuuaagcuaaugauuacuuaauacugauuguaaaaacuaacaaauaagcaaagagaaaauuaacaaaaacucuacacuuuauuccccugcuuuuuaacuuuuuauuguuucuauuuauauuuuauucugugucuugaaaaguuaugguuauuauuuuugauagguucaucuuuuagucuuucuacucaagauauggguaguuuacaaaccuuaaugacaguguuaaaauacuuuguguacuuacuauuaccagugaguuuuguaccuucagaugauuucuuauugcuuauuaaugcccuuuucuuucugguugaagaacucccuuuagcauuucuugcaggauaggucuaguguugaugaaaucccucagcguuuuugucugggaaaaucuuuauaucuccuucauguuugacagguauuuuugcuggauauacuauucuaggauaaaagcuuuuuuuuuccuucaguacuuuaaauauguugugccauucucuucuggccuguguggcuuucuacugagaagucugcugccagauguauuggaacuccuuuguaugcuguuucuuucuucuugcugcuuuuaggauucuuucuuuauccuuaaccuuugggaguuugacuguuaaaaagucuugagguagucuuauuugcauuaaaucugcuugguguucuauaaccuucuuguacuugaauauugguaucuuucucuagguuuggaauguucucaguuauuaucccuuugaauaaacuuucuacccugaucucucucucucucucuauuaccucuuuaaggccagaagcucuuagauuuguccauuugaggcuaucuuauagaucuucuaggcaugcuucuuuugucauucuuauuuuucuuuaguuuccacugacuguguauuuucaaauagccugccuuugagcuuacuaauucuuucuuuugcuugaucaauucugcuguugagagacucugaugcauuccacaguaugucaauugaauuuuuuagcaccagaauuucugcuugauuuuaacaaauuauuuccaucucuguuaaggauagaauucuaaauuccuucucuguuauaucuugaauuuuuugaguuucuucaaaacaguuauuuugaaugcucuguuugaaaggucacauaccucuaucacucugagauugguugcuggugccuuauuaaguuccuuuggugagguccuguuuuucuggauggucuuaaugcuuguggauauucaucuggauauugauaaguuagguauuuauuguagucuucacagucugggcuuauuuauacccauccuucuugggaaggcuuuccaaguauucaaagggaguugaguguugucauccauggucgcugcagccauauuugcauuagggggcaacccaagcccaguuacacugugacucuugcaggcucauagagguaccacuuugauggucuuggguaacaaaucugagagaauucuuuggauuaccagacaaagacucuuguucuuuucccuuacuuucccccaaagaaauggagucugucucuccauguugagcugaugggagcuggaggaggggugacaaaaguacccguguggccaucacauugggacugugcuacaucagaccugaagcuagcacagcacugggucuuacccaaggccugcggcagucacugccugauuccugccgauguucacucaaggcccaaggguucuucaucagcagguauugaauccagccaggcuuaugcccuuuccuuaggguggcagcuuccccaguccacagccuauguugggucagaaaugcugucugggagccaaggccuggaguuaggaaccuuaaucaggagccaggccuggaauccgggacuccaggagucugccuggugcugugcuccacuguggccugaagcuagggccuggaaugugggccucaggacucugccugguaccuuauuuugcuguggcagagcugguauuuaaguugcaagacaaaguccucuuuuacucuccagucuccuuuccuuaagcagaaggcauccuuaagccauacugccugggguugagggaggggugaugcaagcacucccuuggcugccuuagcuggugucuuacuaggucaugugcacccccaguccacugcgucugaguccaacacagcaccaggacuugccuaggaaguccuuguggucuaaacugccuuucaaauuuauuuaagaccccagagugcuuuagccuacaguggugugccuaucuggaacucagguuccuacugcugggauggaccauucccuucuggcuaggacuagccuaaaugcucccuccauagguaccagcugaauucugcccuguguugcuuucugcugugacaagcaagacugaguuccagugcagagucccauagucacugcacucucccuccccaaacacacagauucucucuucaugccaugcagcugcugcuggggaauggagaagugauguugacaauucaauacugucuuucuuacccucuucagugccucuuuccuugauaugauauuaaaaccagguacugugauugcucaacugauuuugauucuuaugaagguacuuucuuguggggauagcuguugaauuugguguuccugccagggggacaguugcuggaggguucuauuuggccauccugcucugccuccucugucauaguuuguuuuuuaauaugcuuauuuuaguuugcuuuugguuuaucuuguuuuaagauuguaauuaagaagcacuuacaggagaggaaaaauacauuuuccuucuguccuucuagguucucuaaugugcccguguaacaaaagacagauuaacaagacaaaaacauaacgcauuuauugaauauaaguuugaaaccuucagaaggaaaugaagacccgaagaaacaguuaaaccugaguguuuuuauacuaacuuugaugaagaggggagaguuguagaaaaugugauaggacaauagaguaugagucaagaguaguaaacgggaaacuuggcaaaaccuguucauuuugguuccucuggguauccuuuuaccuuuggagauaaagaugcuucuuuucucuggguauagggagggcaccucucacaugaggauuuuaugaucugcuucaggggauggucaguucuuccugcaccugcccuuccucagauuccuuuagcuuaaaauauucaauaugccaaggugccagauuuugaaguugaauguucagaacuccaucacacucaaguguggaaacucagguuagcuugcuuaguauuaaugcauuauuccuccuuuggaaauguauguauuauuuaggaaaauggcuuauguauauuauuguaauuugauuuuuucugaaaugucuaucccuuacgcuuuuagagaugcuuauauacauuaauuuucagagaccuaaaaauauugaauaaauacuguuuguugcuuuuaaacaauccauggggaguagaaaaauuuugauuuuaguauugauuguuuaccguuucuuguagagauucacaguuccucuauacuugauccaaaguguuaccagugucuuuaaggcaaauggcaacacuugagcuggggaaaguuauuuuauuuuaauaacuuuuuuuuuccccaaagcugcauuggcuguuugaugagaaaguuguagagaaucaguuuuuguagcacaucauuacuaaaguaugacuguguuccauuuaacugcuuaguuucuuucuacuuacccauugcuauggaaaauauaaaaggaugauuuuuuuuuuuuuucuucagacaagucuugcucugucacccaggcuggagugcaauggcaugaucucggcucacugcaaccucugccucccagguucaguugauucuucugccucagccucccaaguagcugggauuacaggcaugugccaccacacccaauuaauuuuuguauuuuuaguagagacgggguuucaccauguuggucaggcuggucuugaacuccugaacucaggugaucugcccaccuuggccucccaaagugcugugauuacagacauaagccaccacacccugccaaaaggaagauuuuauuauggaaaauuuuagccaaauucucuucucuaaaauguuuaaaauuuuaauuuaaaggcaguuaguagguauuguuaacaacaaaacuacuuguuuuuaaaauucaaacauaauuaugaauaguucaacaauuaauaaaaugaacauuuaaguagugcuuaagcccauuuuucugagaaugagacagaauugaagcugaguaaauauacauuaguguguuuucuuuauguaauucugaaucuuauguaaaugaauuuguagaauuaagcacuguggaaggaaucguuuuuugcccuucccaagugaagcucccauagguacaguuggguuguccuucuggguugcuuuaagggcacuuuagcuguuuuaaaaacuuaaguacuaauuucauacucagugucagcugaauuuauugaaguaggucagacucuggauaggaacuuguuucccaacccuaaagagagucauuauccauucuucuauuuguuagagaaugguaauaaauucuuccacauugaccacaagucuagagcaauuucagaaaaucuagauaguuggauuucuucagguauaggaaauuacuuaagauucucucugacuuuuauuaucccaguggaccaaaaacaaaaacaaaacaaauaaaaaggaaagucaacuccuuuccacccccaaagaagccauauucaaugguuguauucuuuaaaauagaaacuuauaucccucccugcccccaaucccgccacccagccaaagaauacacaugcaaaaaugcaauuaauucuuuggggaauucuuuucuuaaaaaaauuuuuauuauuguagguuauucuuccucuccaguuuaauuaagcaaacuuuuaauguacuauaugccuagcaauguuuucucuggacacuggaaaaucaguuucucugccuaugggauauaaaauucuuaucugguuagcaguuaagaaauaguauagucauaugauaaaacaugggaacugaaaguauaaguauugugagaagucaguaguuagugaucaauauguuuuuaauuuaugaaggaaggcuucauggaagauuuaggauuucagaugaugcuugaagguuggauaugaguugauagaaauagauguauagaauauggaauaagaagcaugaacagaaacuuugaauuucaaagugccagauaguaacuuaaaaauguuuuugggugagaacucauauauggcacuguguuaaagcaaccucggcaaaauuaauuggucugccaucacaaauuaauguugcagaucaguaagugaaaaaucagggacucacaaacucaagucuuuugaacuuaaacguccuugcuguauuaacauucacugauaaccuaugaggguggcauuaagaaucuacuaggugcuauuacauucugagaauagaaaacuuauuaaguuucuuucugagagauagagagacagagacccacacacaugcguguauacuaugguuaauuucuugugcaaaucacucaauguauauaugcuauagaaaaguuaaucuggguuucccaugauugucucauagugggaauaucuucuuagagauuauagcguuuaaagaauauugguauaauucaacaauuaaauacaaacacuucauguaauguuguaaaacuggagaaaaucuggauuagauuucagugagcaauaauaugucauucuucaauauggcacaccuuccuaauggguuaauuaguauauuugacucuaugugauuuuuaccuuacaugccaguuuaaaaagcugugauuauacuguaccucuuugggccuucucacaauuuuguagucaacuguuaguuaaauagugaguggguguuuacucuuuacuaaauggagauagcuuuacaucuuuuuuuuuucuuucuuucuuuucuuuugagacggagucucacucugucgcccaggcuggagugcaguggcgcaaucucagcucacuguaaccucugccucucggguucaagugccucagccucccaaguagcugggacugcagaugcccaccaccacccuggcuaauuuuuuguauuuuuaguagagaugggguuucaccauguuggccagauggucucgaucucuugaccucgugauccacccaccucggccucccaaagugcugggauuacaggcgugagccaccacgcccggccaccuuuaugucauuuuaaaugauuuaagaauaaaagcuacuuaaccaacuuaugaggcauuacagaauaggagcuaagagcauggauuauggagccagucugccuggauucaaauccagacuuugcugcuuauuacgugaauggccauugccuuuguuuucccagcuauaaaguggguauaaugauaauaccuauuucuuuucuuuuuuuuuuuuuuggauggagucucacucugucgcccaggcuggagggcaguggugugaucuuggcucacugcaaccuccgccuccuggguucaagcgauucuccugccucagccuccugaguagcugggauuacaggcacgcaccaccaugcccggcuaauuuuuguauuuuuaguagagacaggguuucaccauguuggucaggcuggucuugaacuccugaccucgugaucugcucaccucggccucccaaagugcugggauuacaggugugagccuccgcgccuggccagauaauaccuauuucauagguucauuguauuugguauauaguaagcacuaucaaguguuaguuauuacaaauccauuaucccuuauuugcaauuuugaaauuaaaguaaucaaaccguaaagcaauaguuuuuauacaacuuauuugacagcaaagccugaucuaauuaaugucuuuuuaacauauagucuguuuuugacccuauacuugaccuuaaguuauuuauaguuuguaaaaguccuuuguaauggcugggcaugguggcugacgccuauaaucccagcacuuugggaggucgaggcaggcagaucacuugaugccaggagugugagaccagccuggccaacauggugaaaccggucucuaauaaaaauacaaaaauuaggcaguuaugguggcacacgccuauaaucccagcuacucgggaggcugaaucaugagaaccgcuugaaccccagagguggagguugcaguaagcugagauugugccacugcacuccagccugggugacagagcaugacucugucucaaaaaaaaguccuuuauaaaaugcagauacucguguuacuauuuuaugguacauauugggcaguauaguugacagccuuaugaaguaaaaauaaaccuggauauaauuauuauugaguacagucagcccucuguauccauggauucuauaucuguggauucagccaaccauggauugaaaauauucgggaaauaaaaaaggaugauugugccuguacugaacauguagauuuuuuucccuugcauuauccccuaaacaauacaguauaacaacuauuuauguagcauuuuacauuguuagguauuauaaguaaucuaaagaugauuuaaaguauacaagagaaugagcagagguuauaugcaaauacuauggcauuuuauauaagggaugagcauccaugaaguuugauuucugugguagugggggguccuagaaugaaucccccacagauacugagggaugauuguaauguuaauaauagugucuauuuauugaauguuuaccaugugccaggcacuaugcuggguauuuuauauccauuaucuuauuuauuccaguagucugcaguagggaaguuguauugauccuguuuuuaaugugcucaaguuuagggagauuaaguaauuugcccagcgucacuccagcagugugccagcagugcuagauucagauuuuaucucucugacuuucucgguaacuccuguguucuuucuguaaccuacacugccucucuaauuuagacaauuuucauaaggaaauaaaaaucacugauaugcuaaaguacauuguuguuuugcucuuuuuaccuuugaucuuaggugcugguaaaccgccuauguuuggugauuaugaagcucagagacacuggcaagaaauaacuuuuaauuuaccggucaaacaaugguaugauaauuuuaacuuguuuuucuuguuuaucauaguuaauacagauuguuugaaaauauuaaagggacaacacgcuauuuucuucaucuugaacauccucaucucuugcaugcuggugccacauauguauugccuugcauuuuguaggccugucuuugaaauuugauaguccugaaaguuaauucauauacuuaguuaggugggcuaugaugcugaacuagaacguugaugauaaaacucugaaugucuauauguccucuguacauaaacuauggaagcaccaucauaggcuaaaaacauuucuucccuguucccucauccacuguuucucucacuaaagaucacuaugauuguaacuauagauaaaaauaaaagagagcuuuggcaguagcugauggcugaauuugcagaucugaaaaggggaccaaagggagaagccuacaaugauaggacuuguuuucaacucuggaaauuucgcauguguccuuuugauucaccuuugaauaccgugcaucuaguauagggcauggcacauuguagacccucaauaaaaaucuguggaaggaaugaguauuuagguguucacuuuuucuuuuuuuuuuugagauggagucucacucugucgcccaggcuggagugcaguggcgugaucucagcucacugcaaccucugcugccuggguucaagcgauucuccugccucagccucccaaguaucugggauugcaggugccugucaccaugcccggcuaauuuuuguaguuuuuaguagagacaggguuucaccaucuuggccaggcugguuuugaacuccuaaccucgugauccacccaccuugaccucccaaagugcugggauuacaggcuugagccaccaugugcggccuagguguucguuuucguauggucucauuuccauagcuuucucuuuguauuaugaaggaggaggucagcucuacccuucauuguuauaugauacaguauauauugaaccgucuguuucugaaaacucagagaacuucauagacauuuuuguuaauuauuauugcucucuaucauaauugagcaguggugauuaaccuuaauuuuguauacaaaucuaccugaaguauaaaauagcaguagcuuagugguaaagaguguaggugcuagagucagacugucugaguucagaucccagcucuacuauuuauuagcugugugaccuuuggcaaaucauuuaacuuucucaaccacaguuuuauuacuuauagaaugaaaauaguagacuacauauuucacuggguuauugugaggacugaauaaaaugauacauguaaagcacuuaggccagucccuagcauguaacgaacucucaauaaauguuagcucugguuauagcaucauagaaauucaugccugugucauuuuuauugaacauauccugauaacuguugaugacauuauuuauugacuuacuagaugguugguagguuauucucuuagagacuggcuauauaaacuguucauauuauauuguugacugcuuuggcuacugcuuuuauauagcucuuuaucagagaguuuuaugcaagaacuucauauugaguuuucuauugauagguugccuguucccuagucagaguuuggaguguuucaaauggaagaggaacucgaaacacuuuaaaugucucuuaguaggggaaugauuaaauaaagucuauuucuuaugugcucauuuuuucuagguagauuccuagaaguggaagcucuaaaguaacaccaggauaucucauucuacguacccugaccaacauuuaguaauaccggacuuuuaaaauuggcacuuccuugaguaauugugaccugagcaucuucuaauguauuuauugauaauuauauuucuuuuuuuugagacggagucucgcucuguuguccaggcuggagugcaguggcucgaucucggcucacugcaagcuccgccucccagguucacgccauucuccugccuuagcuucccgaguagcugggacuacaggcgcccaccaccacgccuggcuaauuuuuuuuuguauuuuuaguagagacaggguuucaccauguuagccaggauggucuugaucuccugaccucgugauccgcccaucucggccucccaaagugcugggauuacaggcuugagccaccgugccuggccgauaauuagauuucuuuucaaaauugcuuguucauuucuuucccccguguuuguaguggauaaucauuuuuguaaugauuuguaugauuuuuaaauaguuauacuaauuuucuaugcuguguaaugaaugaccucaaaugcuaauugcuaaaacacacauuuauuaucacaguuucuuuagaucaggaguuugggcacagcuuagcuagguauucugcucagaguuucgggaaggcuauauuucaggugucagcugggcugcagacuuaucagaggcucaaauggagaaggauccauuuccaaguucccucaggcuguuggcagaauuaguuuccuugcaucugcaagagugagggcuucaguuucuuguugggagccacucuuggcuccuagagcucacaugccauuuguugcuauguggcuucuccaacauggccaugcacuaaaauaugccagcuugcuucuuuaaagucagugagaggcagucugucuaguauaucugcuagcaagacagaauauuacauguacgugaaacagaagcacaagagugauauccuaucacauuuaccauauuguauuaguuagaugcaaaucacaggacuugccuacgcucaaggggaggggauuguaugcacgcaggagucugaacagcaggagaugguguucucaguggugaccuuaaagucugucuaccacgacaguauagcaguacuguacacuuuaaucauuuuccucauguguguguaugcguguauaaaauaaacgucuucuuucuguuuguucuugucuuguucuguaauuggugucuguugucuuauaaaacuuucuacauuuugauguauguaaguuauuucaacuauucuugcaacuuuucuguaacuuugaaacuguuucaggcuaaaaauuuuuuucuuuaaacaaaaauaccaaauaugacucuguggguugucuguuagagaaaacuacaucuuaaaguuaaugguaacacucuugaauguaauuuuauaauucguguggcagccauuuuuuuuuuacuuacuaaacaucuacugagauuacaugggaauucaguggaaaaauacauuucaauguauaaauaguauuuagacaacuuuuuggguauugauauaucuaaaguaaggccgggcgcaguggcuuacgccuguaaucccagcacuuugggagaccaaggcgggcagaucacgaggucaggaguucgagaccagccugaccaacauggagaaaccccaucucuacuaaaaauaugaaauuagcugggcgugguggugcaugccuguaaucccagcuacucaggaggcugaggcaggagaaucgcuugaaccugggaggcggagguugcagugaaccaagaucgcaacauugcacuccagccugggcaacaagagcaaaacucugucucaaaaaaaaaaaaauauauauauauauacguauauauauauauauauauacguauauauauguauauauauauacguauauauauauacguauauauauauacguauauauauguauauauauauacguauauauauauauacguauauauauauguauauauauauguauauauauguauauauauauaaaauauaaagcaggaguaucaacuaauugcuuuauuccuacugauauauuuugaugcuuuacuugaaacacuucuaagcuaucuucucuuaugccucuuuguucugcuuuaugaauuuccauaagaauggggagcacuguuauaaauccuauauuuuuuuccuccuaauccaaccaaugacuuuauuuuuaguauauaucauugcaugcuugcagcuuacugucaaugccucuuuuacucaucuccaguggaucucaagguuaaacuaaaugaaaaaauagguuuugucuauuuucagaagcugaaaaccaaaucaaguuguauuggacaaaaugugauucuugaauuacuugaugguuuuccauugcuguauccaucuuaguuguuuuguggcuaguagccaauuggaacuacuauugagcacuuugugucagucacugaccucacagcuuuacuuguuuaacucaaugcuucaacagcucugaggcugauaaaauaaaacuuuaugcuauauaguaacaugaauuuggaaaugauauaauuggugccugucuucagguaucucugucuagaaaaguggguccuuuggucuccauuauuugccuggcccgguuucccagauucaagcugccaaaaggggcuccaacuaacccagagauucuuagacucgcugcuucuuggcuucaagucccagccagacauggaacccaagauuguucacauggauguuucuggagggacaauggccaccagcugguaccauacuguaguacucuaugcccagaugucuuggcugucuaccaugccuugauaauuuuaauccccaucucuuccauacaaaccuauguuuuauguaacugacacuaagaauagaccuuccgaagaugauuaauagguuauuugaugggaucauguugaaugcuaauuuaaagaaauauuuuuaauucaaaaaguaagagauugugauagugaggaauugugacccauuugaaauaaguuaggccgggcaugguggcucaccccuguaaucgcagcacuuugggaggccgaggaggguggaucacuugaggucaggaguucaagaccagccuggccaacauggugaaaccccgucucuacuaaaaauacaaaaauuagcugggccugguggugggugccuguaauccaagcuacucaggaggcugaggcaggagaaucgcuuaaaaaaaaaaaaaacccaggaggcggaaguugcagugagccgagauugcgccacugcacuccagucuaggugacggagcaagauuccgucucaaaaagaaauaagcuuaugaacaaugguuauuuauggguuauauaguuuggcuugcacuguuguauucuuaugauugagaaaauaaauggaauagaagaagaagcugccuaguuguaaaggacaugauuaagaaauuauuuuaacuuaacuuuuaguucucgagucaugauaguuguauauauuuccuucacauucuggcuaaccagaggagccuaucaauuuguggacauuagaccuacuuuucuuccuaaaauucagagagccuugcacguaacgaggcucucguuacauguugguugaauugguuacaaacaauccuauucuuuuuguugcauauuuuuuguuguaugaguguuagucauugaugaagucuacuaauaguaggaugacaguaaaucccaguuugccuaggagaguccugguuugugucuauugacauggcuuaauuauuaauagcuuaauaauuaguaaauuacauuauuaagcuuagauaagugaggugcaauguuaaauuauaagucuacuucuugaauauugauuaacggaauggugcuuucuucuuuuuuucuuuuucagguauuuuaacagcagugauaacaauuuacaguauuggggauuggauuacccaccucuuacagcuuaucauagucuccuaugugcauauguguaaguuuuucuuucuuaauguaacucuaaauuuuuaugcccuuggcagauuuaguaagaagcagugugauggggcuuucuugacuagaggagagauugcuuguagcugcuauuguauuuuuuuuuuuuuuuuuuuuuuuugagaugaagucucacuccaucgcccaggcuggagugcagugguacaaucucggcuuacugcaaccuccaccuuccaggcucaagugauucucuugccucagccuccugaguagcugggaguacaggugcccgccaccaugccuggcuaauguuuguauuuuuaguagagacgggguuucaccauguuggccaagcuggucucaaacuccugaccuuaagugaucugcccaccucagccucccaaagugcugggauuacaggcaugagccaccucacccagccacugcuauuguauuguguauuacaaauggguuuuaagaaauaacuauuggcugggagugguggcucacgccuguaaucccagcacugugggaggccgaggcgggcggaucacgaggucaggagauuuagaccauccuggcuaacauggugaaaccccaucucuacuaaaaauacaaaaauuagucaggcgugguggcacaugccuguagucccagcuacuugggaggcugaggcaggagaaucgcuugaacccaggagguggagguugcagugagccgagaucacgccacugcauuccauccugggcaacagagugagacuccaucucaaaaaaaaaaaaaaaaaaaaaaaaaagaacuaucaaaguuugaacauuucuauaauuuuuuuggaggacaucuagcaagaaaugugaaaaaccuaguuuuguuuugaaguagagauguuauccauauguguagacuacuaagaaauauaucuaauauguguuguguauaagaaaguuuuuuuucuggaacagcucaaaguaaaugaaaaauauagauccagaugguuaccaacuaaucugucaaguuagaaacuagaauaauuguaguguuucauuugugauugaagaucaaaaugggaauuccuccuccuuuuaaagaaauugaauaguuauagaagauaaggaacuucuguuuugguaaagacccaguucuacucuguagugguauuccaucuuagauuugaaguaugucagcaaaaauuugaggaaccucuucacaauaucucgugaacucaucuuguuuaauuucuacuuacagcccugugucacuucacgauggggauacauucugagaaaugugugguuaggugauuucaucauuaugcaaacaucauagaggguacuuuaguaggcaaaaugguauagccuacuauaucuaggcguauagcauagccuauuguuccuaggcuacaaaccuguacagcaugucacuguacugaauacuguaggcaguuguaacacaaugguauuuguauauuuaaacauaucaacacauagcuagcguaaaaauaugguaguacaaucuuaugggaucauuguccuacauaugguccauuguugacugaaaugucguuaugcggugucguuaugaguguauuuaauauuugcaaaaauaagcuucauggauugaaaauaaacucccaaacaucaucauuauaguauucaggguaauuguaauaugguugaaaauuucauuuaacaauuguguuuaguuuuaugcagugauuuaugauuauuauagcuguuuauuguagccaauuguuaugauaacuaaaauauuauaaauuguaaagaugauccucuggucaacacuagcauauugcuuuuuauaaaguauguguuugguaaaugaaaugugacaugccagauuguuuuuacacuggaagaacugugaagauagggcuuguaguuauaccuuacauaguuuuguuggaagguaagcaauguagaugcuguuuuauagcuuaagucaguuucacaugauuaaauaaaaagaguaaaacuuaagcauugacucuguugcuuuauaagagaaauggccaauucucaaaauauuaauacauucauauauccuucaauaucuuuauugcuaaaagggaugaggaaugaaguaucuguauauaugcuuugauuugcagggcaaaguuuauaaauccagacuggauugcucuccauacaucacguggauaugagagucaggcacauaagcucuucaugcguacaacagguaaaagagcaauggguagugaauauaaaauuugauuuuuuaaaaauuuuggacaaacugguaaagguacuauuauuguucuuacugacuuuaaaauugugcaauuacacaaacacauauauuuacaaauauacauauuuguauacaugauccaagaccaaauguauauguaagcuaaaacuugaaagaguagaaaggaauaauucugggugcuuuacauuuuuuaucugacuuaauucuuugaacaccuaaaugagauaaauacuauuauucuuauuuuaagcugaggaaacugaggcauaguuaaaugaagcaagauagcuauaaauugaaucuuuaguuuuuuagggugcugcuuuaauauccuaauucuaaauuucuuucauuuuuucuuaaagcaaaccuugcaguuaucaucuuauacauuguauuguugugcaguuucuaaauuaaauaauccacacaacaaauguuuauugagcaugugugugugcuguuguaggagcuugaaaguaauaagcuuagauuucuuuaagagcuuuacaugacuuaugcuuuaaugcuuuaaaagcccaguccuuuuccuuaauuagucuaaauguagucagaguuuguucuccuuacaauucauccagucauggaaucuuaggcccaagagauaaccuguuuuuccugucuuucccucucccacaccacugcccuucccucuccaaugcuuuaauccuuucugaaccacauacacaccaugugauuauuuggcuucugaaccaauauccauacuugcagggaacucacaaccuuuagagacagucuauucuguuuucagagagcuccagucauuaaaaauuacuuucuaaauugaacuuccaccagucauuacagauuauguuuucuaggguuacagagaacaagucugaucccuuguaucccuaacauccuacaggaauuugaagucaccucuucucuaaguuaaagauuccuauauacuucagcuauuccuuagaugagcaauuuguugaaugugauuaugguuuugaggacucucgccacucuuuuggguguguuccaguuugucagugucaucuuuaauguggcaucuggagcugaacauauugauagauuucaguugauagauugauaguuuacugucaccuuuuucuugacacuaagugagauauaagaaaaaaauaagcucuuuagacagcuauguuauacauuugaagaacuuauguauuuauuuuucuuuguucuaaaggacugcauguucaaaauuaugaauugcuuuucuuuuuuuaggauuuuuuuuucaguuuucuccucaccuggguuucucaagcucuuuauaugcauuaauuagcaaaaguuuauauuuuuucaauaaagaccaacauuuaaaaaagauuuucuuacacaucacuacauuucaguuauucuuuauacuagaaaauucagaguauauagauugaggaaaaaaauauuuccuugcuuugaauauuuuuaaguccaaguuagagcaaagagagaauguuagauacaucugauugauuaaaugugugaauuuguuagagaaaauuaagagacuccuuugcaauacagcaauugaaauuagucacaggugaagggauugaaaagugcugacuguguaaaggacuuguccauaguagggcaagaaccuuguguuaaugaauucucaauguuggaggaagggaggcaguuaauggguagcuguaaauccugauggacucauguuuaaaguuauuuacuuguguuuucaguuuuaauugcugaucugcugauuuacauaccugcagugguuuuguacuguuguugcuuaaaagaaaucucaacuaagaaaaagguagguuuucaagcagccugacaguucgucucugaaauguauucuuuauuagucuaacuauuaaguauagaccuuagagaagccaugcuuuuggaaagagaguaauuaggaauauuguaucuucuaucaauuuucacuucaaaagcaucaacuuaucuuacaguaauuaauuauuuuaguguacuacuaagauacacugaaucuuggaaguuauguacuguugaacuacaugccuugcugaauuuguuacuuuacugguaaagcugaauuuugagcuggcuugugagauugaccaaacugaaaggcauuuugaaaaguuguuguauauucuuaauucauaguuaucaaauauuauuuuuggucauuuuagauagguuaacauuagauugacuucuccaguuuguguaucugaaaguacuuccucugacaaaaccuuuuagugguuuuguuuuuccuuuuuauggaaguguccaaugucaccuucaugaaaacuucauugucuaaagaguuguauuauaaaaauugaauauuuuaugaaaagaaagugugacaccucuggaaaaggggaacauuugcuaauguguuagauaaaaaccacacuuuuacccugcuugauuuguguaacagauuacuuucuuaucucacaauauuugucuuuacagauugcuaaugcauuaugcaucuugcuguauccaggccuuauucuuauagacuauggacauuuucaguauccuuuacuaaugcagaaaugaagucaguugcauauugugaaaucuagacucaauguguacauugcugucaucuaguaaugucuuauuugauagagugcuugcuuauauaaacuauuucacaauaauauaaaagaaucucuucacuaagcuuuuauuugaaagguaaaguacagauuuauuaaaaguagaauugcuuuuucauguuguuugauugggaacaaaauguugguaaaugauuagcucuuucugggguguuggaaaaagagugccaaguaugguuauacucuaguaauucuaaaguguaacaugucuucuauccuuuguaaauguuaucugacgugaaaaaaggagaaugaucuuacaguuuuaugaguuuaaaaauuuuuuuucuaucagauaguaguagcuagaagcuucaggaaacuaaaacugauaaucaaaauauggcuuuuauauguguauuuuuuugaugccuaaaauaaggaacauucaaacaaagcuuagaugagaauaaauugauaaaaaucuguauauaucuaucuaauuugucuuauaauauauugaauguuauuaccugucuccaucucucuuaaaggaaaaaaagacgacauuacacagcaacaugauuauuuaauuaauagcuuuuccuuuugaugccagucuuguuuuaguuauaauaacacuaauagguauaucugucaaaggacuuacaaauaaaagauauucaagucuguaguuguuuuuaucauauauuuuauauucuguccacuuuacuaauuuaguuuuuuaaaaauuuugacauuguuuaugggaucauggcuaucagauacucugauaauaucaagaacagugauagaaaaggaaaaaauguuaucuaccagaguuuuaaaacuauauuuacuuugaaaugugacacucaugcagaaaacuaugcaaaauauaaauguacagcucagugaguuggcaaacuaccacucaugucaagaaauagaacauuacuaguauccaaaaacuacccuuguacaccuccccauccuucucccuccuccuuucccaaugguaccccugaacuaacuacuaauccuauaguuuuccccuuuuuugaauuuuauaugaaagggacagcauaguaaguauucuuuuguguuugauguuuugggcugaacauuuuguuuaugagauguauucauguaguuguguguagcugcaguuuguuaaaaaacuaugaaagugaauucaguguucacuuucauugcuuuacgauauuccauugcaugaauacauguaauucuaucacugagagaguaauuuggguuguuucccaguuugggccaugacgaauaaugcugccaugaacaucuuauaaauaucuccuuguacauauauaaacauucuucuuauaaguggaauuguugaguuauagagugugcacaugucgauuuuuagauaaucccaaguuguuuuuagcagcauguaccaauuaagacucucauaacaaugguguaagaguuccagaugcucuacaucuugaccaacugucaaugguuuucgauuuagccauucuggaaaauuuguaguaguauguccccugugauuugaguuaaacucugaaggcuuucaggcauauguuaucuuguaaggauacauuuuuuucuuuugagacggaguuucggaguuucgcucuuguccgccaugcuggaaugcaauggcgugauuuuggcucgcugcaaccucugccuccuggguucaaacgauacuccugccucagccuccuaaguagcugggauuauaggcaugugccaccacacccuguuaauuuuuguauuuuuaguagagacaggguuucacuguguuggccagacuggucucaaacuccugaccucaagugauccacccaccuuggccucccagagugcugggauuauaggugugagccacugugccuagcucuaaggacacauuuuuuaaccauuauguacuuuucucauuugcaaaauguggauaauagaaacccugacuuuguaagcuuaguuugauaauuaaaugaauuaauauuuguaaagcacuuaagacaguuccugggagacacuaagcauuauauaggcauuuguugcuauuauuaccauuuuuauaauuuauuuuugugguucugaaauuuuacagugauuuguuuagacauagguguuuuucacaauuguuuuggauauccaaaccguauauggguccauacguuuugaagacucauguucuucuguucugcuaaauucuguuauauuauuucuuugaugauuuucucacuuuuuucuuucuugagccuauuagucagauguuugaucuuuugcaucccuuucucuuuuguuuuauggguuggguuaucuugaguuuauccccaacacuucuaucgaauuucauuuguauuguuagguauauuuuuaauuucuaauuagaauuuacuacuuuuuguuuuuuugguaaaguucacuacuguucccugagugauuuuaauucuuucauggucauuuaguuucccuuucauuucgauucuuuuucugucauagguuuucuauaaauguuuauuuuauccuaguguaucuauuuuuauuuaagaauaaggcaagaacaccugcauaugacuucuauauaucauugguccacucuaggauaaguggggagcaagcuggccaccacgcauugagaugcuuaaaugucagaauguggagggguuugcauuauagugcuaaccucuacacuggauaguuuaguucauuucuucagaaaaauaugcccucuuuuguugccuugggguaaauguuuggcugccagauaaucuuugcaugggagugggguaagauuugacuucuaccucuagggauuuucaguuaaucucuuguuuucuucugcacauacuacucaaagacuguaaccuacuugguguuuccaaaguucucuagggucuugcaggguggauuggcuuuuugcuacccugagucuccucuauguauauacucuaagcuguggcuuccuucauccuauuuuauuuguuaucacuucugucuuccagaaauauguugaaaucuuuaucuauuauaacagauccucccauucucuuuauggcugugaauuuauacuuuuuguuuguuuguuuuuguuuucuugcucucuugcccaagcuggagugcaguggcaugaucauagcucacugcagccucaacuuccugggcucaagcaguccuccugccucagcuucuuggguaacuaggacuccaggcuugcaccaccacacucggcuaauuuaaaaauuuuuuuguagagaugggguuuugccauguugcugaggcuggucucaaacuccuggcucaagcaaucuuccugccuuggccuuccaaaguguuggguuuacaggugugagccacgacuucuggccugaauuuauacuauuaaauuccuuuuccuauuauuuuaagagucucucgggaaggagaggagguaaacauuagugccuagcucaccauuuugaacugaaaaucuaauugugauauuguuuuaauuaacaauguuguuaguuucuaauuaaguacauauauuacuuuauacuauuaauauauauaauagaggaaguguagcgaucucaguaaauuuuuuuuuaacuugcuguuggaacauuguuuuauucucuagauuuugguauguuauaauaauauugugaaguaaucuaacagaaacaaagcuauguuuuaaaucuuuagagcucuuuuaaaccaaaacaaaucaguugcugcuuagcaguagauuuaauguauuugaugcuguuauacauaauuucauguuuguuuaucacuucaguacuuugaauuucuauugggaaauagcuuucauuguauauguuauuuuaaaaucacauaagagauaugcuaugagcuugcauuuccuagagcauaucucuugugugauuugcuuuuuaaaagcucuaucuuuuuaaaagauuauugagauaauuuccuugacacaggaacauauauaauucugugagucuuggcuuugcuuugugggguguucuuggaauaucuugugacugcgaccuccuagggucacuggcauuuugcuuagcuauaaauuauaaacagauggaacuuuaccacgccuugccauuuuuuugcuuuuuacuuggcaaguguuuuaaaaaaggccucaaaggaaaggggugagugacuuuuaaacacuagaauccaaaaauuuacuucagauaauuuuuuuggcauacuuacuugcaguaagaugaucuuucacuuugccuuuuggugauuucuuauaaauauuuuggcuguaggguaugugggaagagagagauuaagucauguucuguauuuuauuuuuaauuuuccuaacuagagaaauauuucaauucauguauauuuacugguaguguggauuggguaguuagaacuuugcuguaggauuuuaucacuuuagagcuuacuacauuauauacuuauuagaaauacauccccauuugauauuuuucuucaugaaugcacucucuuauuccuauaggaauggcaucuaacauaaauguuaauuacgauggugauaacaguccuuuuguugaagugcacgucuuagcuguugugaauuuuuuaccucugauuugagcacacucccaucuuaagccuauauugguaacauagauuuggcauuacuauacaugugcauguauuauguucagugagacucagguugauuuugcagaauuacugaccuuucccuaucuuacugccuaccuuuguuuuuguuuuagguuuguguugcuaguuaagcuagcuuguauuguuguggcuuccuucguucucugcuggcugccauucuuuacagaaagggaacaaacccugcagguucuaagaagacucuucccgguugaucguggauuauuugaggcauguuuaaacacuuuccucuccuuucuguuacuguaccuuaccugugaccuuuagggguuucauguagaagguacaaggaauaggaacuucagcuacuuuccuccuguaaucauuccuugccaguuauugcuugauugauuaauugauugguugagacaggaucuugcuguugcccaggcuggagggcaguggcuauucgcagggguaaucauggugcacuacagccuugaacuccugggcucaagugauucuccugccuuugccucccaaguagcugggacaacagggugugugcaccuugcuaguuauuuaauccauuauauaaccccuagcucagguggcauuuuuuaguauguuccaucaauagguaauauucaugccaucaucagauccauaauugaauuauauguuuuuguaaugaaauaggguuuguaaugaaagacagcaugagaaguuucagcuacaauuuuaacagcuguguaauuuuuugguguauauucuguuuuuagucuuaggaaauuauuuguaaaacuaauaaucauguugcuucaggaagaucucauaauuucuuaugagauauauaaccuucauccauaguaauuuuuaaugagaaucuuucauuucauuucauuuaaugcuaguuuaaucacucuuguuaaacuuuuauuaugugaauaauuugaucauuuagauuugguaauuaaauuaaaccauuuuucugaaacaaaaaggccuuuuaauaaaguuagacagaaacaacauauuuauagauaauuugcuagcauuucuuuuaaaaauaauuuuaaaagcauauuuuccuaaguuuugaauauauaaauuucuauagaauaucuuucaguagacuuauaggaagauggaaccagcauuuugaaagcgacuaagaugggaguuugguguugugaaggaacagaaaugugugacuguaugucaacaggaugaugguagugaugaucuaaauaaucacuauuguuauaaccaccacuuagcaggugccagacacuuccauguaauuuuauuugaucuuuacaguagcuuugugguagcuauugucuccacuuuacagauuagaaaacugaggucaaagauuccuauaacuaguauguagcagaacugugacuugaacuuggaaaauuguuuuccuaaccucuucuuuauauaaacucuaacacuuacauaaagaaaaguuuaacucucuauguaagcugccuaauuauuugccuuaccuuccauuucagaaauggcauuuaucaugauaauuauaaaaaugaguaucagacauguuugaugguguugccagucucuuccauucacuucuugccuucaaaaucugaaaagcauuuucuuugauccagcagaggaaagugggaugauauaguugucagugauaguuacuuuuuugauguuaagucugcacagcuguaagucaagcagcuguguagagaacggauuucaccaccaggagagcuguaguuacaaacuuaauuuugaaagugauccuagcacaacugcuaaugucuuuagacuuugauuuauuagcaauuagcucuugucauugcuaguagcuagcagguuacucuguuacucuaaguaaauucaguugugugauaaaaaugggucaaauguaauauguauucuauaaauuguagaaaaaacauuucuuagaaaaauuuccaaagaugaaggacuuuaguauucagggauagugcacugcucuuugaaaacuauuaaguauuugggaaugucuggauuauggugggccaaugcuuuugaucaacugcccugcacaaaaaugaaaaaugcuugagacaguguaugcguauauguuuauuccuggaggauuuaaucuauuuaguuauaauugugacuaaaaguuucacaucucaaaaaguuuauuagagauuaugggcuguacuucauggguuuuaauauuucuuucaauuauaccagaauguaaagcuaacaaaucucuuuuaaggauaaaguagccaauauuuggugcagcuucaaugucuuucugaagauuaaggauauuuugccacgucacauccaauuaauaaugagguaagagaaacaaaguuuguauguaguauuuuauaaguuacucuuuaaaagcauuaugguauuauuucauuuauuuggcaucauuagggaaugagguguuuuucuuuucuuuuuuuuuuuuuugagacagagucuggcucugucacccagguuggagugcaguggcuugagcucggcucacugcagucucugucuccuggguucaagugauucuccugccucagccucuggaguagcugggauuacaggcgcccgccacauggccagcuaauuuuuguauuuuaguaaagaugagguuucaccauuuuggccaggcuggucucgaacuccugaccucaggugauccacccaccucggccucccaaagugcugggauuacaggcaugagccacugcacccagccgagguguuuuucuuuagaggauuuuccacauaaaagaccuauugcucuguacaauaaaacucuucaacuugaauuauuuuaugugaaaauuucugaauuguuaccuuguucucuccuugaacagagaguacauuaaauacgauuaauauuauguugaagagucaugauauucaguguguaucagucaggaucaauccaagaaguaggaguaggagaucacuguguacugugugugugugaauucgugacaaggaauuggcuuauacaguuguagggccuagcuaagcaaaacagaagucacaaggcaggcagucaggagggaauaucuaggggggaaggaagagcaauucagacccagaugcuguuagggaaggccucagccgucuuuuaaagggcuuuuauuugauuaaguuaggcgccucaggacaagaucccuuuugauuaauuuaaaaucagcugaguagggguuucacaucugcaaaauucuuucacagcagauuaguguucaaauaacugggagaugagauggguguggccucucugucuuccaaaucuuaugagaauuucccuuguagcccacccuaacaaaggcauacaggaagggaauucuagggacauuaguucagccuagccaaguugaugagucaaaaucuacaacugggaaaaaucaguuauuguauuagguuauauacuuguuuucagggcuuucaggggcuauuucccauaguacuaaaugguuccaggccacuuugcuuguugagucugucugcuuuuucuaguucuuuuuccucccacccauuagccaucauuaggagaagcucuaguagcuuccugcucccuuuccaccuuguucuuuaugauuuaccaugggcuugaaaaucagauaaucaauguuugugaaaugagggcuagagagacucuuuugugaguaaaguuuaugaauguuuguguuacagauauagcauuaucucuuauacuucauuauguuuucuuauuuugaguguuugauaauugaccuucaacuauguaucuuuguauauuuucuauacaugauauuaaauacuaaaauaacagaagcaauauuuaguuuuaucauguuuggucuauauuauguaaucguguauaaaaguauauauauauaucaauguguagauuuuguuuaaauguuauuucaucuuuaaauuuaauaaauaaaaauauaguuugaaauaaacuuaaguugauaaauaauaugauccuuauauuuaaaaaauauuuccuuauuuaagcuagauuuauaccucuacaaagaagacaaauauuugauuuguauuaauuuuuuagcuuuuguucuacguuuuugagccugcuuccugcaugcauaaaauuaauacuucagcccucuuccaaaggauucaaauuuacacugguaaguuuuucauuacuuuagauacuuaauucuugccacaacugaucuuuuaaaaauuauuuucauggucugcacaggauuuauuggguugggaaacaagacauucauuuauuuggcagacauuuauuggauguuucccauacuuagcuucuguguuagacacuaagcuaagcaaucaauacucuuucaguuaauucaacuauuuaauuuguuucguauuaguuaaugagggacuacaaaguagaaaacaguggcaaugaacuuaaguagcuuaaauaguuaugcuauaaaacagaugguauuaaguucuaucagguacaaaugaaguccuaugauggugugggaaagggagauauuaucucggggggagauuuuagaaugcuguuuagggcaagugggauuugagcccaaauuugaaaguggggcaagguuagaacagcagguuauauagcagaagagaaguucaaaacagaaggaagaaguugaagguccagaggugggaaaggacacaggauauucugggaauagcuauuaaacaauauaacuugugugaguuuuguguguauguguugagaguaggagaggauauagugaaagauaaggguaaaaauugaccaaauuauugaagaccuugaaaaucuugguugaaaagguuuggaguuugauuugugugcaagagaaacuaaaaaauauuuuugagaaggagagggggcagaucucuguuuuaggaggaugacuugugucaguuugaagauggacuaggugcauuuucuacaguuuaggguuuuucugaguagcuuuacaaagucuucuugguuguguuucuauggcauuuaaaauuuuguuccugugugccauggucuauaaaaugacauuuaaaaaauaaccuuuuaaacuaucaagaacauuuaguuucugaaaacaguaaguccuacuggacuuaugugaggcaacauuuagaaauuaggguuccaagucugggacugccauguaaguacguuggauaaaaacaagccagaaaagaacauaacagcgaaauacuucaaaagugcaucucauuaccacaaugcaaaaaggauagcuuuauguuccucuuuucuuuuucauuaucuuuuuauugaugauuuguguuguuugauucugugaaugaacucugagcauaccaagucaucuguuguuaauauucuauuggauaguuagaacagaauggauaugguguaaugcucugaugucuucacuaggcuuaaccugaaauaucuuccaagcuugugauagauuguuguuuuucuaggaaguagaaugcuaaauaaauguacaguucaaagauaauagaauagaauuucagaguuuggguaacuuuagcaguguuagagaugauuacuuuuaggauuauaagccagaaaaaacauuuucuuuuucuuaguuuuguaauuuuuuucaguuugguauguuuuaaaagaagccauuguguuaaaacuuuuuaaauguaagauuuuuguuauuuuguuuuuguuaaucaugcuuugaauucuuauuguauacuucugagaguuuuaagaacauuucccauuauaauuguuuuaaaaguauuuuccuuucaaucauguuugccugaauuauaucucaauauaaaucuauaauugagguaacugauagcaugaauacuggugcauguauagcagcaaaaggauuuauauuuaauuuuucagguauugagugccuucucauaugccagguccuccucuagguacuggcauguaaaggaaugacagaugacaucccugcucucuuacuuggggccuuccaugcuaguggcaggagagggacaauaaacaagauaaauccauuaacaagaaagcaucugggaguaaugagugcuaugaagaaaguaguguuggccgggcacgguggcucacaccuguaaucccagcacuuugggaggccgaggcagguggaucaccugagguugggaguucaagaccagccugaccaacauggagaaacccugucucuacuaaaaauacaaaauuugccaggcgucgugguucaugccuguaauccuagcuacugggaggcugaggcaggagaaucgcuugaaccugggaggcggagguugcggcgaguggagauugcgccacugcacuccagccugggcaacaagagugaaacuccaucucaaaaaaaaaaaaaaguaguguuaugugaaaagagagcugauggaaugagguuaggggacacuuagauugaguaaaggaaaccuuucuagagaagguuucuauaguuuaggguuuuucugaguagcuuuauuauuaaauauuaaauuuaauaauuuaauauuuaauaaauuauuaaauuauuaaauaauaauauuuauaaauauuaaauauuaaaauaguauuugagccaagaagugaaugaccaaccagaaggagccaaucacaagaagaucugggcccugacuugauagaaucauauuuuuccuuaaggcaggaacacauuuggcaaaaggagaugaaugaaguggcugcuguaaaaugagugagggagauacaagagaugaguuggaagggaaggcaggaaccagaucuuguaggcauugggauuuuuuucuaaguauaauaggaagcuauuggaggauuuuaaacaggaaaauuacaugaucugauaugguagcuguuuggagaauggacuaucaggaggcaggaguguuaccaauuaggagauuauugcacuacuacaaagauggaggguggcuuagaccacuccucugccacccuuagcagaggggaauggagagaaguggauggauauuguauuuaggaggugcuguagauagcauuugcugauggguuagauguguagcauggauaagauucaagguuuuugcuugagcaacuggauaguuauccauaucuaauuugcagaauauaaacuucucaaaauagauaauuuuuuuuaaacucuaaauagcacauuauuaauuuauaaaacauuaauauauuuuauugaagugcauguuuuaaaacaccaaaauagauuuguuuugccgguuuuagauucugaccuucuugucuuucaugguuuuaaauuuaaguugucugagauuccaggggaggaugaauguaugauuguugugucugagguauuuacuaguucuguuuauuaauaacugaguuaugaugaacuuagaugguuaaauaaagcuuuauaaucauuguuuuuugaaaaaauaugucaauuuuuuaauuugauuaaaauaugcauacuaguguuguuuguauuuuacuucuaaauagagcuuuaauaaacuuucaacuuucauuugaaaugauuuuuauuuagauucuauaauuaacuugauaugcuauuucacaaguuguuauaucucauuucccccccuuuuuucuuaaagguuagcugugcgcuaucauucuuuuuauuuucuuuccaaguacaugaaaaauccauucucuuggugucacuguaaguagaaacauuugaaauauguguuuauuuguuuauaauauaacuuuauaauuuacauacaaauauacauuugaaugcaaaacaaaacuacacaaauguuauaucuuugcauaaaaugauuucauagucagguuuuuuuccagaauuuuugauuuucuuuauaaaguguauuuuaaacugaaaaauuuugguagaauguuauugacauaauaguaauuucuuccuguuccuucacuuauauuuucuacaugcuaauaaaaaauauauccuucaaagagguuuucaucagauuggagccuguuugucaucuuugcuuuuucauuucauucauuuccacaucuauucgguagccuucuucuuuccauuuacuuccauggggucuuuuguauguugccuucuuucucuuuuuuugccacaagcuuaguuuaggcccuauuggcaaucuguaaccagacuacuuuguuuuagaagcauuaaauuuuuuuccugauguucauagaaagcaguggaugacagcugggaguaugauauccuaauauuaaaauaguauucacauagaacccuuuggaauacugaaauccuccucuaggucaaucccaacccacuacugcucuaccccucacccuauguucacuaggauccuguggaagauacauguacagaaugaccaaugacaaauggcaggcaguauugcuuuuauuagguggagcuuuggacuaaaaccuucgugcagagcugggcuggccuguguggaaggcuucuuggcucuaaauaaaacagucucauaucauuguagacugggaagacugcuuaaugccauccucugaggcccaaaccugaguuagagcuuaccacuauuguaugaggcuaggcugacccuacacaaaucacugguaccaggggaugaaacuguggagaggcauuacuuucaaacauguauuaauauauuuccccagaauuuauacucauagaaaggcagcucauucaggaccuauaaucugaccagauuaguucucagacacugaacuucuagggguucauuuuuuacaaaugcaccuagauuauuuguaacagugcauggcuuuaaucuauuuuugguaaaugguuuuacaguuugcauuaaaaguuccuuuugggcuggaccugguggcucaagccuguaaucccagcacuuugggaggcugaggcaggcagaucaugaggucaggagaucgacaccauccugacuaacacggugaaacccugucucuacuaaaaauacaaaaaaauuagccgggcaugguggcgggcaccuguaaucccagcuacuugggaggcugaggcaggagaauugcuugaacccaggagguggagguugcagugagcugagacugcaccacugcacuccagccugggcgacagacugagacucugucucaaaaaaaaaaaaaaaauuaaauaaaaguuccuuuugaccuggucccagcuaaucauaucauuaaacaaauauuucauucaguaaauauuuauugagugccuucuauuuaucaggcacuguuuugugcacaugggauauauuccagacaaaaaucccugccuucuuagcuaucauucuuaaagauagacacuuauuaaaaaaaaaaaagaagugaguguguuagaagguaauaaauaccaugauggagaaauaaaacagagcaagaguaauuaggaguacuggaggaugggaugcagguagcgguugcaauuuuauuuuauuuuauuauuauuuuugagauggaguuuugcucuuguugcccaagcuggagugcaauagcgugaucuuggcucaccacaaccuccgccucccuaguucaagcgauucuccugccucagugaucauuaaaaagucaggaaacaacagauacuggagaguuuguggagaaauaggaaugcuuuuauacuguuggugggaguguauauuaguucaaccauuguggaagauaguguggugaugccucaaggaucuagaaccagaaauaccauuugacccagcaaucccauuacugaguauauacccaaaggauuagaaaucauuugaccuagcaaucccauuacuggguauauacucaaaggauuauaaaucauucuacuauaaagacacaugcacauguauguuuauugcagcacuauucaugauagcaaagacuuggaacaaacccagaugcccaucaaugauagauuggauuaagaaaauguggcacauacacaccauggaauauuaugcggccaaaaagaaggaugaguucauguccuuugcagggacacagaugcagcuggaaaccaucauucucagcaaacuaacacagcaacagaaaaccaaacaccacguguucucacucauaagugggaguugaacaaucagaacacauggaaacggaagggaacaucacacacuggccuguuggggggugggggcuaggggagggauagcauuagggagaaauacguaauguagaugacagguugaugggugcagcaaaccaccauggcacguguauaccuauguaacaaaccugcauguucugcacauguaucccagaacuuaaaguauauauauauacauauauguauauauauaauuuauauauaaauaucuauuuauauaaauaucuauauaaauaaauauauaaauauauaaauauaaauauauauaaauauauaaauaaauauauaaauauauauaaauauaaauauauauauaacuaugaauuuauauuuauauaaauauauaucuauaugaauauaaauauauauuuauauaaauauaaauauauauauaaauauauauauuuauauagauauaaauauauauauaaauauauauauuuauauagauauaaauauauaucuauauaugaauauauaucuauaggaauauaaauauauaucuauauaaauauaaauauauauaaguauaaauauauauaaauauauaucuauauaaauauaaauauauauauaaauauaaauauauauauaaauauauauauaaauauaaauauauauauaaauauauauauauaaaagaagguguauuaaggaaaugaggugguaaguugcaucagaugcugcuuauaggucaaauaagaugagggcugggaauauauuauuugccuuagcaauauggaagucacuggugacuuugguggggccaguguugguggagcaaugcacggagaagccugauuagguaggguuaagaaaaaaugggccgggcacaguggcucaugccuguaaucccagcacuuugggaggcccaggcggguggaucaucugagguugggaguucaagaccagccugaccaauauggagaaacccugucucuacuaaaauuacaaaauuagcuggguguggugaugcaugccuguaaucccagcuacucgggagggugaggcaggagaauugcuugaacccaggagguggagguugcggugagccaagauugcaccauugcauuccagcaugggcaacgagagcaaaacuccgucucaaaaaacaaaggaaacaaaaauagaaaaaaugagaggagaagaacuaaagacaaguagggauaaugcaauuuuuuuuuuuuuuuuugaggcagggucuuacucugucacccaugcuagagugcaguggcgugaucuuugcucacugcagccucugccucccggguucaagcgauucucccacaucagccuccccaguagcugggacuacagacgcacaccaccacgcccagcuaauuuuuguauuuuuggaagagaaaggguuucaccauguuggccaggcuggucucgaauuccugaccucaacugauuccccugccuuggccucccaaagugcugggauuacaggcaugagccacugcgccuggcugauaauucauuuuuuaaaagaaauauuuaaaauuauauuuuuaaaauuguguuaaaguacacauagcauaaauguuacauugucaauuaguacauucacacuguugugcaagcaucaccacuaucuaccuccagaacaucuucaucaccgcaaaaggaaaucccauacccaaagcagucccucuccauuuucccuuccccgagucccucuaaccacuaaucugcuuucugcaaaucucuguggauuugucuauucuggauauuuuauauaaauggaaucauauuauauguggucuuuugugucuagcuucuuaauauuuucaagguucauccauguuguaucagaacuguauucuuuuuuaugccugaauaguauugcauuguaucgauacacuacauuuuguucaucauuccucaguugauggacauuggguuguuaccauguuuuggcuguugugaauagugccacugugaauauucauguacaaguuuuuguuugagucuauacucaggaguagaauugcugagucacauggcaauucuguauuuaacuuauugaggaaccaccagacuuuuccauaguggcugcaccacuuaacauucccacuaauaauauaugaaggcuucaauuucuccauauccuugauagcacuuguuauuuuccaucauuuugauuauagccaugcuaguggauaugagugguaucucaucgugauucugauuugcauaucccuaauuacuaaugauauugaacaucucuuuaugugcuuguuggcacaauaugucuaucuucuucagagacaagccuauuuaaauccuuugccuauuuuuuuuuugagacggagucucgcucugucacccaggcuggaaugcaauggcacggucucagcucacugcaaccuccgccucccggguucaagugauucuccugccucagccucccgaguagcugggacuacaggcgcgugccaccacaccuggcuaauuuuugcauuuuuaguagagaugggguuucacuauguuggccaggcuggucuugaacuccugaccucgugauccacccgccucggccucccaaagugcugggauuacaggcgugaaccacugcgcuuggccguuuugcccaauuuuuaauuggguugucauuuuuugaguuuuaggaguucuuuauguauccuggguacuagccuuuaucagauauaugauuugcaaauauuuucucccauucuuuggguugucuuuuuuacccucuugauaguguucuuuugaugcacaaaaguuuuuaauuuugaugaagucuaauuuaccuaucuugucuuuugauuguacuuuugauauauaucuaagaaaccagugccaaacucaaggaaauaaagauuuacccucauuuuccuucuaagaguuuuauggauuuagcucuuauauuuaugucuuugauccauuuugaguuaauuuuuuuuuuuuuuuuuuuuuugagacagagccucggucugucaccgagguuagaguacaguggugcaaucuuagcucacuacaaccuccaccuacuagguucaagagauucuccugccucagccucccaaguagcugggacuauaguugcccgccacaacagcuggcuaauuuuuguauuuuuaguagagacagggauuuaauuauguuggucaggcuggucucgaacuccugaccucaagugaucugccugccuuggccucccaaagugcugggauuacaggcgugagccacugugcccaguugaguuuuuauauauggugugaggaagguagacuguucuucagaggaguuuuguugaaaaaggaagcagaaaaauagggcaauaacugguagagaaaauggggucaagauagguuuguuuguuuaagagaggagcaauaaaggcaggggaaugaucagcagagaaggaaagcugaugguacaggaucucaagaggaggagcugcuggagcacugucauugggaaagggagaugggguaggaucuagagcacaaauggaagaauuggcauuggacagaugugugaagaguuccucuuuaguaaaaggggugaacaggcuauauugguagagaugcugggaagggaguaaaugugauggugggcaucugugaaaguucuguuuuaacugcuucaguuuucuuauugaagugagagggaaagucauuagccaagaguggguugaagcuguuggaaguaggagggagaagugugaaacauuuucuaaggagagacagaguguaaacagaucagggaaauauauaguaauugcagggcacuugaauaucaugaucauguauuuaaagugagaccaguuaguauggguagcuguuuuucucuugagcaguuguucaguaugguuggaguaagcacugguggagaguugaguauuuccagguuuaugguuuugucuggugaggauaacucccuugcuugagggcuuaagagugaauguaugggagugauuauaaugauugaccuuagaauuuaagguagguaaaaagggaaaaggccaucgaagcgaugagggaaagugaaaacgugguaggaacaauggauugaagaucucgguaggaucaaaagauugucggaguuggaauauccaaaaggcaggagauaguggugagagucauggaggaggugcagucuaaaguaugaccguaagggacaggauuaaagaugagaucacuagaagagaggcguuauagcaaaugagagggaagaucuauguauauguuaaaauugccaagaauuaagucaguuuguagagagugauagugagaaaggaguugaaaucuuuggguaauggaggaagcggcccugugguuggucaguauuuacaagauggggaauaaucggggauaaagugugaugagaagaguuucaaagcuggagauuauuaggguggagagagggagaacugguaggaaaguagugaggaagaucaaggagguuacuucccaccaucaggccaagucacuugaagacuguggaaacaacaaaaacaggcacaguugagagggcagagggcaguacuguccucagaggagagagccaggcauuguuucaaacaaggugguaaagggagggguucagagaagagguugaggauguagggcauuucacuguuuggugaugaauuguaaguacuuugagguuaggagcugaguuauaaucaucuuuguauuccuuucagagcagugcuuauauguaguaaguuuuuuuaagagacaaggucucacuuagucacccaggcuggagcaaagugacauggucauagcucacugcagccucggacuccugggcucaagugagccucccacuucagccucccaaguaacaaguaccccaggcgugcgucaccaugccaggcuaauuuguaaauuuuuuguggagguggugucuugcuauauucucuaggcuggucuugaauuccugggcucaagugauccucccaccuuggccuccaaaagugccaggauuacaguugugagccccugcgccggcuguaauacauuuuuugucaaugcuuguguuugguaaauaaauauugaaugcauaaaugggaaagaauuaaaccagaaagagaaaacaguauuuauugagcaccuucaaugagcuugcuauuaauaugcguccauucucaagcagugaaauggaaaguccucuaguaauuucuuucuuugagauggagucuugcucugucaccaggcuggagugcaguggcacgaucucggcucacugcaaccuccgacucccugguucaagcaauucuccugccucagccuccugaguagcugggauuacaggcacgcaccaccguguccagcuaauuuuuuuuuuuuuuuuuuuguauuuuuaguagagacgggguuucaccauguuggccaggauggucuugaacuccugaccucgugauccgccugucucagccucccaaagugcugcgauuacaggugugagccacugcgcccggccuaguaauuucuuuuaguaguuuucaguuuauaaucccaggguuuaaaucucauauauuaguugacauaggaaaaagucauccuucugggaaagggggagaaugcccaaaucuuuauagagcacuuuuuaaaauaaagagauucaaaauaaugauaacaauuauucaacaaccaccaucauuaggaaaguuuauuguauuuuaaaaaaguaaacacuagaugauaccugcaaagaguucuuucaacuauuuaagaauacaggguauuauuauuauuuccauuuccacuuaagaaaauagauuaaucauuugcucaaggucacacaguaaauaaagggcaaacauggggaccaggacucagggcuucacacuagcaaugcuccuucuuugagcauugccacaauugaaucccaaagguacuggagcaggaguugugguaaggagguuacagggcuuagagcuaugacccuaaacaacuuuuuuuuuuuuuuuuuuuuuuuggagauggagucucgcccugucaucucacucuguugcccaggcuggagugcaguggugugaucucagcucacugcaaccuccuccucccggguucaagcaguucuccugcuucagccucccaaguagcugggauuacaggcacgcaccaccaagcccagcuaauuuuuuuuguauuuuuaguagcgaugggguuucaccauguuggccaggcuggucucgaacuccugaccucaagugaucuaccagccuuggccuaccaaaguacugggauuacaggccugagccacugugccuggccccuaaacaauucuuugauaaagccagugguucuguuuauuggcauugugcuuccuguuccuauacuauuucccuuuuuauguagcucuuccuacuaauuucuuccuccuuuuaauuuuauuauuaucaauuuguuuuccuuuauccucuugucucucuuguccucuccaguggcaugaugauguugucugccauaucuuuaguuuuaacuuagcggaguaauauguaacaugaaagaacauaaaagagauguuugaaaacaauacugggaauucauauuuaccaaguacuacgaaauaugugacaaagccuucucagauuuguuuaucugauccuuuucuuaagcuacuuguuuguaugauagagaaaaaaaguuccauuaacggcauacuggaagcagcaguuuuccaauuauuaugaggaguugacaccucugugccugugucuaggcuaauuuagucuggacuguuaacaaaaugaaucaguaguccauaugaagaccuuccuggcuguuuuuaagcuaccgcugaaaaucagacagauaaaauguauuuauauuuuuuacaauuaggaguugaaguuauauucuguaauauuaaaauauuuuuuucuuuacgauuuuagaccagucugcuuaguuuuaagugaaauuccuuuuaugucuacuugguuuuuacuugugucaacauuuagguaagucauaucaauuuccauauauuuucaguauaauucuuguaaacuaauuuaaaacuuuuuuaugaagugguuaugguuugaauugauaauucucuugugauuuuuaaaaauuuuccuuuacaguaugcuaccucuucuauugaaggaugaacuccuaaugcccucuguugugacaacaauggcauuuuuuauagcuuguguaacuuccuuuucaauauuugaaaagacuucugaagaagaacugcaguugaaauccuuuuccauuucugugaggaaauaucuuccauguuuuacauuucuuuccagaauuauacaauauuugguaaguucaauuuuuaagaaaugacacauuuuucagcaugucacuauuuuaaaaaauuauugaaguagugauuuucuuuuauaccuuuuugagauauaauucacauaaauccacucauuuaaaguauacaacuuagugguuuuaaguauguaaacagauuugcacaacuaucaccaucaucuaauuuuacauuauuuugucacucccagaagaaauucuguacccauuagcauucauucccaauucuauucucacuccuaacucccuuccuuggacagccaguuucugccucuuuagauuugccuacuuuggacauugcauauaaauggaauguauuagucugugauagcugccauaacaaaauacaacagaaauuuauuuucuuacaguucuagagacuaaaaguucaagaucaagaucaagguucuaccaucaggguugguuucuggugaggccucucuuccuggcuuguagaaggucucugcuuuaugugucacacauggagagagaccucuguugucucuuccuuuucuuguaaggacaccaguacuacuggauuagggccccauucuuaucaucuaauuuaaccuuauuuaccuccuaaaaggcuauaucuccaaauaacagucacauuggggguuagggcuucaacauaugaauuuuaauucaguccauaacaugggauaauaaaauuguggucuuuaugacucgguucuuucacuuaguguguguguguguguguguguguguguguguguauuuauuuauuuuuuugagacagagucuugcucugucacucaggcuagagugcaguggcaugaucuugucucacugcaaccucugccuccuggauucaagcaauucuccugccucagccucccuaguagcuggaacuacaggcaugcgccaccaugcccagcuaaauuuuguauuuuuaguagagaugggauuucaguaugucggccaagcuguucuugaacuccugaccucaugaucugccggccuuggccucccaaagugcugggauuacaggcaugagccacugcgcccagucacuuagcauauuuuugagguucauuuguuauagcauauaucaguacuuuauuccuuuuuauuaccaaauuauauuccauuauauggauauaccacauuuuguuuauccauucaugaauuaauggacaugaaguuguuucuacuuuuuuaguguuaugaauauaauaaugcuguugugaacauuuguuuacaagguauugagugcacauauguuuucauuucccuuauguguauaccugggaguagaauugcuagaucauaugguaauucuauguuuaacaucuucagaaacugccaaacuguuuuccaaagugcagcacaauucuucauucucaccaacaaugugugaggguucuaauuucuucacaucuuucacagcauuuguugucuuuuuaauuauaaccauccuagugggugugaggugguauuucauuggagugcugacuugcauuucccuaaugacuaaugauguugaacaucuuuucaugugcuuaucggccauuuguauaucuucuuuggagaaaugccuauucaaauccuuugcccauuuuaaacuggguugucuuuuugaguuguaagaguuuuuuuaauauauauucuugauaugaguuccuuaccagauauuuaacuugcaaauauccucucccauucuguguguugccuuuucacuuucuugaugguaucauuugcagcagaaaaguuuugauuuugauaacauccaguauaucuauuuuuuucuuuuguugugcuuuuggugucauaucuaagaaaccauuguauaaccaguggucacaaauauuuaccccuguauuuucuucuaagaguuuuauaguuuuuaaaucuaugccuuugaguugcuuugaguuaauauuguauauggugugagguaggagucugacuuuauucaauuauuucaguuccauugaauugucuuggcacucuuguugaaaaucaguuguucuuaaauguaaggguuuauuucuggaaucucaguucuguuccauugaucuauaugucuauccuuaugccacugccauacugucuuguuuacuguagcuuuguaguuaguuuugaaauugaaaaugcaaguccacugauuuuguucuuuuacaagauuguuuuaucuauuuuacaucccuuuauuuucauauuauuuuuagaaguucaucaguuuucucccaaaacucagcugagauuuugauagggacugagucgauucugcauaucaauuuguggaauauugcuuuauuuuuuugagacaaggucucacuuuguugcccagauuggagugcaauggugugaucuuggcucacugcaaccucugccucccaggcucaagcagucuucccaccucagcccccuuaauagcugggacuaugggccugugccaccacacccggcuaauuuuuuuagagacggaguuucaccaugaauauugccgucuuaauauuuagucuuccaaugaacaaacacaggauguguuuccauuuauuuagauauuuaauuucuuucaacaauguuuuguaguuuucaguguauaaguuuuggacuucuuuuguuaaauuuauucuuaaguauaacgaaugauccuaaagcauaauucuuuaugaugcuauuguaaaggaauuguuuucuuaauuucauuuucauaauguucauugcuacuauauacaaauauauuuuuguauauucaacuuguauucuucggcauagguuuuuaauggauuuccuacaguuuucaauauacaagauaauguaaucugcaaaccaugaguuuuacuucuuccuuucuaauguggaugacuuuuaucuuuuauuucucuuacuugccuaauugcccuaggaccuauaagacaguguugaauacagguaacaagaguggacaucuucucuuuuacuugauauuagagggaaagcaucuggucugucaccauuaacuaugauguuaacugugggcuuuuuaaaauagaugucuuuuaucugguugaggaaguucucuucaauuccuaguuuacauguuuuucucaugaaaaaaugcuggauucugucuaauucuuuuucugcaucuuuggucauguguguuuuuuuucuuuuauucuauuauaugacauauuucauugauugauuuuuguauguuacacuaaccuugaauuccuaggauaaauccuacuggaucaugguguauaauucuuuuuaucugccacuggcuucaguuugacaguauucuguugaugauuuuugcauuuauauucauaagagacacuaacauguaguuuucaugugacgucuuugucuacucauaaaguucauauauuuaaggcauaucacauuacauucaaggcuaaaaugcuagauugcaauguauuugaggucaagaacucugcauuuuauacaugccauuuuaucuguagcaucuaucagugccucacaaagaauaggugcucugauuuuuguuuguugaaugaaugaauauucaucuaauuauuauaaugaaaaauuagaggcagcucaauuauccaguaguugaaaaaugauacaugaauaaguauauaagcuccacggaauauuugacaacuacuacaaauguuaugaaguuguuguuguugagacaggaucucacucuguugccuaggcgggagugcgguggugcauuuuuaacucacugcaaccuggaacuccugggcccaagugauccuccuuccucagccuccugaguagcuaggauuauaggcaugcaccaucaugcuugccuaauuuuuauuuuuuauuuuauucuuuuugagauggaguuucacucuuguugcccaggcuggagugcaauggcacgaacuuggcucacugcaaccucaaccuccuggguuuaugcaauucuucugccucagccuccugaguagcugggacuacaggcacgugccaccacacccugccaauuuuuguauuuuuaauagagacgggguuucaccauauuggccaggcuggucucgaacuccugaccucgugauccacccgccucagccucccaaagugcugggauuacaggcgugagcuaccgcgcccagcccaacaggcuauacuuauuuauauuuuugaguacuacauagaggauugcccaaaguacccagauaacaaagagaaaagaaugacuaacucuauuaggggaguguaggggaagguuucaaaggagauauuuuauauuuagaucuuguaggaagacaaggcagguauucucagggcagaguugaauggguguccugaggguuuugcacuuuagguaaugaccauggaggauaguggugugggagguaggaaguuaagaggugaacaggaaagacaaggagaggauuaacuuuacucagggguucaaauggaaaguagauauaaaguucauuuuuuguuaguauaggcccagauuccugaguguaugucaaaaucuagcccuauugugauauucacaaucugguccaguaaucuuaaggugaggaccgcuaugggcucccagauuuauuuguucuuuaauaguuuuugagcacuuacuauaugcaagcauuguucuggaggcugaggauacgguagugaccaaaacuaacagaaaucccugcucccauggagguugcauucuaguggagaaauccagcaccagcauauguaaaauauauggcaugucagagggugauaagugcuauggagaacaacaaagcaagggagaaaucgauaugauaugcaggagggaugaaugcaauuuuaaaguggcagggcuuucuugagcaaagaaccaaaggaaguaaacugcagauaauugaggguagaacauccuagaagagaaaaacugcaaaugcagugaacaucauggaggucauagugauuggagcugggugagggaaagaaauaauaggaccuaagauuagagagguaacaguguaguuucuuauaaugggacuagaaucugacuuacauuuuuaaaaggucccuaugguagcuauguggagaacagauuguggauaauggaauccaugagaugauggugcuguggaccaggguagcaguggaagugguuagaaauggucagauuuuuuauauauuuugaagguagagccaacaggaauugcugggguugugaaagagagguguucaagaugacuccaagguuuuuggcauacauaacugaaugggugggguugccauuuaccgaauuggaggaagcauguugaaggaacuuuguguguggugggggcagucgggaguaugaggagaccaagaguuuuuuacauguuuaguuuuagauaccuauuagauauccaaguagagauauuaagaaguaccuggauauaugaguccagaguuuagcgcaagcuuguccaaucugcaacugaagcuggcuuugaaugcagugcaauacaaauucauaaacuucuuaaaaccuggaguuuuuuugcgauauuuuuaaaaacucaucagcuaucguuaguguugguguauuuuauguguggcccaagauaauucuucuuuuuccaguguggcccagggaagccaaaagauuggacaacccugguuuaggggaaagggccaggcuggagacgaaguugagucuuuacauauaguugguaauuaaagucauauuacuggaugacucacuaaggguaugaguauagauuaauaagaggaauagguacgaagccccagaaugcagacguaggggacaugaggaaccagcaaagaugucuaagaauuaacugggugagauaggagaaccagaagaguaugaugucauggaagccaagugaacgaaguguuucagugagaggagagugauuucaaaugcuaaugagagaaucaaguaaggcaguaagaacugaccaugggauuuacuacacuggaggucauuauggauguuugacuauagcaguuucaucgugauuagggugaaagcccaauugguauggguucacuagugaaugggaugaagacuggacacagcauguuuauaggcaacuguuuugggaaacaaguguaaauaggagcagacaaaugggguaauaguuggagcaagagaggguuuuuguucuguuuaacacugacucaagaucgugguauuaugacauuucaaccagucccauauuucuuaaguuugaaacuuuuauuuuaaagauuucauuccagauguuugcacuucccacuaagguugccucaggaauuuuuccuuuaacgacacuggcagccuuuguuuguaucugcuuguaagcuuucuuggcgccuauccucgcuuuuccauuuggaaugaucacugcauuacucucuauuuagaucuuaccaauacugucauaauguagccagcaguuaaggcauccuuuaggguucugugucccacccacuucauggaagucacuacuguuucucacugcuuucuacauuuauuuauacugcuuuuguauaccuguguacugugcuagggauaaaaugaguaagaucuugcuggucuuugucuuaaaggagcucacagucuagagucacagucuguccaguacgguagccacuagacauauauauaaauuuaaacuuauuaaauuuaaauaaaaauucuguuccucagucacaguaaguacauuucaaaugcccaauagccacaugugguuagcagcuacuauacuggagugcagacaaaacauuuucauuacugcaggaaguucuauuguauagcacauuggccuagagaagaccacacuaacugaugaccacacaacuacaauaaaugugcuaauuauuuuuacuacucagcuugguauuuaagccagugugacuuugugauuuuauuuaacauuccccucaguagauggaaaacucuuugaggccagaggaccucauuuucuuucaugugccuucgugugcuuuacucauugaaagcauuuagcgaauaugaaauguaauuuuccauuugccauggaaaacuuuuucacagauggguucucaagguuagcuuagaauuuuaaaaauugauacagaauagauguauauauuuuggggguauaugugauaauuugauucauuuauucauucauguaaugcaugaagaucaaaucgggguaacugggcuauuuauuaccuuaaaaauaugucuuuaugcuaggaacauucaacuuauuauuuucuagcuauuuuaaaauguacauuaauguuaacuauauucagccuacugaccugccaaacacuagguuuuauuucuucuagcuaccuauacauuuguacccauuagcuuagaauuuuauauccuguuggaccccaggggauguuauaaauuuaacccugacuagcauuaauauuugucccagauaccuuuguucagugccuuggugguaggaaguauaagaagacagggguccucagguuuuggcuacacaugggaaucacuuggagagcuuuaaaaaguacugaggccugauuuaauuggucuggggugugaugugggcauugagauuuuaaaaacuccucauaugauucuaauaggaagucaaaguugagauacaccagaauaaauuagacccucaacccucaccuuuaauucugcucauuuaauagcuacaagucaauguuuccagcacauuuaaauuucaccuuuuauacuacucaguaauccuuuuuuuccuugcaguuucuuaucucagucaucacuauggugcuucugacguugaugacugucacacuggauccuccucagaaacuaccggacuuguuuucuguauugguguguuuuguaucuugcuugaacuuccuguucuucuugguauacuuuaacauuauuauuaugugggauuccaaaaguggaagaaaucagaagaaaaucagcuagcuguauuccuaaacaaauuguuuccuaaacaaaugugaaaaugugaacagugcugaaagguuuugugaacuuuuugcuauguauaaaugaaauuaccauuuugagaaccauggaaccacaggaaaggaaauggugaaaagucauuguugucuacacaaaauaaauguauauggagaccaaagaccaauggaggcuugucuaaguacugcuuggccaaaacaugugguuuuauuauucacagcuauucaaguggggaaaaaagagaaacauguccuuaaucccauuguuuacucaggaaaugcacuuuuuaaaugucuuuaaaaaacugagaaauauuucuugauauuugcuuugucuaaaccuacuuccuucaucagaccauauagugagcuucaugggagaauugagccccuucuuuuuaauggaaaucacuaauuuugguauucaaacuuacauuuuagaaugcaaguaguguguauuucacuguuuagaagucauaucuuagggaauuaaauuugugauaaucuuuuuaauuacugagaaggcaauuuaaacugcuugaaguuugaauaugccuuauuacacaugcaaauuugauuguuuuaacaaggcaaauaaaccauaaucuuauuuauuuccaagaaugcauauuuuaauacaauuaaaaaugaauuuuccugaauuuaaauguaagcuuuaacuuaacuuuaagugguuugagugaagucuucuaaauuacacauaaucacugguucuaaacuuccagaaccauucuguuuaauuaaacauuauauuauauauauauuauuauugacaugguucaggguuaccacugccagagcauugauucauguuaacuucauccuauuaauacuguaucacccuguauuagcagaagccaauauuuauuauaguauucaacugguaaaaauaauacaugauauccauguugcaguuucucauauaaagauauguuuucuuuagccucuguaauaaagauaaucauuuucccaucaacauuuuuuaaggaauauauuucuucuuucauaagauagccauuaaacuauauuaaguggugguauauuuuaauauagugcaaaucaaaccacauacaaaaaaaaacugguucuagacacggacagucacaggcugauauaagaagguauguguuucuaagucugguaaaggaaguggguuuagacaaagcaaaaaucuagaaagguuucuuucucaaagcaaaugugcauaaagacucaaagggcaggucaacgcagaauagcagccuugaaucacugccgaaucagcaagaacauugcuguccauggucaccaucuguaaucacugugcccaaaugucagcaucuuggcuggcugguguagcuuuauuuuuaaaaauauuuuuuguaauaguacacuuguguuuaacauagaauguugacuuagauaaaugaugaggaaguuauaaauaauuggaguagcauaacuuuauuauuuggaaauaaaaguauuauguacauauauuaguaaaaugaaaugcaccuga

SEQ ID NO: 191386 - RNA, 70973 nt, Homo sapiens
ucaggugcauuucauuuuacuaauauauguacauaauacuuuuauuuccaaauaauaaaguuaugcuacuccaauuauuuauaacuuccucaucauuuaucuaagucaacauucuauguuaaacacaaguguacuauuacaaaaaauauuuuuaaaaauaaagcuacaccagccagccaagaugcugacauuugggcacagugauuacagauggugaccauggacagcaauguucuugcugauucggcagugauucaaggcugcuauucugcguugaccugcccuuugagucuuuaugcacauuugcuuugagaaagaaaccuuucuagauuuuugcuuugucuaaacccacuuccuuuaccagacuuagaaacacauaccuucuuauaucagccugugacuguccgugucuagaaccaguuuuuuuuuguaugugguuugauuugcacuauauuaaaauauaccaccacuuaauauaguuuaauggcuaucuuaugaaagaagaaauauauuccuuaaaaaauguugaugggaaaaugauuaucuuuauuacagaggcuaaagaaaacauaucuuuauaugagaaacugcaacauggauaucauguauuauuuuuaccaguugaauacuauaauaaauauuggcuucugcuaauacagggugauacaguauuaauaggaugaaguuaacaugaaucaaugcucuggcagugguaacccugaaccaugucaauaauaauauauauauaauauaauguuuaauuaaacagaaugguucuggaaguuuagaaccagugauuauguguaauuuagaagacuucacucaaaccacuuaaaguuaaguuaaagcuuacauuuaaauucaggaaaauucauuuuuaauuguauuaaaauaugcauucuuggaaauaaauaagauuaugguuuauuugccuuguuaaaacaaucaaauuugcauguguaauaaggcauauucaaacuucaagcaguuuaaauugccuucucaguaauuaaaaagauuaucacaaauuuaauucccuaagauaugacuucuaaacagugaaauacacacuacuugcauucuaaaauguaaguuugaauaccaaaauuagugauuuccauuaaaaagaaggggcucaauucucccaugaagcucacuauauggucugaugaaggaaguagguuuagacaaagcaaauaucaagaaauauuucucaguuuuuuaaagacauuuaaaaagugcauuuccugaguaaacaaugggauuaaggacauguuucucuuuuuuccccacuugaauagcugugaauaauaaaaccacauguuuuggccaagcaguacuuagacaagccuccauuggucuuuggucuccauauacauuuauuuuguguagacaacaaugacuuuucaccauuuccuuuccugugguuccaugguucucaaaaugguaauuucauuuauacauagcaaaaaguucacaaaaccuuucagcacuguucacauuuucacauuuguuuaggaaacaauuuguuuaggaauacagcuagcugauuuucuucugauuucuuccacuuuuggaaucccacauaauaauaauguuaaaguauaccaagaagaacaggaaguucaagcaagauacaaaacacaccaauacagaaaacaaguccgguaguuucugaggaggauccagugugacagucaucaacgucagaagcaccauagugaugacugagauaagaaacugcaaggaaaaaaaggauuacugaguaguauaaaaggugaaauuuaaaugugcuggaaacauugacuuguagcuauuaaaugagcagaauuaaaggugaggguugagggucuaauuuauucugguguaucucaacuuugacuuccuauuagaaucauaugaggaguuuuuaaaaucucaaugcccacaucacaccccagaccaauuaaaucaggccucaguacuuuuuaaagcucuccaagugauucccauguguagccaaaaccugaggaccccugucuucuuauacuuccuaccaccaaggcacugaacaaagguaucugggacaaauauuaaugcuagucaggguuaaauuuauaacauccccugggguccaacaggauauaaaauucuaagcuaauggguacaaauguauagguagcuagaagaaauaaaaccuaguguuuggcaggucaguaggcugaauauaguuaacauuaauguacauuuuaaaauagcuagaaaauaauaaguugaauguuccuagcauaaagacauauuuuuaagguaauaaauagcccaguuaccccgauuugaucuucaugcauuacaugaaugaauaaaugaaucaaauuaucacauauacccccaaaauauauacaucuauucuguaucaauuuuuaaaauucuaagcuaaccuugagaacccaucugugaaaaaguuuuccauggcaaauggaaaauuacauuucauauucgcuaaaugcuuucaaugaguaaagcacacgaaggcacaugaaagaaaaugagguccucuggccucaaagaguuuuccaucuacugaggggaauguuaaauaaaaucacaaagucacacuggcuuaaauaccaagcugaguaguaaaaauaauuagcacauuuauuguaguuguguggucaucaguuaguguggucuucucuaggccaaugugcuauacaauagaacuuccugcaguaaugaaaauguuuugucugcacuccaguauaguagcugcuaaccacauguggcuauugggcauuugaaauguacuuacugugacugaggaacagaauuuuuauuuaaauuuaauaaguuuaaauuuauauauaugucuaguggcuaccguacuggacagacugugacucuagacugugagcuccuuuaagacaaagaccagcaagaucuuacucauuuuaucccuagcacaguacacagguauacaaaagcaguauaaauaaauguagaaagcagugagaaacaguagugacuuccaugaagugggugggacacagaacccuaaaggaugccuuaacugcuggcuacauuaugacaguauugguaagaucuaaauagagaguaaugcagugaucauuccaaauggaaaagcgaggauaggcgccaagaaagcuuacaagcagauacaaacaaaggcugccagugucguuaaaggaaaaauuccugaggcaaccuuagugggaagugcaaacaucuggaaugaaaucuuuaaaauaaaaguuucaaacuuaagaaauaugggacugguugaaaugucauaauaccacgaucuugagucaguguuaaacagaacaaaaacccucucuugcuccaacuauuaccccauuugucugcuccuauuuacacuuguuucccaaaacaguugccuauaaacaugcuguguccagucuucaucccauucacuagugaacccauaccaauugggcuuucacccuaaucacgaugaaacugcuauagucaaacauccauaaugaccuccaguguaguaaaucccauggucaguucuuacugccuuacuugauucucucauuagcauuugaaaucacucuccucucacugaaacacuucguucacuuggcuuccaugacaucauacucuucugguucuccuaucucacccaguuaauucuuagacaucuuugcugguuccucauguccccuacgucugcauucuggggcuucguaccuauuccucuuauuaaucuauacucauacccuuagugagucauccaguaauaugacuuuaauuaccaacuauauguaaagacucaacuucgucuccagccuggcccuuuccccuaaaccaggguuguccaaucuuuuggcuucccugggccacacuggaaaaagaagaauuaucuugggccacacauaaaauacaccaacacuaacgauagcugaugaguuuuuaaaaauaucgcaaaaaaacuccagguuuuaagaaguuuaugaauuuguauugcacugcauucaaagccagcuucaguugcagauuggacaagcuugcgcuaaacucuggacucauauauccagguacuucuuaauaucucuacuuggauaucuaauagguaucuaaaacuaaacauguaaaaaacucuuggucuccucauacucccgacugcccccaccacacacaaaguuccuucaacaugcuuccuccaauucgguaaauggcaaccccacccauucaguuauguaugccaaaaaccuuggagucaucuugaacaccucucuuucacaaccccagcaauuccuguuggcucuaccuucaaaauauauaaaaaaucugaccauuucuaaccacuuccacugcuacccugguccacagcaccaucaucucauggauuccauuauccacaaucuguucuccacauagcuaccauagggaccuuuuaaaaauguaagucagauucuagucccauuauaagaaacuacacuguuaccucucuaaucuuagguccuauuauuucuuucccucacccagcuccaaucacuaugaccuccaugauguucacugcauuugcaguuuuucucuucuaggauguucuacccucaauuaucugcaguuuacuuccuuugguucuuugcucaagaaagcccugccacuuuaaaauugcauucaucccuccugcauaucauaucgauuucucccuugcuuuguuguucuccauagcacuuaucacccucugacaugccauauauuuuacauaugcuggugcuggauuucuccacuagaaugcaaccuccaugggagcagggauuucuguuaguuuuggucacuaccguauccucagccuccagaacaaugcuugcauauaguaagugcucaaaaacuauuaaagaacaaauaaaucugggagcccauagcgguccucaccuuaagauuacuggaccagauugugaauaucacaauagggcuagauuuugacauacacucaggaaucugggccuauacuaacaaaaaaugaacuuuauaucuacuuuccauuugaaccccugaguaaaguuaauccucuccuugucuuuccuguucaccucuuaacuuccuaccucccacaccacuauccuccauggucauuaccuaaagugcaaaacccucaggacacccauucaacucugcccugagaauaccugccuugucuuccuacaagaucuaaauauaaaauaucuccuuugaaaccuuccccuacacuccccuaauagaguuagucauucuuuucucuuuguuaucuggguacuuugggcaauccucuauguaguacucaaaaauauaaauaaguauagccuguugggcugggcgcgguagcucacgccuguaaucccagcacuuugggaggcugaggcggguggaucacgaggucaggaguucgagaccagccuggccaauauggugaaaccccgucucuauuaaaaauacaaaaauuggcagggugugguggcacgugccuguagucccagcuacucaggaggcugaggcagaagaauugcauaaacccaggagguugagguugcagugagccaaguucgugccauugcacuccagccugggcaacaagagugaaacuccaucucaaaaagaauaaaauaaaaaauaaaaauuaggcaagcaugauggugcaugccuauaauccuagcuacucaggaggcugaggaaggaggaucacuugggcccaggaguuccagguugcagugaguuaaaaaugcaccaccgcacucccgccuaggcaacagagugagauccugucucaacaacaacaacuucauaacauuuguaguaguugucaaauauuccguggagcuuauauacuuauucauguaucauuuuucaacuacuggauaauugagcugccucuaauuuuucauuauaauaauuagaugaauauucauucauucaacaaacaaaaaucagagcaccuauucuuugugaggcacugauagaugcuacagauaaaauggcauguauaaaaugcagaguucuugaccucaaauacauugcaaucuagcauuuuagccuugaauguaaugugauaugccuuaaauauaugaacuuuaugaguagacaaagacgucacaugaaaacuacauguuagugucucuuaugaauauaaaugcaaaaaucaucaacagaauacugucaaacugaagccaguggcagauaaaaagaauuauacaccaugauccaguaggauuuauccuaggaauucaagguuaguguaacauacaaaaaucaaucaaugaaauaugucauauaauagaauaaaagaaaaaaaacacacaugaccaaagaugcagaaaaagaauuagacagaauccagcauuuuuucaugagaaaaacauguaaacuaggaauugaagagaacuuccucaaccagauaaaagacaucuauuuuaaaaagcccacaguuaacaucauaguuaauggugacagaccagaugcuuucccucuaauaucaaguaaaagagaagauguccacucuuguuaccuguauucaacacugucuuauagguccuagggcaauuaggcaaguaagagaaauaaaagauaaaagucauccacauuagaaaggaagaaguaaaacucaugguuugcagauuacauuaucuuguauauugaaaacuguaggaaauccauuaaaaaccuaugccgaagaauacaaguugaauauacaaaaauauauuuguauauaguagcaaugaacauuaugaaaaugaaauuaagaaaacaauuccuuuacaauagcaucauaaagaauuaugcuuuaggaucauucguuauacuuaagaauaaauuuaacaaaagaaguccaaaacuuauacacugaaaacuacaaaacauuguugaaagaaauuaaauaucuaaauaaauggaaacacauccuguguuuguucauuggaagacuaaauauuaagacggcaauauucauggugaaacuccgucucuaaaaaaauuagccgggugugguggcacaggcccauagucccagcuauuaagggggcugaggugggaagacugcuugagccugggaggcagagguugcagugagccaagaucacaccauugcacuccaaucugggcaacaaagugagaccuugucucaaaaaaauaaagcaauauuccacaaauugauaugcagaaucgacucagucccuaucaaaaucucagcugaguuuugggagaaaacugaugaacuucuaaaaauaauaugaaaauaaagggauguaaaauagauaaaacaaucuuguaaaagaacaaaaucaguggacuugcauuuucaauuucaaaacuaacuacaaagcuacaguaaacaagacaguauggcaguggcauaaggauagacauauagaucaauggaacagaacugagauuccagaaauaaacccuuacauuuaagaacaacugauuuucaacaagagugccaagacaauucaauggaacugaaauaauugaauaaagucagacuccuaccucacaccauauacaauauuaacucaaagcaacucaaaggcauagauuuaaaaacuauaaaacucuuagaagaaaauacagggguaaauauuugugaccacugguuauacaaugguuucuuagauaugacaccaaaagcacaacaaaagaaaaaaauagauauacuggauguuaucaaaaucaaaacuuuucugcugcaaaugauaccaucaagaaagugaaaaggcaacacacagaaugggagaggauauuugcaaguuaaauaucugguaaggaacucauaucaagaauauauauuaaaaaaacucuuacaacucaaaaagacaacccaguuuaaaaugggcaaaggauuugaauaggcauuucuccaaagaagauauacaaauggccgauaagcacaugaaaagauguucaacaucauuagucauuagggaaaugcaagucagcacuccaaugaaauaccaccucacacccacuaggaugguuauaauuaaaaagacaacaaaugcugugaaagaugugaagaaauuagaacccucacacauuguuggugagaaugaagaauugugcugcacuuuggaaaacaguuuggcaguuucugaagauguuaaacauagaauuaccauaugaucuagcaauucuacucccagguauacacauaagggaaaugaaaacauaugugcacucaauaccuuguaaacaaauguucacaacagcauuauuauauucauaacacuaaaaaaguagaaacaacuucauguccauuaauucaugaauggauaaacaaaaugugguauauccauauaauggaauauaauuugguaauaaaaaggaauaaaguacugauauaugcuauaacaaaugaaccucaaaaauaugcuaagugacugggcgcaguggcucaugccuguaaucccagcacuuugggaggccaaggccggcagaucaugaggucaggaguucaagaacagcuuggccgacauacugaaaucccaucucuacuaaaaauacaaaauuuagcugggcaugguggcgcaugccuguaguuccagcuacuagggaggcugaggcaggagaauugcuugaauccaggaggcagagguugcagugagacaagaucaugccacugcacucuagccugagugacagagcaagacucugucucaaaaaaauaaauaaauacacacacacacacacacacacacacacacacacuaagugaaagaaccgagucauaaagaccacaauuuuauuaucccauguuauggacugaauuaaaauucauauguugaagcccuaacccccaaugugacuguuauuuggagauauagccuuuuaggagguaaauaagguuaaauuagaugauaagaauggggcccuaauccaguaguacugguguccuuacaagaaaaggaagagacaacagaggucucucuccaugugugacacauaaagcagagaccuucuacaagccaggaagagaggccucaccagaaaccaacccugaugguagaaccuugaucuugaucuugaacuuuuagucucuagaacuguaagaaaauaaauuucuguuguauuuuguuauggcagcuaucacagacuaauacauuccauuuauaugcaauguccaaaguaggcaaaucuaaagaggcagaaacuggcuguccaaggaagggaguuaggagugagaauagaauugggaaugaaugcuaauggguacagaauuucuucugggagugacaaaauaauguaaaauuagaugauggugauaguugugcaaaucuguuuacauacuuaaaaccacuaaguuguauacuuuaaaugaguggauuuaugugaauuauaucucaaaaagguauaaaagaaaaucacuacuucaauaauuuuuuaaaauagugacaugcugaaaaaugugucauuucuuaaaaauugaacuuaccaaauauuguauaauucuggaaagaaauguaaaacauggaagauauuuccucacagaaauggaaaaggauuucaacugcaguucuucuucagaagucuuuucaaauauugaaaaggaaguuacacaagcuauaaaaaaugccauuguugucacaacagagggcauuaggaguucauccuucaauagaagagguagcauacuguaaaggaaaauuuuuaaaaaucacaagagaauuaucaauucaaaccauaaccacuucauaaaaaaguuuuaaauuaguuuacaagaauuauacugaaaauauauggaaauugauaugacuuaccuaaauguugacacaaguaaaaaccaaguagacauaaaaggaauuucacuuaaaacuaagcagacuggucuaaaaucguaaagaaaaaaauauuuuaauauuacagaauauaacuucaacuccuaauuguaaaaaauauaaauacauuuuaucugucugauuuucagcgguagcuuaaaaacagccaggaaggucuucauauggacuacugauucauuuuguuaacaguccagacuaaauuagccuagacacaggcacagaggugucaacuccucauaauaauuggaaaacugcugcuuccaguaugccguuaauggaacuuuuuuucucuaucauacaaacaaguagcuuaagaaaaggaucagauaaacaaaucugagaaggcuuugucacauauuucguaguacuugguaaauaugaauucccaguauuguuuucaaacaucucuuuuauguucuuucauguuacauauuacuccgcuaaguuaaaacuaaagauauggcagacaacaucaucaugccacuggagaggacaagagagacaagaggauaaaggaaaacaaauugauaauaauaaaauuaaaaggaggaagaaauuaguaggaagagcuacauaaaaagggaaauaguauaggaacaggaagcacaaugccaauaaacagaaccacuggcuuuaucaaagaauuguuuaggggccaggcacaguggcucaggccuguaaucccaguacuuugguaggccaaggcugguagaucacuugaggucaggaguucgagaccagccuggccaacauggugaaaccccaucgcuacuaaaaauacaaaaaaaauuagcugggcuugguggugcgugccuguaaucccagcuacuugggaggcugaagcaggagaacugcuugaacccgggaggaggagguugcagugagcugagaucacaccacugcacuccagccugggcaacagagugagaugacagggcgagacuccaucuccaaaaaaaaaaaaaaaaaaaaaaaguuguuuagggucauagcucuaagcccuguaaccuccuuaccacaacuccugcuccaguaccuuugggauucaauuguggcaaugcucaaagaaggagcauugcuagugugaagcccugaguccugguccccauguuugcccuuuauuuacugugugaccuugagcaaaugauuaaucuauuuucuuaaguggaaauggaaauaauaauaauacccuguauucuuaaauaguugaaagaacucuuugcagguaucaucuaguguuuacuuuuuuaaaauacaauaaacuuuccuaaugauggugguuguugaauaauuguuaucauuauuuugaaucucuuuauuuuaaaaagugcucuauaaagauuugggcauucucccccuuucccagaaggaugacuuuuuccuaugucaacuaauauaugagauuuaaacccugggauuauaaacugaaaacuacuaaaagaaauuacuaggccgggcgcaguggcucacaccuguaaucgcagcacuuugggaggcugagacaggcggaucacgaggucaggaguucaagaccauccuggccaacauggugaaaccccgucucuacuaaaaauacaaaaaaaaaaaaaaaaaaauuagcuggacacgguggugcgugccuguaaucccagcuacucaggaggcugaggcaggagaauugcuugaaccagggagucggagguugcagugagccgagaucgugccacugcacuccagccuggugacagagcaagacuccaucucaaagaaagaaauuacuagaggacuuuccauuucacugcuugagaauggacgcauauuaauagcaagcucauugaaggugcucaauaaauacuguuuucucuuucugguuuaauucuuucccauuuaugcauucaauauuuauuuaccaaacacaagcauugacaaaaaauguauuacagccggcgcaggggcucacaacuguaauccuggcacuuuuggaggccaaggugggaggaucacuugagcccaggaauucaagaccagccuagagaauauagcaagacaccaccuccacaaaaaauuuacaaauuagccuggcauggugacgcacgccugggguacuuguuacuugggaggcugaagugggaggcucacuugagcccaggaguccgaggcugcagugagcuaugaccaugucacuuugcuccagccugggugacuaagugagaccuugucucuuaaaaaaacuuacuacauauaagcacugcucugaaaggaauacaaagaugauuauaacucagcuccuaaccucaaaguacuuacaauucaucaccaaacagugaaaugcccuacauccucaaccucuucucugaaccccucccuuuaccaccuuguuugaaacaaugccuggcucucuccucugaggacaguacugcccucugcccucucaacugugccuguuuuuguuguuuccacagucuucaagugacuuggccugauggugggaaguaaccuccuugaucuuccucacuacuuuccuaccaguucucccucucuccacccuaauaaucuccagcuuugaaacucuucucaucacacuuuauccccgauuauuccccaucuuguaaauacugaccaaccacagggccgcuuccuccauuacccaaagauuucaacuccuuucucacuaucacucucuacaaacugacuuaauucuuggcaauuuuaacauauacauagaucuucccucucauuugcuauaacgccucucuucuagugaucucaucuuuaauccugucccuuacggucauacuuuagacugcaccuccuccaugacucucaccacuaucuccugccuuuuggauauuccaacuccgacaaucuuuugauccuaccgagaucuucaauccauuguuccuaccacguuuucacuuucccucaucgcuucgauggccuuuucccuuuuuaccuaccuuaaauucuaaggucaaucauuauaaucacucccauacauucacucuuaagcccucaagcaagggaguuauccucaccagacaaaaccauaaaccuggaaauacucaacucuccaccagugcuuacuccaaccauacugaacaacugcucaagagaaaaacagcuacccauacuaacuggucucacuuuaaauacaugaucaugauauucaagugcccugcaauuacuauauauuucccugaucuguuuacacucugucucuccuuagaaaauguuucacacuucucccuccuacuuccaacagcuucaacccacucuuggcuaaugacuuucccucucacuucaauaagaaaacugaagcaguuaaaacagaacuuucacagaugcccaccaucacauuuacucccuucccagcaucucuaccaauauagccuguucaccccuuuuacuaaagaggaacucuucacacaucuguccaaugccaauucuuccauuugugcucuagauccuaccccaucucccuuucccaaugacagugcuccagcagcuccuccucuugagauccuguaccaucagcuuuccuucucugcugaucauuccccugccuuuauugcuccucucuuaaacaaacaaaccuaucuugaccccauuuucucuaccaguuauugcccuauuuuucugcuuccuuuuucaacaaaacuccucugaagaacagucuaccuuccucacaccauauauaaaaacucaacugggcacaguggcucacgccuguaaucccagcacuuugggaggccaaggcaggcagaucacuugaggucaggaguucgagaccagccugaccaacauaauuaaaucccugucucuacuaaaaauacaaaaauuagccagcuguuguggcgggcaacuauagucccagcuacuugggaggcugaggcaggagaaucucuugaaccuaguagguggagguuguagugagcuaagauugcaccacuguacucuaaccucggugacagaccgaggcucugucucaaaaaaaaaaaaaaaaaaaaaauuaacucaaaauggaucaaagacauaaauauaagagcuaaauccauaaaacucuuagaaggaaaaugaggguaaaucuuuauuuccuugaguuuggcacugguuucuuagauauauaucaaaaguacaaucaaaagacaagauagguaaauuagacuucaucaaaauuaaaaacuuuugugcaucaaaagaacacuaucaagaggguaaaaaagacaacccaaagaaugggagaaaauauuugcaaaucauauaucugauaaaggcuaguacccaggauacauaaagaacuccuaaaacucaaaaaaugacaacccaauuaaaaauugggcaaaacggccaagcgcagugguucacgccuguaaucccagcacuuugggaggccgaggcggguggaucacgaggucaggaguucaagaccagccuggccaacauagugaaaccccaucucuacuaaaaaugcaaaaauuagccaggugugguggcacgcgccuguagucccagcuacucgggaggcugaggcaggagaaucacuugaacccgggaggcggagguugcagugagcugagaccgugccauugcauuccagccugggugacagagcgagacuccgucucaaaaaaaaaauaggcaaaggauuuaaauaggcuugucucugaagaagauagacauauugugccaacaagcacauaaagagauguucaauaucauuaguaauuagggauaugcaaaucagaaucacgaugagauaccacucauauccacuagcauggcuauaaucaaaaugauggaaaauaacaagugcuaucaaggauauggagaaauugaagccuucauauauuauuagugggaauguuaaguggugcagccacuauggaaaagucuggugguuccucaauaaguuaaauacagaauugccaugugacucagcaauucuacuccugaguauagacucaaacaaaaacuuguacaugaauauucacaguggcacuauucacaacagccaaaacaugguaacaacccaauguccaucaacugaggaaugaugaacaaaauguaguguaucgauacaaugcaauacuauucaggcauaaaaaagaauacaguucugauacaacauggaugaaccuugaaaauauuaagaagcuagacacaaaagaccacauauaauaugauuccauuuauauaaaauauccagaauagacaaauccacagagauuugcagaaagcagauuagugguuagagggacucggggaagggaaaauggagagggacugcuuuggguaugggauuuccuuuugcggugaugaagauguucuggagguagauaguggugaugcuugcacaacagugugaauguacuaauugacaauguaacauuuaugcuauguguacuuuaacacaauuuuaaaaauauaauuuuaaauauuucuuuuaaaaaaugaauuaucagccaggcgcaguggcucaugccuguaaucccagcacuuugggaggccaaggcaggggaaucaguugaggucaggaauucgagaccagccuggccaacauggugaaacccuuucucuuccaaaaauacaaaaauuagcugggcgugguggugugcgucuguagucccagcuacuggggaggcugaugugggagaaucgcuugaacccgggaggcagaggcugcagugagcaaagaucacgccacugcacucuagcaugggugacagaguaagacccugccucaaaaaaaaaaaaaaaaauugcauuaucccuacuugucuuuaguucuucuccucucauuuuuucuauuuuuguuuccuuuguuuuuugagacggaguuuugcucucguugcccaugcuggaaugcaauggugcaaucuuggcucaccgcaaccuccaccuccuggguucaagcaauucuccugccucacccucccgaguagcugggauuacaggcaugcaucaccacacccagcuaauuuuguaauuuuaguagagacaggguuucuccauauuggucaggcuggucuugaacucccaaccucagaugauccacccgccugggccucccaaagugcugggauuacaggcaugagccacugugcccggcccauuuuuucuuaacccuaccuaaucaggcuucuccgugcauugcuccaccaacacuggccccaccaaagucaccagugacuuccauauugcuaaggcaaauaauauauucccagcccucaucuuauuugaccuauaagcagcaucugaugcaacuuaccaccucauuuccuuaauacaccuucuuuuauauauauauauuuauauauauauuuauauuuauauauauauuuauauauauauuuauauuuauauauauauuuauauuuauauagauauauauuuauauauauuuauacuuauauauauuuauauuuauauagauauauauuuauauuccuauagauauauauucauauauagauauauauuuauaucuauauaaauauauauauuuauauauauauuuauaucuauauaaauauauauauuuauauauauauuuauauuuauauaaauauauauuuauauucauauagauauauauuuauauaaauauaaauucauaguuauauauauauuuauauuuauauauauuuauauauuuauuuauauauuuauauauauuuauauuuauauauuuauauauuuauuuauauagauauuuauauaaauagauauuuauauauaaauuauauauauacauauauguauauauauauacuuuaaguucugggauacaugugcagaacaugcagguuuguuacauagguauacacgugccauggugguuugcugcacccaucaaccugucaucuacauuacguauuucucccuaaugcuaucccuccccuagcccccaccccccaacaggccagugugugauguucccuuccguuuccauguguucugauuguucaacucccacuuaugagugagaacacgugguguuugguuuucuguugcuguguuaguuugcugagaaugaugguuuccagcugcaucugugucccugcaaaggacaugaacucauccuucuuuuuggccgcauaauauuccaugguguguaugugccacauuuucuuaauccaaucuaucauugaugggcaucuggguuuguuccaagucuuugcuaucaugaauagugcugcaauaaacauacaugugcaugugucuuuauaguagaaugauuuauaauccuuugaguauauacccaguaaugggauugcuaggucaaaugauuucuaauccuuuggguauauacucaguaaugggauugcugggucaaaugguauuucugguucuagauccuugaggcaucaccacacuaucuuccacaaugguugaacuaauauacacucccaccaacaguauaaaagcauuccuauuucuccacaaacucuccaguaucuguuguuuccugacuuuuuaaugaucacugaggcaggagaaucgcuugaacuagggaggcggagguuguggugagccaagaucacgcuauugcacuccagcuugggcaacaagagcaaaacuccaucucaaaaauaauaauaaaauaaaauaaaauugcaaccgcuaccugcaucccauccuccaguacuccuaauuacucuugcucuguuuuauuucuccaucaugguauuuauuaccuucuaacacacucacuucuuuuuuuuuuuuaauaagugucuaucuuuaagaaugauagcuaagaaggcagggauuuuugucuggaauauaucccaugugcacaaaacagugccugauaaauagaaggcacucaauaaauauuuacugaaugaaauauuuguuuaaugauaugauuagcugggaccaggucaaaaggaacuuuuauuuaauuuuuuuuuuuuuuuugagacagagucucagucugucgcccaggcuggagugcaguggugcagucucagcucacugcaaccuccaccuccuggguucaagcaauucuccugccucagccucccaaguagcugggauuacaggugcccgccaccaugcccggcuaauuuuuuuguauuuuuaguagagacaggguuucaccguguuagucaggauggugucgaucuccugaccucaugaucugccugccucagccucccaaagugcugggauuacaggcuugagccaccagguccagcccaaaaggaacuuuuaaugcaaacuguaaaaccauuuaccaaaaauagauuaaagccaugcacuguuacaaauaaucuaggugcauuuguaaaaaaugaaccccuagaaguucagugucugagaacuaaucuggucagauuauagguccugaaugagcugccuuucuaugaguauaaauucuggggaaauauauuaauacauguuugaaaguaaugccucuccacaguuucauccccugguaccagugauuuguguagggucagccuagccucauacaauagugguaagcucuaacucagguuugggccucagaggauggcauuaagcagucuucccagucuacaaugauaugagacuguuuuauuuagagccaagaagccuuccacacaggccagcccagcucugcacgaagguuuuaguccaaagcuccaccuaauaaaagcaauacugccugccauuugucauuggucauucuguacauguaucuuccacaggauccuagugaacauagggugagggguagagcaguaguggguugggauugaccuagaggaggauuucaguauuccaaaggguucuaugugaauacuauuuuaauauuaggauaucauacucccagcugucauccacugcuuucuaugaacaucaggaaaaaaauuuaaugcuucuaaaacaaaguagucugguuacagauugccaauagggccuaaacuaagcuuguggcaaaaaaagagaaagaaggcaacauacaaaagaccccauggaaguaaauggaaagaagaaggcuaccgaauagauguggaaaugaaugaaaugaaaaagcaaagaugacaaacaggcuccaaucugaugaaaaccucuuugaaggauauauuuuuuauuagcauguagaaaauauaagugaaggaacaggaagaaauuacuauuaugucaauaacauucuaccaaaauuuuucaguuuaaaauacacuuuauaaagaaaaucaaaaauucuggaaaaaaaccugacuaugaaaucauuuuaugcaaagauauaacauuuguguaguuuuguuuugcauucaaauguauauuuguauguaaauuauaaaguuauauuauaaacaaauaaacacauauuucaaauguuucuacuuacagugacaccaagagaauggauuuuucauguacuuggaaagaaaauaaaaagaaugauagcgcacagcuaaccuuuaagaaaaaagggggggaaaugagauauaacaacuugugaaauagcauaucaaguuaauuauagaaucuaaauaaaaaucauuucaaaugaaaguugaaaguuuauuaaagcucuauuuagaaguaaaauacaaacaacacuaguaugcauauuuuaaucaaauuaaaaaauugacauauuuuuucaaaaaacaaugauuauaaagcuuuauuuaaccaucuaaguucaucauaacucaguuauuaauaaacagaacuaguaaauaccucagacacaacaaucauacauucauccuccccuggaaucucagacaacuuaaauuuaaaaccaugaaagacaagaaggucagaaucuaaaaccggcaaaacaaaucuauuuugguguuuuaaaacaugcacuucaauaaaauauauuaauguuuuauaaauuaauaaugugcuauuuagaguuuaaaaaaaauuaucuauuuugagaaguuuauauucugcaaauuagauauggauaacuauccaguugcucaagcaaaaaccuugaaucuuauccaugcuacacaucuaacccaucagcaaaugcuaucuacagcaccuccuaaauacaauauccauccacuucucuccauuccccucugcuaaggguggcagaggaguggucuaagccacccuccaucuuuguaguagugcaauaaucuccuaauugguaacacuccugccuccugauaguccauucuccaaacagcuaccauaucagaucauguaauuuuccuguuuaaaauccuccaauagcuuccuauuauacuuagaaaaaaaucccaaugccuacaagaucugguuccugccuucccuuccaacucaucucuuguaucucccucacucauuuuacagcagccacuucauucaucuccuuuugccaaauguguuccugccuuaaggaaaaauaugauucuaucaagucagggcccagaucuucuugugauuggcuccuucugguuggucauucacuucuuggcucaaauacuauuuuaauauuuaauauuuauaaauauuauuauuuaauaauuuaauaauuuauuaaauauuaaauuauuaaauuuaauauuuaauaauaaagcuacucagaaaaacccuaaacuauagaaaccuucucuagaaagguuuccuuuacucaaucuaaguguccccuaaccucauuccaucagcucucuuuucacauaacacuacuuuuuuuuuuuuuugagauggaguuucacucuuguugcccaggcuggagugcaguggcgcaaucuccacucgccgcaaccuccgccucccagguucaagcgauucuccugccucagccucccaguagcuaggauuacaggcaugaaccacgacgccuggcaaauuuuguauuuuuaguagagacaggguuucuccauguuggucaggcuggucuugaacucccaaccucaggugauccaccugccucggccucccaaagugcugggauuacaggugugagccaccgugcccggccaacacuacuuucuucauagcacucauuacucccagaugcuuucuuguuaauggauuuaucuuguuuauugucccucuccugccacuagcauggaaggccccaaguaagagagcagggaugucaucugucauuccuuuacaugccaguaccuagaggaggaccuggcauaugagaaggcacucaauaccugaaaaauuaaauauaaauccuuuugcugcuauacaugcaccaguauucaugcuaucaguuaccucaauuauagauuuauauugagauauaauucaggcaaacaugauugaaaggaaaauacuuuuaaaacaauuauaaugggaaauguucuuaaaacucucagaaguauacaauaagaauucaaagcaugauuaacaaaaacaaaauaacaaaaaucuuacauuuaaaaaguuuuaacacaauggcuucuuuuaaaacauaccaaacugaaaaaaauuacaaaacuaagaaaaagaaaauguuuuuucuggcuuauaauccuaaaaguaaucaucucuaacacugcuaaaguuacccaaacucugaaauucuauucuauuaucuuugaacuguacauuuauuuagcauucuacuuccuagaaaaacaacaaucuaucacaagcuuggaagauauuucagguuaagccuagugaagacaucagagcauuacaccauauccauucuguucuaacuauccaauagaauauuaacaacagaugacuugguaugcucagaguucauucacagaaucaaacaacacaaaucaucaauaaaaagauaaugaaaaagaaaagaggaacauaaagcuauccuuuuugcauugugguaaugagaugcacuuuugaaguauuucgcuguuauguucuuuucuggcuuguuuuuauccaacguacuuacauggcagucccagacuuggaacccuaauuucuaaauguugccucacauaaguccaguaggacuuacuguuuucagaaacuaaauguucuugauaguuuaaaagguuauuuuuuaaaugucauuuuauagaccauggcacacaggaacaaaauuuuaaaugccauagaaacacaaccaagaagacuuuguaaagcuacucagaaaaacccuaaacuguagaaaaugcaccuaguccaucuucaaacugacacaagucauccuccuaaaacagagaucugcccccucuccuucucaaaaauauuuuuuaguuucucuugcacacaaaucaaacuccaaaccuuuucaaccaagauuuucaaggucuucaauaauuuggucaauuuuuacccuuaucuuucacuauauccucuccuacucucaacacauacacacaaaacucacacaaguuauauuguuuaauagcuauucccagaauauccuguguccuuucccaccucuggaccuucaacuucuuccuucuguuuugaacuucucuucugcuauauaaccugcuguucuaaccuugccccacuuucaaauuugggcucaaaucccacuugcccuaaacagcauucuaaaaucuccccccgagauaauaucucccuuucccacaccaucauaggacuucauuuguaccugauagaacuuaauaccaucuguuuuauagcauaacuauuuaagcuacuuaaguucauugccacuguuuucuacuuuguagucccucauuaacuaauacgaaacaaauuaaauaguugaauuaacugaaagaguauugauugcuuagcuuagugucuaacacagaagcuaaguaugggaaacauccaauaaaugucugccaaauaaaugaaugucuuguuucccaacccaauaaauccugugcagaccaugaaaauaauuuuuaaaagaucaguuguggcaagaauuaaguaucuaaaguaaugaaaaacuuaccaguguaaauuugaauccuuuggaagagggcugaaguauuaauuuuaugcaugcaggaagcaggcucaaaaacguagaacaaaagcuaaaaaauuaauacaaaucaaauauuugucuucuuuguagagguauaaaucuagcuuaaauaaggaaauauuuuuuaaauauaaggaucauauuauuuaucaacuuaaguuuauuucaaacuauauuuuuauuuauuaaauuuaaagaugaaauaacauuuaaacaaaaucuacacauugauauauauauauacuuuuauacacgauuacauaauauagaccaaacaugauaaaacuaaauauugcuucuguuauuuuaguauuuaauaucauguauagaaaauauacaaagauacauaguugaaggucaauuaucaaacacucaaaauaagaaaacauaaugaaguauaagagauaaugcuauaucuguaacacaaacauucauaaacuuuacucacaaaagagucucucuagcccucauuucacaaacauugauuaucugauuuucaagcccaugguaaaucauaaagaacaagguggaaagggagcaggaagcuacuagagcuucuccuaaugauggcuaaugggugggaggaaaaagaacuagaaaaagcagacagacucaacaagcaaaguggccuggaaccauuuaguacuaugggaaauagccccugaaagcccugaaaacaaguauauaaccuaauacaauaacugauuuuucccaguuguagauuuugacucaucaacuuggcuaggcugaacuaaugucccuagaauucccuuccuguaugccuuuguuagggugggcuacaagggaaauucucauaagauuuggaagacagagaggccacacccaucucaucucccaguuauuugaacacuaaucugcugugaaagaauuuugcagaugugaaaccccuacucagcugauuuuaaauuaaucaaaagggaucuuguccugaggcgccuaacuuaaucaaauaaaagcccuuuaaaagacggcugaggccuucccuaacagcaucugggucugaauugcucuuccuuccccccuagauauucccuccugacugccugccuugugacuucuguuuugcuuagcuaggcccuacaacuguauaagccaauuccuugucacgaauucacacacacacaguacacagugaucuccuacuccuacuucuuggauugauccugacugauacacacugaauaucaugacucuucaacauaauauuaaucguauuuaauguacucucuguucaaggagagaacaagguaacaauucagaaauuuucacauaaaauaauucaaguugaagaguuuuauuguacagagcaauaggucuuuuauguggaaaauccucuaaagaaaaacaccucggcugggugcaguggcucaugccuguaaucccagcacuuugggaggccgagguggguggaucaccugaggucaggaguucgagaccagccuggccaaaauggugaaaccucaucuuuacuaaaauacaaaaauuagcuggccauguggcgggcgccuguaaucccagcuacuccagaggcugaggcaggagaaucacuugaacccaggagacagagacugcagugagccgagcucaagccacugcacuccaaccugggugacagagccagacucugucucaaaaaaaaaaaaaagaaaagaaaaacaccucauucccuaaugaugccaaauaaaugaaauaauaccauaaugcuuuuaaagaguaacuuauaaaauacuacauacaaacuuuguuucucuuaccucauuauuaauuggaugugacguggcaaaauauccuuaaucuucagaaagacauugaagcugcaccaaauauuggcuacuuuauccuuaaaagagauuuguuagcuuuacauucugguauaauugaaagaaauauuaaaacccaugaaguacagcccauaaucucuaauaaacuuuuugagaugugaaacuuuuagucacaauuauaacuaaauagauuaaauccuccaggaauaaacauauacgcauacacugucucaagcauuuuucauuuuugugcagggcaguugaucaaaagcauuggcccaccauaauccagacauucccaaauacuuaauaguuuucaaagagcagugcacuaucccugaauacuaaaguccuucaucuuuggaaauuuuucuaagaaauguuuuuucuacaauuuauagaauacauauuacauuugacccauuuuuaucacacaacugaauuuacuuagaguaacagaguaaccugcuagcuacuagcaaugacaagagcuaauugcuaauaaaucaaagucuaaagacauuagcaguugugcuaggaucacuuucaaaauuaaguuuguaacuacagcucuccugguggugaaauccguucucuacacagcugcuugacuuacagcugugcagacuuaacaucaaaaaaguaacuaucacugacaacuauaucaucccacuuuccucugcuggaucaaagaaaaugcuuuucagauuuugaaggcaagaagugaauggaagagacuggcaacaccaucaaacaugucugauacucauuuuuauaauuaucaugauaaaugccauuucugaaauggaagguaaggcaaauaauuaggcagcuuacauagagaguuaaacuuuucuuuauguaaguguuagaguuuauauaaagaagagguuaggaaaacaauuuuccaaguucaagucacaguucugcuacauacuaguuauaggaaucuuugaccucaguuuucuaaucuguaaaguggagacaauagcuaccacaaagcuacuguaaagaucaaauaaaauuacauggaagugucuggcaccugcuaaguggugguuauaacaauagugauuauuuagaucaucacuaccaucauccuguugacauacagucacacauuucuguuccuucacaacaccaaacucccaucuuagucgcuuucaaaaugcugguuccaucuuccuauaagucuacugaaagauauucuauagaaauuuauauauucaaaacuuaggaaaauaugcuuuuaaaauuauuuuuaaaagaaaugcuagcaaauuaucuauaaauauguuguuucugucuaacuuuauuaaaaggccuuuuuguuucagaaaaaugguuuaauuuaauuaccaaaucuaaaugaucaaauuauucacauaauaaaaguuuaacaagagugauuaaacuagcauuaaaugaaaugaaaugaaagauucucauuaaaaauuacuauggaugaagguuauauaucucauaagaaauuaugagaucuuccugaagcaacaugauuauuaguuuuacaaauaauuuccuaagacuaaaaacagaauauacaccaaaaaauuacacagcuguuaaaauuguagcugaaacuucucaugcugucuuucauuacaaacccuauuucauuacaaaaacauauaauucaauuauggaucugaugauggcaugaauauuaccuauugauggaacauacuaaaaaaugccaccugagcuagggguuauauaauggauuaaauaacuagcaaggugcacacacccuguugucccagcuacuugggaggcaaaggcaggagaaucacuugagcccaggaguucaaggcuguagugcaccaugauuaccccugcgaauagccacugcccuccagccugggcaacagcaagauccugucucaaccaaucaauuaaucaaucaagcaauaacuggcaaggaaugauuacaggaggaaaguagcugaaguuccuauuccuuguaccuucuacaugaaaccccuaaaggucacagguaagguacaguaacagaaaggagaggaaaguguuuaaacaugccucaaauaauccacgaucaaccgggaagagucuucuuagaaccugcaggguuuguucccuuucuguaaagaauggcagccagcagagaacgaaggaagccacaacaauacaagcuagcuuaacuagcaacacaaaccuaaaacaaaaacaaagguaggcaguaagauagggaaaggucaguaauucugcaaaaucaaccugagucucacugaacauaauacaugcacauguauaguaaugccaaaucuauguuaccaauauaggcuuaagaugggagugugcucaaaucagagguaaaaaauucacaacagcuaagacgugcacuucaacaaaaggacuguuaucaccaucguaauuaacauuuauguuagaugccauuccuauaggaauaagagagugcauucaugaagaaaaauaucaaauggggauguauuucuaauaaguauauaauguaguaagcucuaaagugauaaaauccuacagcaaaguucuaacuacccaauccacacuaccaguaaauauacaugaauugaaauauuucucuaguuaggaaaauuaaaaauaaaauacagaacaugacuuaaucucucucuucccacauacccuacagccaaaauauuuauaagaaaucaccaaaaggcaaagugaaagaucaucuuacugcaaguaaguaugccaaaaaaauuaucugaaguaaauuuuuggauucuaguguuuaaaagucacucaccccuuuccuuugaggccuuuuuuaaaacacuugccaaguaaaaagcaaaaaaauggcaaggcgugguaaaguuccaucuguuuauaauuuauagcuaagcaaaaugccagugacccuaggaggucgcagucacaagauauuccaagaacaccccacaaagcaaagccaagacucacagaauuauauauguuccugugucaaggaaauuaucucaauaaucuuuuaaaaagauagagcuuuuaaaaagcaaaucacacaagagauaugcucuaggaaaugcaagcucauagcauaucucuuaugugauuuuaaaauaacauauacaaugaaagcuauuucccaauagaaauucaaaguacugaagugauaaacaaacaugaaauuauguauaacagcaucaaauacauuaaaucuacugcuaagcagcaacugauuuguuuugguuuaaaagagcucuaaagauuuaaaacauagcuuuguuucuguuagauuacuucacaauauuauuauaacauaccaaaaucuagagaauaaaacaauguuccaacagcaaguuaaaaaaaaauuuacugagaucgcuacacuuccucuauuauauauauuaauaguauaaaguaauauauguacuuaauuagaaacuaacaacauuguuaauuaaaacaauaucacaauuagauuuucaguucaaaauggugagcuaggcacuaauguuuaccuccucuccuucccgagagacucuuaaaauaauaggaaaaggaauuuaauaguauaaauucaggccagaagucguggcucacaccuguaaacccaacacuuuggaaggccaaggcaggaagauugcuugagccaggaguuugagaccagccucagcaacauggcaaaaccccaucucuacaaaaaaauuuuuaaauuagccgagugugguggugcaagccuggaguccuaguuacccaagaagcugaggcaggaggacugcuugagcccaggaaguugaggcugcagugagcuaugaucaugccacugcacuccagcuugggcaagagagcaagaaaacaaaaacaaacaaacaaaaaguauaaauucacagccauaaagagaaugggaggaucuguuauaauagauaaagauuucaacauauuucuggaagacagaagugauaacaaauaaaauaggaugaaggaagccacagcuuagaguauauacauagaggagacucaggguagcaaaaagccaauccacccugcaagacccuagagaacuuuggaaacaccaaguagguuacagucuuugaguaguaugugcagaagaaaacaagagauuaacugaaaaucccuagagguagaagucaaaucuuaccccacucccaugcaaagauuaucuggcagccaaacauuuaccccaaggcaacaaaagagggcauauuuuucugaagaaaugaacuaaacuauccaguguagagguuagcacuauaaugcaaaccccuccacauucugacauuuaagcaucucaaugcgugguggccagcuugcuccccacuuauccuagaguggaccaaugauauauagaagucauaugcagguguucuugccuuauucuuaaauaaaaauagauacacuaggauaaaauaaacauuuauagaaaaccuaugacagaaaaagaaucgaaaugaaagggaaacuaaaugaccaugaaagaauuaaaaucacucagggaacaguagugaacuuuaccaaaaaaacaaaaaguaguaaauucuaauuagaaauuaaaaauauaccuaacaauacaaaugaaauucgauagaaguguuggggauaaacucaagauaacccaacccauaaaacaaaagagaaagggaugcaaaagaucaaacaucugacuaauaggcucaagaaagaaaaaagugagaaaaucaucaaagaaauaauauaacagaauuuagcagaacagaagaacaugagucuucaaaacguauggacccauauacgguuuggauauccaaaacaauugugaaaaacaccuaugucuaaacaaaucacuguaaaauuucagaaccacaaaaauaaauuauaaaaaugguaauaauagcaacaaaugccuauauaaugcuuagugucucccaggaacugucuuaagugcuuuacaaauauuaauucauuuaauuaucaaacuaagcuuacaaagucaggguuucuauuauccacauuuugcaaaugagaaaaguacauaaugguuaaaaaauguguccuuagagcuaggcacaguggcucacaccuauaaucccagcacucugggaggccaagguggguggaucacuugaggucaggaguuugagaccagucuggccaacacagugaaacccugucucuacuaaaaauacaaaaauuaacagggugugguggcacaugccuauaaucccagcuacuuaggaggcugaggcaggaguaucguuugaacccaggaggcagagguugcagcgagccaaaaucacgccauugcauuccagcauggcggacaagagcgaaacuccgaaacuccgucucaaaagaaaaaaauguauccuuacaagauaacauaugccugaaagccuucagaguuuaacucaaaucacaggggacauacuacuacaaauuuuccagaauggcuaaaucgaaaaccauugacaguuggucaagauguagagcaucuggaacucuuacaccauuguuaugagagucuuaauugguacaugcugcuaaaaacaacuugggauuaucuaaaaaucgacaugugcacacucuauaacucaacaauuccacuuauaagaagaauguuuauauauguacaaggagauauuuauaagauguucauggcagcauuauucgucauggcccaaacugggaaacaacccaaauuacucucucagugauagaauuacauguauucaugcaauggaauaucguaaagcaaugaaagugaacacugaauucacuuucauaguuuuuuaacaaacugcagcuacacacaacuacaugaauacaucucauaaacaaaauguucagcccaaaacaucaaacacaaaagaauacuuacuaugcugucccuuucauauaaaauucaaaaaaggggaaaacuauaggauuaguaguuaguucagggguaccauugggaaaggaggagggagaaggauggggagguguacaaggguaguuuuuggauacuaguaauguucuauuucuugacaugagugguaguuugccaacucacugagcuguacauuuauauuuugcauaguuuucugcaugagugucacauuucaaaguaaauauaguuuuaaaacucugguagauaacauuuuuuccuuuucuaucacuguucuugauauuaucagaguaucugauagccaugaucccauaaacaaugucaaaauuuuuaaaaaacuaaauuaguaaaguggacagaauauaaaauauaugauaaaaacaacuacagacuugaauaucuuuuauuuguaaguccuuugacagauauaccuauuaguguuauuauaacuaaaacaagacuggcaucaaaaggaaaagcuauuaauuaaauaaucauguugcuguguaaugucgucuuuuuuuccuuuaagagagauggagacagguaauaacauucaauauauuauaagacaaauuagauagauauauacagauuuuuaucaauuuauucucaucuaagcuuuguuugaauguuccuuauuuuaggcaucaaaaaaauacacauauaaaagccauauuuugauuaucaguuuuaguuuccugaagcuucuagcuacuacuaucugauagaaaaaaaauuuuuaaacucauaaaacuguaagaucauucuccuuuuuucacgucagauaacauuuacaaaggauagaagacauguuacacuuuagaauuacuagaguauaaccauacuuggcacucuuuuuccaacaccccagaaagagcuaaucauuuaccaacauuuuguucccaaucaaacaacaugaaaaagcaauucuacuuuuaauaaaucuguacuuuaccuuucaaauaaaagcuuagugaagagauucuuuuauauuauugugaaauaguuuauauaagcaagcacucuaucaaauaagacauuacuagaugacagcaauguacacauugagucuagauuucacaauaugcaacugacuucauuucugcauuaguaaaggauacugaaaauguccauagucuauaagaauaaggccuggauacagcaagaugcauaaugcauuagcaaucuguaaagacaaauauugugagauaagaaaguaaucuguuacacaaaucaagcaggguaaaagugugguuuuuaucuaacacauuagcaaauguuccccuuuuccagaggugucacacuuucuuuucauaaaauauucaauuuuuauaauacaacucuuuagacaaugaaguuuucaugaaggugacauuggacacuuccauaaaaaggaaaaacaaaaccacuaaaagguuuugucagaggaaguacuuucagauacacaaacuggagaagucaaucuaauguuaaccuaucuaaaaugaccaaaaauaauauuugauaacuaugaauuaagaauauacaacaacuuuucaaaaugccuuucaguuuggucaaucucacaagccagcucaaaauucagcuuuaccaguaaaguaacaaauucagcaaggcauguaguucaacaguacauaacuuccaagauucaguguaucuuaguaguacacuaaaauaauuaauuacuguaagauaaguugaugcuuuugaagugaaaauugauagaagauacaauauuccuaauuacucucuuuccaaaagcauggcuucucuaaggucuauacuuaauaguuagacuaauaaagaauacauuucagagacgaacugucaggcugcuugaaaaccuaccuuuuucuuaguugagauuucuuuuaagcaacaacaguacaaaaccacugcagguauguaaaucagcagaucagcaauuaaaacugaaaacacaaguaaauaacuuuaaacaugaguccaucaggauuuacagcuacccauuaacugccucccuuccuccaacauugagaauucauuaacacaagguucuugcccuacuauggacaaguccuuuacacagucagcacuuuucaaucccuucaccugugacuaauuucaauugcuguauugcaaaggagucucuuaauuuucucuaacaaauucacacauuuaaucaaucagauguaucuaacauucucucuuugcucuaacuuggacuuaaaaauauucaaagcaaggaaauauuuuuuuccucaaucuauauacucugaauuuucuaguauaaagaauaacugaaauguagugauguguaagaaaaucuuuuuuaaauguuggucuuuauugaaaaaauauaaacuuuugcuaauuaaugcauauaaagagcuugagaaacccaggugaggagaaaacugaaaaaaaaauccuaaaaaaagaaaagcaauucauaauuuugaacaugcaguccuuuagaacaaagaaaaauaaauacauaaguucuucaaauguauaacauagcugucuaaagagcuuauuuuuuucuuauaucucacuuagugucaagaaaaaggugacaguaaacuaucaaucuaucaacugaaaucuaucaauauguucagcuccagaugccacauuaaagaugacacugacaaacuggaacacacccaaaagaguggcgagaguccucaaaaccauaaucacauucaacaaauugcucaucuaaggaauagcugaaguauauaggaaucuuuaacuuagagaagaggugacuucaaauuccuguaggauguuagggauacaagggaucagacuuguucucuguaacccuagaaaacauaaucuguaaugacugguggaaguucaauuuagaaaguaauuuuuaaugacuggagcucucugaaaacagaauagacugucucuaaagguugugaguucccugcaaguauggauauugguucagaagccaaauaaucacaugguguguaugugguucagaaaggauuaaagcauuggagagggaagggcaguggugugggagagggaaagacaggaaaaacagguuaucucuugggccuaagauuccaugacuggaugaauuguaaggagaacaaacucugacuacauuuagacuaauuaaggaaaaggacugggcuuuuaaagcauuaaagcauaagucauguaaagcucuuaaagaaaucuaagcuuauuacuuucaagcuccuacaacagcacacacacaugcucaauaaacauuuguuguguggauuauuuaauuuagaaacugcacaacaauacaauguauaagaugauaacugcaagguuugcuuuaagaaaaaaugaaagaaauuuagaauuaggauauuaaagcagcacccuaaaaaacuaaagauucaauuuauagcuaucuugcuucauuuaacuaugccucaguuuccucagcuuaaaauaagaauaauaguauuuaucucauuuagguguucaaagaauuaagucagauaaaaaauguaaagcacccagaauuauuccuuucuacucuuucaaguuuuagcuuacauauacauuuggucuuggaucauguauacaaauauguauauuuguaaauauauguguuuguguaauugcacaauuuuaaagucaguaagaacaauaauaguaccuuuaccaguuuguccaaaauuuuuaaaaaaucaaauuuuauauucacuacccauugcucuuuuaccuguuguacgcaugaagagcuuaugugccugacucucauauccacgugauguauggagagcaauccagucuggauuuauaaacuuugcccugcaaaucaaagcauauauacagauacuucauuccucaucccuuuuagcaauaaagauauugaaggauauaugaauguauuaauauuuugagaauuggccauuucucuuauaaagcaacagagucaaugcuuaaguuuuacucuuuuuauuuaaucaugugaaacugacuuaagcuauaaaacagcaucuacauugcuuaccuuccaacaaaacuauguaagguauaacuacaagcccuaucuucacaguucuuccaguguaaaaacaaucuggcaugucacauuucauuuaccaaacacauacuuuauaaaaagcaauaugcuaguguugaccagaggaucaucuuuacaauuuauaauauuuuaguuaucauaacaauuggcuacaauaaacagcuauaauaaucauaaaucacugcauaaaacuaaacacaauuguuaaaugaaauuuucaaccauauuacaauuacccugaauacuauaaugaugauguuugggaguuuauuuucaauccaugaagcuuauuuuugcaaauauuaaauacacucauaacgacaccgcauaacgacauuucagucaacaauggaccauauguaggacaaugaucccauaagauuguacuaccauauuuuuacgcuagcuauguguugauauguuuaaauauacaaauaccauuguguuacaacugccuacaguauucaguacagugacaugcuguacagguuuguagccuaggaacaauaggcuaugcuauacgccuagauauaguaggcuauaccauuuugccuacuaaaguacccucuaugauguuugcauaaugaugaaaucaccuaaccacacauuucucagaauguauccccaucgugaagugacacagggcuguaaguagaaauuaaacaagaugaguucacgagauauugugaagagguuccucaaauuuuugcugacauacuucaaaucuaagauggaauaccacuacagaguagaacugggucuuuaccaaaacagaaguuccuuaucuucuauaacuauucaauuucuuuaaaaggaggaggaauucccauuuugaucuucaaucacaaaugaaacacuacaauuauucuaguuucuaacuugacagauuaguugguaaccaucuggaucuauauuuuucauuuacuuugagcuguuccagaaaaaaaacuuucuuauacacaacacauauuagauauauuucuuaguagucuacacauauggauaacaucucuacuucaaaacaaaacuagguuuuucacauuucuugcuagauguccuccaaaaaaauuauagaaauguucaaacuuugauaguucuuuuuuuuuuuuuuuuuuuuuuuuuugagauggagucucacucuguugcccaggauggaaugcaguggcgugaucucggcucacugcaaccuccaccuccuggguucaagcgauucuccugccucagccucccaaguagcugggacuacaggcaugugccaccacgccugacuaauuuuuguauuuuuaguagagaugggguuucaccauguuagccaggauggucuaaaucuccugaccucgugauccgcccgccucggccucccacagugcugggauuacaggcgugagccaccacucccagccaauaguuauuucuuaaaacccauuuguaauacacaauacaauagcaguggcugggugagguggcucaugccuguaaucccagcacuuugggaggcugaggugggcagaucacuuaaggucaggaguuugagaccagcuuggccaacauggugaaaccccgucucuacuaaaaauacaaacauuagccaggcaugguggcgggcaccuguacucccagcuacucaggaggcugaggcaagagaaucacuugagccuggaagguggagguugcaguaagccgagauuguaccacugcacuccagccugggcgauggagugagacuucaucucaaaaaaaaaaaaaaaaaaaaaaaauacaauagcagcuacaagcaaucucuccucuagucaagaaagccccaucacacugcuucuuacuaaaucugccaagggcauaaaaauuuagaguuacauuaagaaagaaaaacuuacacauaugcacauaggagacuaugauaagcuguaagagguggguaauccaauccccaauacuguaaauuguuaucacugcuguuaaaauaccugaaaaagaaaaaaagaagaaagcaccauuccguuaaucaauauucaagaaguagacuuauaauuuaacauugcaccucacuuaucuaagcuuaauaauguaauuuacuaauuauuaagcuauuaauaauuaagccaugucaauagacacaaaccaggacucuccuaggcaaacugggauuuacugucauccuacuauuaguagacuucaucaaugacuaacacucauacaacaaaaaauaugcaacaaaaagaauaggauuguuuguaaccaauucaaccaacauguaacgagagccucguuacgugcaaggcucucugaauuuuaggaagaaaaguaggucuaauguccacaaauugauaggcuccucugguuagccagaaugugaaggaaauauauacaacuaucaugacucgagaacuaaaaguuaaguuaaaauaauuucuuaaucauguccuuuacaacuaggcagcuucuucuucuauuccauuuauuuucucaaucauaagaauacaacagugcaagccaaacuauauaacccauaaauaaccauuguucauaagcuuauuucuuuuugagacggaaucuugcuccgucaccuagacuggagugcaguggcgcaaucucggcucacugcaacuuccgccuccuggguuuuuuuuuuuuuuaagcgauucuccugccucagccuccugaguagcuuggauuacaggcacccaccaccaggcccagcuaauuuuuguauuuuuaguagagacgggguuucaccauguuggccaggcuggucuugaacuccugaccucaagugauccacccuccucggccucccaaagugcugcgauuacaggggugagccaccaugcccggccuaacuuauuucaaaugggucacaauuccucacuaucacaaucucuuacuuuuugaauuaaaaauauuucuuuaaauuagcauucaacaugaucccaucaaauaaccuauuaaucaucuucggaaggucuauucuuagugucaguuacauaaaacauagguuuguauggaagagauggggauuaaaauuaucaaggcaugguagacagccaagacaucugggcauagaguacuacaguaugguaccagcugguggccauugucccuccagaaacauccaugugaacaaucuuggguuccaugucuggcugggacuugaagccaagaagcagcgagucuaagaaucucuggguuaguuggagccccuuuuggcagcuugaaucugggaaaccgggccaggcaaauaauggagaccaaaggacccacuuuucuagacagagauaccugaagacaggcaccaauuauaucauuuccaaauucauguuacuauauagcauaaaguuuuauuuuaucagccucagagcuguugaagcauugaguuaaacaaguaaagcugugaggucagugacugacacaaagugcucaauaguaguuccaauuggcuacuagccacaaaacaacuaagauggauacagcaauggaaaaccaucaaguaauucaagaaucacauuuuguccaauacaacuugauuugguuuucagcuucugaaaauagacaaaaccuauuuuuucauuuaguuuaaccuugagauccacuggagaugaguaaaagaggcauugacaguaagcugcaagcaugcaaugauauauacuaaaaauaaagucauugguuggauuaggaggaaaaaaauauaggauuuauaacagugcuccccauucuuauggaaauucauaaagcagaacaaagaggcauaagagaagauagcuuagaaguguuucaaguaaagcaucaaaauauaucaguaggaauaaagcaauuaguugauacuccugcuuuauauuuuauauauauauacauauauauacauauauauauacauauauauauacguauauauauauauacguauauauauauacauauauauacguauauauauauacguauauauauauacguauauauauauacauauauauacguauauauauauauauauauacguauauauauauauauuuuuuuuuuuuugagacagaguuuugcucuuguugcccaggcuggagugcaauguugcgaucuugguucacugcaaccuccgccucccagguucaagcgauucuccugccucagccuccugaguagcugggauuacaggcaugcaccaccacgcccagcuaauuucauauuuuuaguagagaugggguuucuccauguuggucaggcuggucucgaacuccugaccucgugaucugcccgccuuggucucccaaagugcugggauuacaggcguaagccacugcgcccggccuuacuuuagauauaucaauacccaaaaaguugucuaaauacuauuuauacauugaaauguauuuuuccacugaauucccauguaaucucaguagauguuuaguaaguaaaaaaaaaauggcugccacacgaauuauaaaauuacauucaagaguguuaccauuaacuuuaagauguaguuuucucuaacagacaacccacagagucauauuugguauuuuuguuuaaagaaaaaaauuuuuagccugaaacaguuucaaaguuacagaaaaguugcaagaauaguugaaauaacuuacauacaucaaaauguagaaaguuuuauaagacaacagacaccaauuacagaacaagacaagaacaaacagaaagaagacguuuauuuuauacacgcauacacacacaugaggaaaaugauuaaaguguacaguacugcuauacugucgugguagacagacuuuaaggucaccacugagaacaccaucuccugcuguucagacuccugcgugcauacaauccccuccccuugagcguaggcaaguccugugauuugcaucuaacuaauacaauaugguaaaugugauaggauaucacucuugugcuucuguuucacguacauguaauauucugucuugcuagcagauauacuagacagacugccucucacugacuuuaaagaagcaagcuggcauauuuuagugcauggccauguuggagaagccacauagcaacaaauggcaugugagcucuaggagccaagaguggcucccaacaagaaacugaagcccucacucuugcagaugcaaggaaacuaauucugccaacagccugagggaacuuggaaauggauccuucuccauuugagccucugauaagucugcagcccagcugacaccugaaauauagccuucccgaaacucugagcagaauaccuagcuaagcugugcccaaacuccugaucuaaagaaacugugauaauaaauguguguuuuagcaauuagcauuugaggucauucauuacacagcauagaaaauuaguauaacuauuuaaaaaucauacaaaucauuacaaaaaugauuauccacuacaaacacgggggaaagaaaugaacaagcaauuuugaaaagaaaucuaauuaucggccaggcacgguggcucaagccuguaaucccagcacuuugggaggccgagaugggcggaucacgaggucaggagaucaagaccauccuggcuaacauggugaaacccugucucuacuaaaaauacaaaaaaaaauuagccaggcgugguggugggcgccuguagucccagcuacucgggaagcuaaggcaggagaauggcgugaaccugggaggcggagcuugcagugagccgagaucgagccacugcacuccagccuggacaacagagcgagacuccgucucaaaaaaaagaaauauaauuaucaauaaauacauuagaagaugcucaggucacaauuacucaaggaagugccaauuuuaaaaguccgguauuacuaaauguuggucaggguacguagaaugagauauccugguguuacuuuagagcuuccacuucuaggaaucuaccuagaaaaaaugagcacauaagaaauagacuuuauuuaaucauuccccuacuaagagacauuuaaaguguuucgaguuccucuuccauuugaaacacuccaaacucugacuagggaacaggcaaccuaucaauagaaaacucaauaugaaguucuugcauaaaacucucugauaaagagcuauauaaaagcaguagccaaagcagucaacaauauaauaugaacaguuuauauagccagucucuaagagaauaaccuaccaaccaucuaguaagucaauaaauaaugucaucaacaguuaucaggauauguucaauaaaaaugacacaggcaugaauuucuaugaugcuauaaccagagcuaacauuuauugagaguucguuacaugcuagggacuggccuaagugcuuuacauguaucauuuuauucaguccucacaauaacccagugaaauauguagucuacuauuuucauucuauaaguaauaaaacugugguugagaaaguuaaaugauuugccaaaggucacacagcuaauaaauaguagagcugggaucugaacucagacagucugacucuagcaccuacacucuuuaccacuaagcuacugcuauuuuauacuucagguagauuuguauacaaaauuaagguuaaucaccacugcucaauuaugauagagagcaauaauaauuaacaaaaaugucuaugaaguucucugaguuuucagaaacagacgguucaauauauacuguaucauauaacaaugaaggguagagcugaccuccuccuucauaauacaaagagaaagcuauggaaaugagaccauacgaaaacgaacaccuaggccgcacaugguggcucaagccuguaaucccagcacuuugggaggucaagguggguggaucacgagguuaggaguucaaaaccagccuggccaagauggugaaacccugucucuacuaaaaacuacaaaaauuagccgggcauggugacaggcaccugcaaucccagauacuugggaggcugaggcaggagaaucgcuugaacccaggcagcagagguugcagugagcugagaucacgccacugcacuccagccugggcgacagagugagacuccaucucaaaaaaaaaaagaaaaagugaacaccuaaauacucauuccuuccacagauuuuuauugagggucuacaaugugccaugcccuauacuagaugcacgguauucaaaggugaaucaaaaggacacaugcgaaauuuccagaguugaaaacaaguccuaucauuguaggcuucucccuuugguccccuuuucagaucugcaaauucagccaucagcuacugccaaagcucucuuuuauuuuuaucuauaguuacaaucauagugaucuuuagugagagaaacaguggaugagggaacagggaagaaauguuuuuagccuaugauggugcuuccauaguuuauguacagaggacauauagacauucagaguuuuaucaucaacguucuaguucagcaucauagcccaccuaacuaaguauaugaauuaacuuucaggacuaucaaauuucaaagacaggccuacaaaaugcaaggcaauacauauguggcaccagcaugcaagagaugaggauguucaagaugaagaaaauagcguguugucccuuuaauauuuucaaacaaucuguauuaacuaugauaaacaagaaaaacaaguuaaaauuaucauaccauuguuugaccgguaaauuaaaaguuauuucuugccagugucucugagcuucauaaucaccaaacauaggcgguuuaccagcaccuaagaucaaagguaaaaagagcaaaacaacaauguacuuuagcauaucagugauuuuuauuuccuuaugaaaauugucuaaauuagagaggcaguguagguuacagaaagaacacaggaguuaccgagaaagucagagagauaaaaucugaaucuagcacugcuggcacacugcuggagugacgcugggcaaauuacuuaaucucccuaaacuugagcacauuaaaaacaggaucaauacaacuucccuacugcagacuacuggaauaaauaagauaauggauauaaaauacccagcauagugccuggcacaugguaaacauucaauaaauagacacuauuauuaacauuacaaucaucccucaguaucugugggggauucauucuaggaccccccacuaccacagaaaucaaacuucauggaugcucaucccuuauauaaaaugccauaguauuugcauauaaccucugcucauucucuuguauacuuuaaaucaucuuuagauuacuuauaauaccuaacaauguaaaaugcuacauaaauaguuguuauacuguauuguuuaggggauaaugcaagggaaaaaaaucuacauguucaguacaggcacaaucauccuuuuuuauuucccgaauauuuucaauccaugguuggcugaauccacagauauagaauccauggauacagagggcugacuguacucaauaauaauuauauccagguuuauuuuuacuucauaaggcugucaacuauacugcccaauauguaccauaaaauaguaacacgaguaucugcauuuuauaaaggacuuuuuuuugagacagagucaugcucugucacccaggcuggagugcaguggcacaaucucagcuuacugcaaccuccaccucugggguucaagcgguucucaugauucagccucccgaguagcugggauuauaggcgugugccaccauaacugccuaauuuuuguauuuuuauuagagaccgguuucaccauguuggccaggcuggucucacacuccuggcaucaagugaucugccugccucgaccucccaaagugcugggauuauaggcgucagccaccaugcccagccauuacaaaggacuuuuacaaacuauaaauaacuuaaggucaaguauagggucaaaaacagacuauauguuaaaaagacauuaauuagaucaggcuuugcugucaaauaaguuguauaaaaacuauugcuuuacgguuugauuacuuuaauuucaaaauugcaaauaagggauaauggauuuguaauaacuaacacuugauagugcuuacuauauaccaaauacaaugaaccuaugaaauagguauuaucuggccaggcgcggaggcucacaccuguaaucccagcacuuugggaggccgaggugagcagaucacgaggucaggaguucaagaccagccugaccaacauggugaaacccugucucuacuaaaaauacaaaaauuagccgggcaugguggugcgugccuguaaucccagcuacucaggaggcugaggcaggagaaucgcuugaacccaggaggcggagguugcagugagccaagaucacaccacugcccuccagccugggcgacagagugagacuccauccaaaaaaaaaaaaaagaaaagaaauagguauuaucauuauacccacuuuauagcugggaaaacaaaggcaauggccauucacguaauaagcagcaaagucuggauuugaauccaggcagacuggcuccauaauccaugcucuuagcuccuauucuguaaugccucauaaguugguuaaguagcuuuuauucuuaaaucauuuaaaaugacauaaagguggccgggcgugguggcucacgccuguaaucccagcacuuugggaggccgagguggguggaucacgaggucaagagaucgagaccaucuggccaacauggugaaaccccaucucuacuaaaaauacaaaaaauuagccagggugguggugggcaucugcagucccagcuacuugggaggcugaggcacuugaacccgagaggcagagguuacagugagcugagauugcgccacugcacuccagccugggcgacagagugagacuccgucucaaaagaaaagaaagaaagaaaaaaaaaagauguaaagcuaucuccauuuaguaaagaguaaacacccacucacuauuuaacuaacaguugacuacaaaauugugagaaggcccaaagagguacaguauaaucacagcuuuuuaaacuggcauguaagguaaaaaucacauagagucaaauauacuaauuaacccauuaggaaggugugccauauugaagaaugacauauuauugcucacugaaaucuaauccagauuuucuccaguuuuacaacauuacaugaaguguuuguauuuaauuguugaauuauaccaauauucuuuaaacgcuauaaucucuaagaagauauucccacuaugagacaaucaugggaaacccagauuaacuuuucuauagcauauauacauugagugauuugcacaagaaauuaaccauaguauacacgcaugugugugggucucugucucucuaucucucagaaagaaacuuaauaaguuuucuauucucagaauguaauagcaccuaguagauucuuaaugccacccucauagguuaucagugaauguuaauacagcaaggacguuuaaguucaaaagacuugaguuugugagucccugauuuuucacuuacugaucugcaacauuaauuugugauggcagaccaauuaauuuugccgagguugcuuuaacacagugccauauaugaguucucacccaaaaacauuuuuaaguuacuaucuggcacuuugaaauucaaaguuucuguucaugcuucuuauuccauauucuauacaucuauuucuaucaacucauauccaaccuucaagcaucaucugaaauccuaaaucuuccaugaagccuuccuucauaaauuaaaaacauauugaucacuaacuacugacuucucacaauacuuauacuuucaguucccauguuuuaucauaugacuauacuauuucuuaacugcuaaccagauaagaauuuuauaucccauaggcagagaaacugauuuuccaguguccagagaaaacauugcuaggcauauaguacauuaaaaguuugcuuaauuaaacuggagaggaagaauaaccuacaauaauaaaaauuuuuuuaagaaaagaauuccccaaagaauuaauugcauuuuugcauguguauucuuuggcuggguggcgggauugggggcagggagggauauaaguuucuauuuuaaagaauacaaccauugaauauggcuucuuuggggguggaaaggaguugacuuuccuuuuuauuuguuuuguuuuuguuuuugguccacugggauaauaaaagucagagagaaucuuaaguaauuuccuauaccugaagaaauccaacuaucuagauuuucugaaauugcucuagacuuguggucaauguggaagaauuuauuaccauucucuaacaaauagaagaauggauaaugacucucuuuaggguugggaaacaaguuccuauccagagucugaccuacuucaauaaauucagcugacacugaguaugaaauuaguacuuaaguuuuuaaaacagcuaaagugcccuuaaagcaacccagaaggacaacccaacuguaccuaugggagcuucacuugggaagggcaaaaaacgauuccuuccacagugcuuaauucuacaaauucauuuacauaagauucagaauuacauaaagaaaacacacuaauguauauuuacucagcuucaauucugucucauucucagaaaaaugggcuuaagcacuacuuaaauguucauuuuauuaauuguugaacuauucauaauuauguuugaauuuuaaaaacaaguaguuuuguuguuaacaauaccuacuaacugccuuuaaauuaaaauuuuaaacauuuuagagaagagaauuuggcuaaaauuuuccauaauaaaaucuuccuuuuggcagggugugguggcuuaugucuguaaucacagcacuuugggaggccaaggugggcagaucaccugaguucaggaguucaagaccagccugaccaacauggugaaaccccgucucuacuaaaaauacaaaaauuaauugggugugguggcacaugccuguaaucccagcuacuugggaggcugaggcagaagaaucaacugaaccugggaggcagagguugcagugagccgagaucaugccauugcacuccagccugggugacagagcaagacuugucugaagaaaaaaaaaaaaaaucauccuuuuauauuuuccauagcaauggguaaguagaaagaaacuaagcaguuaaauggaacacagucauacuuuaguaaugaugugcuacaaaaacugauucucuacaacuuucucaucaaacagccaaugcagcuuuggggaaaaaaaaaguuauuaaaauaaaauaacuuuccccagcucaaguguugccauuugccuuaaagacacugguaacacuuuggaucaaguauagaggaacugugaaucucuacaagaaacgguaaacaaucaauacuaaaaucaaaauuuuucuacuccccauggauuguuuaaaagcaacaaacaguauuuauucaauauuuuuaggucucugaaaauuaauguauauaagcaucucuaaaagcguaagggauagacauuucagaaaaaaucaaauuacaauaauauacauaagccauuuuccuaaauaauacauacauuuccaaaggaggaauaaugcauuaauacuaagcaagcuaaccugaguuuccacacuugagugugauggaguucugaacauucaacuucaaaaucuggcaccuuggcauauugaauauuuuaagcuaaaggaaucugaggaagggcaggugcaggaagaacugaccauccccugaagcagaucauaaaauccucaugugagaggugcccucccuauacccagagaaaagaagcaucuuuaucuccaaagguaaaaggauacccagaggaaccaaaaugaacagguuuugccaaguuucccguuuacuacucuugacucauacucuauuguccuaucacauuuucuacaacucuccccucuucaucaaaguuaguauaaaaacacucagguuuaacuguuucuucgggucuucauuuccuucugaagguuucaaacuuauauucaauaaaugcguuauguuuuugucuuguuaaucugucuuuuguuacacgggcacauuagagaaccuagaaggacagaaggaaaauguauuuuuccucuccuguaagugcuucuuaauuacaaucuuaaaacaagauaaaccaaaagcaaacuaaaauaagcauauuaaaaaacaaacuaugacagaggaggcagagcaggauggccaaauagaacccuccagcaacugucccccuggcaggaacaccaaauucaacagcuauccccacaagaaaguaccuucauaagaaucaaaaucaguugagcaaucacaguaccugguuuuaauaucauaucaaggaaagaggcacugaagaggguaagaaagacaguauugaauugucaacaucacuucuccauuccccagcagcagcugcauggcaugaagagagaaucuguguguuuggggagggagagugcagugacuaugggacucugcacuggaacucagucuugcuugucacagcagaaagcaacacagggcagaauucagcugguaccuauggagggagcauuuaggcuaguccuagccagaagggaaugguccaucccagcaguaggaaccugaguuccagauaggcacaccacuguaggcuaaagcacucuggggucuuaaauaaauuugaaaggcaguuuagaccacaaggacuuccuaggcaaguccuggugcuguguuggacucagacgcaguggacugggggugcacaugaccuaguaagacaccagcuaaggcagccaagggagugcuugcaucaccccucccucaaccccaggcaguauggcuuaaggaugccuucugcuuaaggaaaggagacuggagaguaaaagaggacuuugucuugcaacuuaaauaccagcucugccacagcaaaauaagguaccaggcagaguccugaggcccacauuccaggcccuagcuucaggccacaguggagcacagcaccaggcagacuccuggagucccggauuccaggccuggcuccugauuaagguuccuaacuccaggccuuggcucccagacagcauuucugacccaacauaggcuguggacuggggaagcugccacccuaaggaaagggcauaagccuggcuggauucaauaccugcugaugaagaacccuugggccuugagugaacaucggcaggaaucaggcagugacugccgcaggccuuggguaagacccagugcugugcuagcuucaggucugauguagcacagucccaaugugauggccacacggguacuuuugucaccccuccuccagcucccaucagcucaacauggagagacagacuccauuucuuugggggaaaguaagggaaaagaacaagagucuuugucugguaauccaaagaauucucucagauuuguuacccaagaccaucaaagugguaccucuaugagccugcaagagucacaguguaacugggcuuggguugcccccuaaugcaaauauggcugcagcgaccauggaugacaacacucaacucccuuugaauacuuggaaagccuucccaagaaggauggguauaaauaagcccagacugugaagacuacaauaaauaccuaacuuaucaauauccagaugaauauccacaagcauuaagaccauccagaaaaacaggaccucaccaaaggaacuuaauaaggcaccagcaaccaaucucagagugauagagguaugugaccuuucaaacagagcauucaaaauaacuguuuugaagaaacucaaaaaauucaagauauaacagagaaggaauuuagaauucuauccuuaacagagauggaaauaauuuguuaaaaucaagcagaaauucuggugcuaaaaaauucaauugacauacuguggaaugcaucagagucucucaacagcagaauugaucaagcaaaagaaagaauuaguaagcucaaaggcaggcuauuugaaaauacacagucaguggaaacuaaagaaaaauaagaaugacaaaagaagcaugccuagaagaucuauaagauagccucaaauggacaaaucuaagagcuucuggccuuaaagagguaauagagagagagagagagaucaggguagaaaguuuauucaaagggauaauaacugagaacauuccaaaccuagagaaagauaccaauauucaaguacaagaagguuauagaacaccaagcagauuuaaugcaaauaagacuaccucaagacuuuuuaacagucaaacucccaaagguuaaggauaaagaaagaauccuaaaagcagcaagaagaaagaaacagcauacaaaggaguuccaauacaucuggcagcagacuucucaguagaaagccacacaggccagaagagaauggcacaacauauuuaaaguacugaaggaaaaaaaaagcuuuuauccuagaauaguauauccagcaaaaauaccugucaaacaugaaggagauauaaagauuuucccagacaaaaacgcugagggauuucaucaacacuagaccuauccugcaagaaaugcuaaagggaguucuucaaccagaaagaaaagggcauuaauaagcaauaagaaaucaucugaagguacaaaacucacugguaauaguaaguacacaaaguauuuuaacacugucauuaagguuuguaaacuacccauaucuugaguagaaagacuaaaagaugaaccuaucaaaaauaauaaccauaacuuuucaagacacagaauaaaauauaaauagaaacaauaaaaaguuaaaaagcaggggaauaaaguguagaguuuuuguuaauuuucucuuugcuuauuuguuaguuuuuacaaucaguauuaaguaaucauuagcuuaaaauaaugaguuauaagauguuauuugccagccuggggaacauggccaaacccccaucucuacaaaaauacaaaaaauuagcugggcaugguggcaugugccuguagucucagcuacuugggaggcugaggugaaaggacaaccugagucuggaaggcggagguuccagugagccaagaucaccucacuuaggccaggcgcgguggcucaugccuguaaucccagcacuuugggaggccaaggugggcagaucacuugaggucagaaguuugagaccagcguggccaacauggugaaaacucgucucuacuaaaaauacaaaaaaaauagccgggcaugguggcgugcaccuguaaucacagcuacuccacaggcugaggcaagagaaucgcuugaacagucuguugccuacaagaaacauacuucauuuauaaagacacacauagacugaaaauaaaaggauggaaaaagauauuccaugcaaauggaaaccaaaaagagcaggaguagccauacuuacaucagacaaaacagauuucaagacaaaagcuauaaaaagagacaaagaagcugggcacgguggcucacaccucuaaucccaguacuuuggcaggcugaggcaggcggauugccugaggucaggaguucaagaccagccuggccaacacggcaaaaccucgucuuuucuaaaaauacaaaaauuagcugggcgugguggugcacaccuguagucccacuacuugggaggcugaggcaggagaaucacuugaacucuggaggcaggagguugcagugagccgagaucacaccacugcacuccagccugggcaacagagcaagacucugucucaaaaaaaaaaaaaaaaaaaaaaaaaaagagaaagacaaagaaggucauuauauaaugacaaacgggucaauucagcaagagauauaacaaugguaaauauauaugcauccagcacuggagcaccuagauauauaaaacaaauauuauuagagcuaaagagagugucuccaauaggguaauagcuagagaugucaauuucagcacuggacaaaucauccagacagaaaaucaacaaagaaacaucagacuuaaucugcaguguaaacuaaguggaccuaucagauauuuauacaacauuucauccaauggcuagagaauauacacauucuucuccuuggcacacagauagaccauacgauagaccacaaacaagucuuaaaaaauucaaaacacugauaucauaucagguauccuuucuaaccacaauggaauaaaacuagaaaucaauaacaagaggaauuuuggaaacagugcaaacacauggaaauuaaucaauaugauccugaaugcccagugugccaacgaagaaauuaagaagaaaauuuaaaaauuucuucaaacaaaugaaaauggaaacacaacauaccaaaaccuaugggauacaugaaaguaguacuaagaggaaaguuuauagcaauaagugccuaugucaaaaaaguagaaaaacuucaaauaaacaaccuaaugauacaucuuaaagaacuagaaaagcuacagcaaaauaaacagaaaauuaguagaagaaauaguaaagaucagagcagaaauaaacgaaguugaaagaucaacaaaacaaaaaguugguuuucgaaaagauaaacaaaauugagacacuuuuagccagacuaggaaaaaaagaaagaagacuuaaauaaauaaaaucagagauuaaagaggagacauuacaaccaauacugcagaaauucaaaggaucaccagagacuacuaugagcaauuauaugccaaaaaacuggacagccuagaagaaacugauaaauuccuagacacguacaaccuaccaagacugaaccaggaagaaauccaaaaccugaacagaucaauaacaagcaaugacaucaaagcaguaauuaaaagucucccagcaaagaaaagccuagaaccugauggcaucacuguugaauuucacuaaacauuuaaagaaaaauccuaauaucaguccuauucaaacuauuccaaaaaauagagagaauacuuccaaacucauucuacgagcccaguacuccuaauaacaacaccagagaaagacauauuaaaaaaagaaaaaaaaacuacaagccaauaucccugaugaacauugaugcaaaaauccacaacaaaauacuagcaaacuguaaucaacagugcauuaaaaagaucauucaccauaacccuacagauaaaucccacggaugcaagaauggcucaacauaugcaaaucaaucaaugugguacaucaaaucaacacaaugaaggacagaaaccauaugaccauuuugguugaugcugaaaaaguaucugauacaauuccacaccccuuccugacacaaacccucaaaaaauugaguuuagaaaaaacauaccucaacacaauaaaagccauacaugacagacccacagcuaguaucauacugaauggggaaaaacugaaagccuuuccucuaagauuuggaacaaaagaaugcccacuuucacaacuguuauucaacauagugcuguuagucuuagcuagcgcaaucagacaagagaaagaaauaaaggucacccaaacuggaaaggaagaagucaaauuauccuuguuugcagaugauauaauuuuauauuuggaaaaaccuuaaaacaccauaaaaaaacuauuagaacuguaaaacaaacucaguaaagucacagcauaaaaaaucaacauacaaaaaucacuaguacuucuguaugccaauggugaacaauuugaaaaagaaauuugaaaaaucucauuuacaauagccacaaauaaaauuaaauaccuaggaauuaacuaaagaauaaaagaucaggccaagcacaguggcucaaggccgggcgugguggcucacgccuguaaugccagcacuuugggaggcugagaugggcagaucacaaggucaggaguucaagaccagccuggccaacauggugaaaccccguuucuacuaaaaaaaaauaaaaauaauacaaaaauuugucgggcaugguggcaugcgccuauaaucccagcuacucaggagacugaggcaggagaauugcuuuaaccugggagguagagguugccgugagccaagaucaugccauugcacuccagccugggugacagagcgagacucugucucaaaaaaaaaaaaaaaaaaaaaaaaaaaaaaaaagaagaaguaaaagaucuuaauaaaaaacuauagaacacugaugaaagaaauucaaaaaaaugggaaaauauuccauguucauggauuggaagaaucaauaucauuaaauguccauucuacccaaagcaaucuacagauucaaugcaaucuccaucaaacuaccaaugauauuccucacagaaauagaaaaaauaauccuaaaauuuauauggaaccacaaaagaccccaaauagucaaaacuauccuaagcaaaaagaacaaaacuggaggaauuacauuacacugacuucaauuuuacuacagagcuacaguaaccaaaacagcaugguacuggcauaaaaacagauaccuagaccauggaacagaauagagaacccagaaacaaauacacacaucuacagugaacucauuuuugacaaaggugccaagaacauacacuggggaaaagagagucucuuugggggaaaauuggauaucuauaugcagaaaaugaaacuaaaccccuaucucucaucagauacaaaaaucaaaucaaaauggauuaaagacuuaaauauacgaccucacacuaugaaacugcuccaagaaaacacuggggaaacucucuaggacauuggucugggcaaaaauuucuugaguaauacucuacaagcacaagcaaccaaagcaaaaacgggcaaaugggauccaugaaguuuaaaagcuucugcacagcaaaggaagcaaucaacaaagacagaacccacagaaugggagaaaauaugcgcaaacuacccaucugacaagggauuaacaaccagaauauauaaggaauucaagcaacucaauaggaaaaaaaauuaaauaacccaauuaaaaaaugggcaaaagaucugaauacacauuuuucaaaagaagacauacaaauggcaaacaggaauaugaaaaagugcucaacaucacugaugaucagagaaaugcaaaucaaaacuacaaugagacaucaucucacccagguaaaauggcuuuuauccaaacgacaggcaauaaaggaaauccauauauugaaaagauagcuccacucuuauguuuauugcagcaccguucacaauagccaagauucgcaagcaaccuaaguguccaucagcagacgaaugaauaaauaaaauguauaugcaauggauucagccauaaaaaagaaugagauccugucacuugcaacaacauagcuggaacuggaggucaugauguuaagugaaacaagccaggcacagaaagacaaacuuucaauauucucacucauuagugggagcuaaaaauugaaacaauugaacucuuggagaugaagaacagaauuaugguuaccagaggcugagaagagugggugggguagggaagauuaauggauucaaaaauauaauuacacggaaugaauaagaucuaguauuugauagcucaacagggugacugcagucaacaauaauuuauuuuaccauuuuuaaauaacugaaaguauaaauggaauguuuauaauacaaagaauaaaugcuugagguaaugaauaccucauuuacccuaaugugauuauuacacauuguaugcuuguaucaaaacauuucauguuagccaggugcagugguaugugccuauaguccuggcuaccuguaaggcugagguaggaggaucacuugagcccaggggaucaaggcugcagugaaccaugauggcaccacuguacuccagccugggugacauagugagauacuguaucuaaaaaauaaaauaauggccaggcacgguaccucaugccuguaauccuagcacuuugggaggccaaggugggcagaucgccaggaguucaagaccagccuggacaacaugaugaaaccccaucucuacuaaaaauacaaaaaaaauuagcuaggcaugguggugagcaccuguaaucccagcuacuugggaggcugaggcaggagaaucacuugaacccagagacagaggcuacagugagcuaagauuucacaacugcacuccagccugugcuggagcacagggcaauggagcgagacucuaucucaaaaaaauaaaaauaggcugggcaugguggcucacgccuguaaucccugcacuuugggaggccaaggcagguggaucuccugaggucaggaguuugagaccagccuggccaacaugguaaaaccccgacucugcuaaaaauacaaaaacuuaggccaggugcgguggcucacgccuguaaucccagcacuuugggaggccgagacgggcggaucaugaggucaggagcucgagaccauccuggcuaacauggugaaacccugucucuaauaaaaauacaaaaaaaugagcugggugugguggcaggcaccuguagucccagcuacucgggaggcugaggcaggagaauggcaugaacccgggaggcagagcuugcagugagccgagaucgcgcuacugcacuccagccugggcgacagagccagacuccgucucaaaaaaaaaaaaaacaaaaaaaaaaaaacaaaaaaaaacaaacaaaaaaaaacuuagccaggcaugguggcacgugccuauaauccuagcuacucaggaggcugaggcaggagaacugcuugaacucgggaggcagaguugcaaugagccaaggccguaccacugcacuccagccugggugacagagcgaggcucuugucucaaaaaaauaauaaauaauaaauaaucagcugggcgcugaggcgggcagaucacuugaagucaggaguucgagaccagucuggucaacaugguaaaaccccaucuauacuaaaaauacaaaaaauuagcugggcgugguggcucaugcuuguagucccagcuaccugggaggcugagacagaagaauugcuugaaccggggaggcagagguugcaguaagucgagauggcaccacugcacuccacucugggcgacacagcaagacuccauuucaaaaaauaauaauaaaauaaaaauuuaaaauaauaaaaauauaaauaaaauuuuuaaaaaaaaaaucucaugugacccaugaauauguacaucuacuauguacccauacaaauuaaaagcaaaaaaacuuuuaaaaaacaacaaaaaaagaaauuaugagcugggagcagugguacaagcugagauauuuuacaauacauaaaaaugaugcauuucuauugggaggcuaggugggaggaccacuugaggccaggagcccaagguuacagugccugaugaucacauccuguaaauagucacucuacugcagcuugggcaacauagugaaaacucacuucuuaaaaacaaaacaauacaaauuaggauaccaaaaauaguauuuuaaucaacagaaggaacaauaucucagcagaaucacagauguuauucauuaauucucccaaccuccaaugacacauuaagucccucacacgugaaugcuaaaaauguuauauucuuuaugauggaguugaguucuauaauggaauccucuccccuccccuccccuccccucccuuccuucuuuucuuuucuuuuaaacagggucuuguucugucacccaggcuggaguccaguggugugaucacggcucacugcggccuugaccuucugggcucaagggauccccccucagcccccacuaucaguagcugggacuacaggcaugcgccaccaugcccaccuaauuuugggguuuuguuuuuguuuuuguauuuguuuuugucuuuugagacggucucgcucugucgcccaggcuggagugcaguggugagaucucagcucacugcaagcuccgccuccuggguucaugccauucuccugccucagccucccuaguagcugggacuacaggcgcccgccaccacgcacagcuaauuuuuuguauuuuuaguagagacgggguuucaccguguuagccaggauggucuugaucuccugaccucaugauccgccugccucggccucccaaagugcugggauuacaggcgugagccaccgcgccuggccaauuuuuguauuuuuuauaaagacaagguuuccccguauugcccaggcuggacucaaacuuuugggcucaagcaauccaccugccucggccucucaaagugcugggauuacaggugugagccacugggcccagccaccauuuuucuuaauguuuagcauauuuacuuuccuuaucugaaaaaugacaaaaauauaucauagccaucuacaagaugccuucaaauaaucuacuaaugugcaauaacaauauuuuucuuauauaguaacccaaaaggaaucugauucuguugauuuuccuagggacaauuuaagagcaggguuuaaaauaaguagcuggaguccuguuuucuuuuccagaugagaaaaguaauugaguaaauucaguucaugaaagaaaugucagguuaaguaauauauguaagucacaggaauagagaaguauuggaugaauuguccccuccugaauucccauuaagcauuugauuauauauaccagcaauacugaaauaguaucauuuaaaaauuuguaguauuuuauccuauacucugauuuuaguucuuuucaacuucaccuuaaaauaaacgagaaaauaauauaugugucacaauuaggagacaaaaggaaaacuggaaaaaagauugcaaacuaaauaaucaccaugaauuaguaccaaauucagaaaaggggaugacuuuccaauggaccaauuauggacuaaaaguaauauuauaaguuacauauuuuauguaacaacuucuaauuggaccuuuccucagcccuucuucccccacuucagccaccaaacuacuuccuuucuuccguucacgaacaaacguccugaaaguugcuauguccauuugauaacuaccauucaguccucaguucauuacagucuggcaaccaggagguucacauggucuccuauagaucccuugucuauuuuaaauuuucauccuuuuugacaugucuauagcuugacacuguuggccgguccucauuuuguaaaguugucugguuucuuggcuucuagaaaaacaaacucuccagaugcuaagccuacuacacaguuucuucucagucuccuuuaaucauucucccuucucucuggagaugauuagugguuaaaucuguuuucuucuugcacaaaaguugcuuuuguugaggggcaaaagcaacucuuaaaccuguugcuuuugccccucaaccccuggcuucaaccaucaugucuauuaacccucuguaaacacuagaauaacuuauggagcuuuuaaaaauauagauggcacuucgguuuccagcaauaugccagacaaaggguccaaaaacaucuccaguaaaaauccuaguuaacauugaauaaauaauguauauaauauaauguuuuauauauguuuuauauauaauguaugauuuauauuuguuuuuauauaauuaauaauauaguauuacguauccuacuuuuauaaauauauaauuuuaauauauggcugaacuagcaguaacaugaaagaauuccuuagaggccccagaaacaacagcaaaguguagauucagagaaguaagcauuugccuugaggguauccaaugaucucugguggucaauagccuggcuaccaggagcccugugcagucaguaaggaggcaaagccugggaccugaacagguaggaauucaaggucagagaacccucuacuacaauuuaaaauacaaugccuuuagggagauagugaagauaguacucaucucggccuuggcuccugguaguacaggaaaaacgaaaaagaguccuaugaaaacuccuaaccauaugccugcauuugcccagguuggggccugaauucacaccaaguacaugacccaaagaaacuuuaaguugcuaauuuaguuugauuuuuguuaauagugccccaggugccuaccaggaagcaacauaaacccuauguggaaaaaugcacaggaaacucaagccucaaagaauucccacagauaaaaguuccaaauuacauaaacucacuauuuuauuaaaaaucacuaagcucaugaagaaacaaaauaccaugagcaagggucaggagaaacaaaaaacuaugaaaucagaaugcagauacgagaauuuuuagauaagaaacauaaaauaagcaugguucaacugcuuaacaauacaaaagaagaccuugaaaguaugcugaaggaacaagagacuaucagaaaugaucaagaucuaaaaaggaaccaaagagaacuucuggaaauaaaaaauauaauaacugaaaccuuaacauucaauggggaguuaaaaaaaaaaaacaaacaaauuaagcacagcuaaaaacuaaugaacaggaaaccaaauuugaugauuauaaaggaagcacugugaagaaaccccgagauggaaaauacaagagauuaugaaacacagaagacagaaugaaaagacccaacauacaucuaacaagaguuguacaagaauaaaaaugaggaagauacaauauuugaagagauaacugagaacuauaaagucaaugaggggaagagauuauugucuauuuuauucucugcagcaucaccagcccuuggcacauagugaauggccuauacuaucuguggaauuccuaaccaaagauccaacauauaucuaaucagaguucuaaaaggaagaaaaauaagaagacacaguagcugaaaaguuucuagaacagacagaaaauaccauuccuuagagacagaaaucacagaaaauccuaggaugacaaauguuuuaauauucacuaagauauaucauagugaaacugcagcaagaaaggaaaggcaaauuaccuacaaaagaauaacaguuaaaaugacagcugauguccaaacaucaacacaaauuaaaagacaaugguauuuucaaaauacuaagagaaaacaaccaucaaaacaauuccauacccagcaaaacuuuaagacugaaagccaaauaaaggcauuuucagacaaaaacuggguuugccaccaacagacucucaccaaaaaaaacucccaaagguguacuucaggaagaaaaaaaugaucucaaagaaagauacaauauguaagaagggugaacagaaaaugcuaaacacaaggguaaaacuaaauaaauaugcagggcacaguggcucacaaccugucaucccagcacuucgggaggccaaggugggaggaucccccuugagcccaggaguuugagcccagcuugggcaacacagcaggaccuuaugucuacuaaaaauaaaaaaacauauauuuagcugggugugguggcaagcaccuguaguuccagcuacuggggaggcuggagcaggaggauccucugagcccaggaagucaaggcugcaaugaacuauggucaugccacuguacuugagcuugggcaauagagugagaucccaucucuaaaaauaaauaaauaauaaauaauaaaccaauauuaacuguacaaaacaagucauuaaugccuaauuuauaggauuaaaaaucauggaagaaacaaaauccuagacaguaacauuuuaacuugggaagugaggaucuguaaccagaauuaaaacauucuaaagucuuugcauuguucaagaggauauaaauauuaacuuuaggcuuuguuaaguuaaauaugcaacugaaaauuuccagauaaguccugaaagaagaaaauaaaaauauagcuuucaaaccaauagagaagggaaacagcaauugcggaaggaaauugcuuagacauaucuaaacauacaguaaagaauaaaaggacagaaaaagauauaacaagcaaaaaucaaacuaaagaaaacuauuauggcuauauuaauuuuagaggaaacaaacuuuaacaaaaaagcauuacuguaaacaaacagggaagcaacagugauaugaaauucaggucacacacaaaaaaauucuaccuguuaauaccaccacuuugggaggccgaggugguggaucaccugagaucaggaguucaagaccagccuggccaacauggugaaaccccgucucuacuaaaaaugcaaaaauuagcuggguguggcagcgcacgccuguaaucccagccacuagggaggcugaggcaggagaaucccuugaacccgggaggcagagguugcaguaagcugagauugugccguccagccugggcaacagagugagauuccaucucaaaaaaaaaagaaaaacaauucuaaaucaccuaguaauauagauacaaaauauauacauacaaguugacaaaacuacaaagagaaacuacagcucucuuaauaacugguagaucaauugguaaaauaucaguaagaauauaaaaaacgauuguaucaaaacaauaauauuggguuauugaauauaugcagaauauuaaacuagagauuacacauucuuuucaagcacacacagaacauuuacaaaagcugauuacauacuaggucaaguuucaaugcuuuucaaagaauuaguaguacacagaaagauucucuuucuaccaucuacuuaaauuuaaaauaucaaaaagguaauuuuuaaagccuaaauauuuaaaaaauuuuaaacauaauucuaaauaacucaugggucaaaguagaugucacauuagaaauuagaaaauauuacuugugggaugguacucuaaagaaaauguauagcuuaaaugauaguguuacagagacugaaacuuaagagcuaaagcauccaauuuaguaaauuuaaaaaagaacaaccccaaggauaucacugagagaaugggcaaagcucagauuaguuauuugaaaaauacggcuauguaccacaauaaugacaucucagucaacaacgaacuguauaaacaaugauggucccauaagauaaucauacuguauuuuaacugcaccuuaucuauguuuagauauguuuaaauacacaaauacuuaccaugugcuacaacugccuacaguauucaguacaguaacauguuguauagguuuguagccuaggagcaauaggcuauaauguacagccuagguguaguaggcuguacaaucugaguugguguaagucacucuacaaugguugaacaaugacuaaacugccaauugacgcauuucucagaaugaauccccaucauuaaacaaugcaugacuguacuaauaaaauuaauaaaccccuaauaagacugauuguuuuaaaaaaugaaacaccacuaacuauauaagaaauaaaaaaggaacuauaaucauugauacagcagaaaauguaaaagguaagaaaacauuaugaauaauuuuaugucaauacauuuuaaaacuuaggugaaauggaaacauuucuagaaaaauauaaauuacaaaaauaauucgagaaaaaagagagagccuaaaugguccuauaaccaauaaacaaauuaaaucacuaaacauuuuccuuacaaagaaaauuccaggcccaaauaccuuuacuaucaaguucuaccaaguaucuaaggaacaaacaauuccaagcuuacauacuauuccagauuuuacaaaaagagagaauacucccuaauucauuuuaugaggcuagcuuaaccuugauaucaaaccugacaaaggcauuuuaaggaaguaaaagaaaugggccaggcgugguggcucacgccuguaaucccagcacuuugggaggccaaggagggcggaucaccuaaggucaggaguuugagaccaggcuggcaaacauggggaaauccugucucuacuggaaaaaaaaaaaaaaaaaaaaaaaaaaaugccgggggugguggcacaugccuguaaaucccagcuacucgggaagcugaggcaggagaauugcuugaacccaggaaacggauauuguagugagccgagauugcaccauugcccuccagccugggcaacagagcaagacucagucuagggagaaaaaagaaaaagaaaagaaacaaaguauuugccuauaucacacuacauuuuuuuuuuaauggagucucccucugucacccaggcugaagugcaguggcaccaucucuggcucacugcaaccuccgccucccggguucaagcaauccacccaccucagaggcccgaguagcuaggacuacaggcaugugccaucaugccuaauuuuucuuuuuguaaaggggguuucaccauguuggcuaggcuggucuggaacuccugaccucaagugaucccccugccucagccucccaaagcgcuagaauuacaagcaugagccacugugcucagccuacauuuuuauguaguauguauuuacauguccaccuuauccacuagacuguaaacuucucuaaggaagauaccauuuauuauucuuggucacccuaaagaccaggccuaaagacuuaaucaccagcaagaccuauuuuuccugcauagcagacauuuuagggcuaaaugaucugaugugaggaucaaaugagaugaguuaugaacuauaaaugugcuaguuauagcccugcacuauuaaaaaagaaaacauaauuuauacauauuaucucaauccucacaagaauccuuuuuuuuuuuuggagacagagucuugcucugucacccaggguggggugcaguggcgugaucucggcucacugcaaccucugccuuccagguucaagcaauucucgugccucauccuccggaauagcugggacuacaggcacccgccaccacacccggcuaauuuuuguauuuuuaguagagacgggguuucacuguguuggccacgcuggucucgaacuccugaccucaugugaucggcccacuucggccucccaaagugcugggauuacaggcgugagccacggcccggccaagaacccucuuaaaguauguauuaauaccccacuugauagaagaggcucaaggagauuaaauaaauuccccaagaucaggcaacuaacaggugaaagagcuaagauuugagcccaagucaacugcuacauuuaagugauuuuacuuccuccauauuccucgaacucauucagaagccacagagcacagucauaagagcacugauuguggaauuaaauacaacuauauuugaaucccaguugucauuuauugguugucucauuuuccauuuguaaaucgaagauauuaccugucuucagugguugugguaaauacuaaagaaaauacucauacucaaaauauaguaguucuuacaaguucuuucuauaaauccuuuaaauucaugcugaauaaagagaaacuauauuaagccagaguauuugaaaaaauugggcgcaguggcucacaccuauaaucccaguacuuugggaggcugaggcaggaguauugcucgagcccaggaguucaagaccagccuaggcaacacagugagaccucaucuuuacuaaaaaucaaaacaauuagccagacaauuagccacaugccuguggucccaagaggucaaggcugcagugagccaagaucaugccacugcacuccagccugggcaacagggggagacccugucucaaaaaaaaaaaaaaaaaaaauguaaauuaaauuaaauugaaaaauaaaaauagcccaaaaaaguguguuguuuuguuuuuuuuugaggcagagucuugcucugucgcccaggcuaaaguguaaugggaugaucuuggcucacugcaaccuccaucuccugggcuuaagcaauucucgugccucagccuccccagcagcugggauuacaggugugcgcccggcuaauuuuuguauuuuuaauagagacgggguuuugccauguugcucaggcuggucuugaacuccugagcucaggcaauccacccaccuuagccuccccccaaaaaaaaauguuuuaagagaaaagagaaacuauagucugguuaaaauauugacuggacauaguggcucacaccuguaaucccagcacuuugggaggcuggggcaggcagaucacuugagcucaggaguucaagaccagccugggcaacauggugagacccugugucuacaaaaaauacaaaaauuagccaggcgucguggugcacgccuguauuuccagcuacuugguaggcugaggcagcagaaucacugcaccaaggaggcggaggcugccaugagccaacauugugccacugcacuuuagccuggacgaugaaagugaaacccugucuccaaaaaaaaaagucuuacaaaacauauauguauguguguguguauacaucuauauguaagagcuacaggccaggcacgguggcucaugccuguaaucccagcacuucaggaggccgaggcaggcagaucacgaggucaggaguucaagaccagccugaccaacauggugaaaccucgucucuacuaaaaauacaaaaauuagcugggcaugauggcaugcaccuguaaucccagcuacuuaggaggcugaggcaggagaauagcuugaaacugggaggcggagauuacagugagccaagauugcgccacugcacuccagccugggugacagagcuuuuuuuucucaaaaaaaagcuacgauauacacagacacauacacauuuauucucuacauacacauuugcuauauacacacauauauacagauauuuauauauaugugugucuguguauauccauauauaugucuguguauauauacauuuacuauauacagacacacacauauauagguaugcauaaaauaccuauauaugugugugucuguguauauacacauuuacuauauagacacacauauauauaaauuuccauauauguaucuucguauauaguaaauguguaaguagagaguaaaugugugucuguguauauauaugugucuguguauauaucauagcucuuacaacuauuaauauuauugucucauuuuucucuuuaccuaucucuuuuuccuaugacccuuuuucacuaacauaaguuauuuuucuacaacgaaauaauuugcccagcuaauuguauaaccuauucucuggucacucucuccucauccuuuuuguuccuauguuucaugcaacucaaauacaauacuuauaauaaccaugcucugugacaccaugucuguugcacaaguuccugcacucuauaauaccuucuccacuucauuugccuagaaaauucugacucauccuucaaaucuugaaugcaaacaucuuuccugaaguuuucucuaaugcaucuugaucauuuaccucucuauuaacucuguaccucacacauacuccuacauuauaauuaucacccucuguugugaccauuuaacuauuaaaaugugggcccucuagcugggugcgguggcucacgccuguaaucccagcacuuugggaggccgaggcaaguggaucacgaggucaggaguucgacaccagccuggccagcauggugaaaccccgucucuacuaaaaaugcaaaaauuagcugggcauggucgcgugcaucuguaaucccagcuacucggaagguugagguagaagaauugcuugaacccgggaggcagaggucacagugagccaagauugcgccacugaacuccagccugggcgacacagcgaggcuccguaucaaaaaaauaaaauaaaauaaaauaaaauaaaaugugggcccucugaguauuggcuauucaucuuguauuuuuagaagcuagcacagugccgggaacaugagacgugcuaaauagguaccugcagaguuacauuuaagccaauccaacacaccaggaccacacuccaucaauucccccucucucauucccaauuuuauucuuguucacugaucgcuucccuuuaauccaguaauaugcuucucuacccuaaacagacuccaccccucccuugaagugcuagcucauuuuccucuucaauguuuaauacagaaucauuucucaauuugucaucuuaccuguuagaacacauuuuugcuuucucacaucacaaagcgcaugcuucuauuuagcuguuauccauauucuuucuauuagaacuggacauuuaaauguauuuucucaaccauaucaaaaaggccugaaauucuucucuguacuggucagaaaaugguaaacuuuuccccaaacaaacaccuauucaaaggaaaauuucguuuuuuuuuuaaccaguaaaaauguauuaccugaauaagaauuaagagacacuguccaucguacuguuaguccuauuaaaaccacuacugucaucaaguaccauuucuccauaguucuucaaauuuagggaggggaagaaaacacagcaccagugccagaguacuuuuaaaacguggucaaucacuucuuuucuuguucagagaaauguuaucacuucuugaaauguuaucgauucuucgcaauuaggaguuugagagaauuuuaaugaugcuugguuuccaaauagucaaaacuugauuaugucuauguagaaguauccuaaggggaaaaaaaaagauaucaagauucagcugaguacaguaccuacaacaaugaacccaguaaaccaaguagaaggauagagaauucgaggggagggguagugggaaggaaugugaaggaaacgugguauuuuaaguuccuuauucccuaguccuuuaguugggaauauacaucaaaagguggaucucccuauuaaaugggacucaauacaucuaaagauauaguaaagauuuacucucacaagggaauauuucugagaaaagaaaaacaacacauauguagauaaugacacagucaauucuauuuagaacacauucaccuacagguaaauauaaaaccacaaccguagacaaaggcaugauuuaucuuugguacagcgagaaagaggaaucuugucuuuguauuuaguuugggaaagucuuccaauaaacaauuuaucuaguuugguuuuuacuuuucuuccaaaauauacuugcauuaaccacaccaacuuuccaucuuagagaaaugagccuuuuuaagaaucauuaagaauaaucccaaaucgugagaaaaaaauacaaaagcaguaaaacucaauuaaccacuuacuuuuuuuuuuuuuuuacaguuuuccuuagguugggguuuuaaaguaagaagcaaauugaugccgguugcgguggcucacgccuguaaucccagcacuuugggaagccgaggugggcagaucaccugaggucaggaguucaagaccagccugaccaacauggugaaaccccaucucuacuaaaaauacaaaauuagccagguaugguggcgcucgccugugaucccagcuauuuggaaggcugaggcaggagaaucgcuucaacccaggaggugaagguugcagugagccgagaucgcaccauugcacuccagccugggcaacaagagcgaaacuccaucucaaacaaaaaaaaauaaaaagcaaaucgacaaaauugacauuuuccucuucucuuugaaaaauguuggaccauuuuaaccacaggauacacuuuaaauauauucagaaaauauaauaaaucaacuaaaaaauuuagggcaaaauugguacauuccaccuaaugaucuaaaauuauuuuauuuuauuuguuuuuuuuucuuuuuuuuugagauggagcuuugcucuuguugcccaggcuggaguacaauggcacaauaucggcucaccgcaaccucugccuccuggguucaagcgauugucuucccucagccucccagguaguugggauuacaggcacccaccaccacgccuggcuaauuuuuguauuguuaguagagacgggguuucaccagauuggccaggcugaucuugaacuccugaccucaggugauccacccuccuuggucucccaaagugcugggauuacaggcgugagccacugcacccggcccuaauuauuuucuuauuuaaaauaaaaacaucacgggauaacuccagaacugauuggaauggcuaaucuuuugucauugaugccaaaucucaaaucauccccucagaaagaucaucccugacuauccuacuaaagcuuccuccccuuacuguuuguaucauuaccuucaauuugcuuccuaauucuuuucacuaacaggauuuguauuuucacaugacauggugcaaucucacacacauaauuuucaguauaaaugcuggacaccaaagaauacauaucauaugguuccaugaaagguucauaaauaggcaaaacuaaucuaugguguuaaaaaucaggaaagagguuaccuuuggggaggaaagaagggauggugguugggaggggugcccagagagguguucugaaaugcugugaaucuuccuucuugauuugaguagugguuaggaaauguguugacuuuaggauaaauuaacaaguuacaacuuauaauuugcguacaguauuuuucuauaugguauauuccaauuuaaaaagcauaaaaggggcugggcgcagugguucaccccuguaaucccagcacuuugggaggccgaggcagguggaucaccugaggucaggaguucgagaccagccuggucaacauggugaaaccccaucucuacuaaaaauacaaaaauuagcugggcgugguggugcguuccuguaaucccagcuacucgugaggcugaggcaggaaaaucgcucgaacccgggaggcagagguugcagugagccaagaucgugccacugcacuccagccugggcgacagagcaagacucugucucaauuaaaaaaaaaaaaaguguaaaaggaaauuacuuggauguguugacuaaaggcucccugugagcagggauccuccugucuuagucguugcucucuguuccccacuuguagaacaguguuagcagaaggcagguacccaagaaguauuugcugaauggagcugugugcgucuguguguacgaagcggggagguacccuaauuuuacugagcccugugugguuaaagauauuaugcgaggcuuuuaacgacucucuucugcuuaaaccagaaaaaggguuauuugcgacuuuuuccaccuguaaaucagaaaacaguaauuuucuaacccauccacuggccacgaaguugcuaggcaggcaguagaugcgcuuuucguccuccuuugcccugacggugcaucucgacaaaugccaagcccgccguccccaucccagaaccgacuuugcuccuuuuagucugaaagguccuuccaccgcaguggacacaacaccggggagugcagcuaucccgggcguguauauggggcgaaagggaucccuucucgcguuucuccgccccuccucuugagggccaggcccucagaaccgcaaggacaagggugccaggaccgccccagccugcaagugccaccacuaucaccgcguccccucacccgacccacaagcgacccugcaggaagggcuggggaggccucgcgucgcgucccugggaguggagcggagcugggagacgggucgccagcucugcgccggcucguggcgcguccgagcccccggcaccuccccacacuggccugggguccggaaccuccgggaucccaugcucuuaccccgccgcccgccggccgcugggauucgcgccugccgugggucccaggaaggcgcaugcgcgcucgcccccgcggcggacugccccuccggccuuccg

SEQ ID NO: 191387 - RNA, 84316 nt, Homo sapiens
agccgccggggaggggacgagacgcagaccacacguugcccacgugcgaggaccgggcaggggcucagccccuaggccgcccggugcguggggcggcgggggcuggcuuugagucacccccgcuugugccagcuuccccggcucggcggagacuggcuuggggaugccuggccgcccggcccccuucucggacgcggcguggggagcgagcuggaguuaaggaugaaggugggacuggccgggccgaccucugaccccuggaggccgagucggcagggcggggcacggcgcgcuucagcagcuuugcgugggggcgaggagguggaggagggcgaggagguggagaagggcggggagguguagcguggcgcucaguccgccugcuacucggucccggcgcugggcugaggggagggguugucuuaaaagucucuccuucccccuguaggggcggccggcgagucccagugagagcggagggugccagagguagggggccgagaaacaaaguucccggggcuuccuccggggccgcggucggggcugcgcguuugaccgccccccuccucgcgaaggcaauggcuuccaaacuccugcgcgcggucauccucgggccgcccggcucgggcaagggcaccgugugccagaggaucgcccagaacuuuggucuccagcaucucuccagcggccacuucuugcgggagaacaucaaggccagcaccggugaggggcugcggggacgagggccgggggcgagccgcguugggcuggggugaggcccuggagggacuggggcucccggaucacggcgcccuucccccgcccgcguguggucgugcaggcucguacgugccggggcgcaugcagcuggcggccgcgcggcuuaaccgcgccuggggaggaggccgaggcuccaggggcggccggugggaggugcccacggcuccucuccaccgcuccuccugucgcgaggaauagcccgagccacccggccgagggaacgagaacuaggcagggaaaacccggagcuuccgucucacgcugcccuccuuaaggcagagccguccccguaccccuuagcccuggcccccucccccgagucccuagagagccgcgcgcccccucccgcgggagcccagaggcggagcgccgcccaccuguggcagucgggcggggccgcgcgccggggaaccuguggcgccggggggcucgcagccucgcgccucuccagccccuccacgcagccucgggccucggggcagagcccuggguggcuuugaaaggccugucuguucguugucgccuucuaagguaaacucuccccagcaacuccccccccucccgaagccgccgggccuggccgucaggagacucggaggagacucguucugauaaauuacauuuuguaaugcagcuuuccuggaaauggcuucuugagcugccucccuuggcaugagaugccuccuuuggcuggcguggugaacuuggggauauauagaucgccugauuucuuagucugacgggguugagugcgucccuuucccccucuccucccacuccacguucacaccaguuccgaaagaauuggcguuaaaaggcgagagguagcgguugugcugcugcgaggcucuuaacccuucugggauggagaugcugguaauuagcaacuccuuuaugaaaaguuguucuucccagcagggguccuuuacugucgauguacuucucaaggauguccgggcugguuauugcccaucauggacuaauuauccggagaucugcauuucagaagcacagacuggcuugaaaaggaagguggaggacaguaccagaaaacaaaaggaaagcuuaaaagcaaggaauuaagaaguaucuccagaauuguauuccuuaucucuuaagcagauugaaaaagcggacuuuuacaggaaacucuucccccacccccaugucucaaaaggaagaauuauguguaccagauugcacuugaguuuucuguuguggguauuguuaccucaagugcgccuauuuugauuuuaauacauucacaugcauuuuauucuugaaaugcugcgguuugaggggagagcggccugagggggaaggcuggcucucauccuaaugguuuuguguuuagguugggcuucuucaugguaggggcauggagucagugaaggaagacagugagaagagaugagcccauuccauaauucucuguaccugacuaggagacuuguuuccuucuaugagcccauuccauaauucucuguaccuuacuuggugacuuguuuccuucuggaaugaagggcuucacacuguccauccugggacuggacucauagcccuuuccauguuuaaagagagugugaugggaaguagcuuauuucugcacuuucuuaggggcuuugaaaauuuuccauuugcucuuuucccuuguucucucuuucucucucucucucuuuuuuuuuuuuaacuuuccuguguucuaaauuuuaguuuucauucucuuucaaaugccuucauuuccuccccagugauccucccuggagugagaaaugacuaugaaauguuuagauuuucuuuuuucuguugggaaucaagcagcuuuuugcaugagccaauuaaaaaaaaaacuuuaucaaagaaagaagaaaaauaaaggacagcaauuuguuuugaaaguggcuuguuucuagugaacuuucggguuaucggauuauuuuucccucucagaaggucugagaaucuuauaggcuuacugccugguaaauaaaacauuccuuuccacgguauuuauuuuucugucuguuaccugcuguuugcuuuuagcugauuuccuggugggaaacacaaccacccuucuguauguacccuuuauaauggaagguuugaaggagacgaugaagcacaacaaaaacccaggaaauagaaccguguaggaauuugaauuggaaaguagcuccggccaucugcuccagccuggauuugggcacacucuugucuacauggcuuuccuccuccugcagccuggugaaaagcugcucuuucaggaaagggccauucugaugucauugcuucuuggaagucuucccucaccugcucuggcagaauucaucucuuuccucugcacauaacuuuuuuuuuuugagacgagucucguucugucacccacaccggaguucaguggcgcuaucucggcucgcugcaaccucugccucccggguucaagcgauucucuugcuucagccucccaaguagcugggauuacaggcgucugccaccacgcccggcuaauuuuuguauuuuucguagagauaggguuucaccaucucuacgaagguucgaggucaggcuggucgcgaacucgggaccuuagaugauccacccgucuuggccucccaaagugcugggauuacaaaugugagccaccgcaccugaccuccucuccucugcacaugucuuauugauucuaauguugcagucauauaucaugcaguguaaaaaugccugucucacacccaguaagauaucugcugaguggcugcugugcgucaauguucuaggugcugggggcaauagcauuaagauaaucuugugccucuuuuauuauuauuuauagauagggguuuugcuuuagugcccaggcuggucucaaacucuuggcucagucucccaaaauguugggauuacaggugugagccacugcaccuggcccauucuugggccuuuuguucuuucugccuauaccauuguacaauuuccacucugaaacuuggaggacagggaucaggcaaaguaccuaauguauaaaaggagcuuaccgagucuguauuaaaggccugggucacaaauucuagacaguacaucuuaguccagaagucaagcaaccuauagcauagagaccauuuuguuuaauuagcucugauuuaugguaaaaguuugugcuuaauauggaucugagauuagcuucaugguagcugucacccauuggcccuuccuacacugccuagagugguacaggcugaggcuuaucagauaccucauuugaagagucacacccauaucuuuggcucagauuuucuuuagcacacugcaagaguaaauagaagggagaguucucuuagauugccaggaguugggucuuacccucuguuguaagaaauauuagcuuuucucuguguauguauggguaugcacauguauguaugaguauacacacacacacagggacuggcacucuauugagugaguccuacuacaaacucugaacaaauucugauauuuaaugauagauucuuuuauugggucauaucuaaaggauaugcaaauccuguuuuaaagguuggagaaauagugguauuuuuuaaaaccacauuauacuggaucuacuaucucaagugcaggaaaacuggcacaucuccauuuggaagcaucuuggaguuaauugagauaaaagauguuaaggaacaaaccuguuucugcacuugcuaucucucucucucucucucucucucucucucucucucucucucucuauauauauauauauauauauauauuuuuuuuuuuuuuuuuuuuuuuuuuuuuuuuuuuugagccggagucucacucugucacccaggccggagugcaguggcacagucucggcucacugcagccuccgccucccagguucaagcgauucuucugccucagccucccgaguagcugggacuacaggcacacaccaccacguguggcuauuuuuguauuuuugguggagaugggguuucaccauuuggccaggcuggucuugaacuccugaccucaugaucugccugccucggccucccaaagugcugggauuacaggcgugagccaccgcaccuggccucugcuucucaauauuaacugcagcucuugcuggaguuuugcugaugggacuagcauuucaaguuagucuaugggcccagccucuuuuugaaaagauggccuaguucagagggcucaggguucuuuuuggugcucauuaaguauaaaugugugucuuauguaagagggaaaacuucugagaacuggaagauagaaacauuguauuagagagacuugggagccagaguucaacaauguaucuaaaacagguuucaauaguuauccuuuuuauagaucauacagagucuuggcuuauuacaggguuucuagaguauguucuauuccauuucccccccuagcugggugagacucaggauguagcacaggucaagcaagggucugacugguuuugagaccucuccaguccaaagguccacuccauauccacuuauuguugcuuuuuugguuucuuugaggauuuucacacauauuugaagaacacuauuugugacuugaauaaggcauuccaugacaguaagucugccuuagccacauguacaucugaaucuuugcacauucuuccagugggauuuuuuuucuucuucuuuuugagacauaguuucacucugugaccuaggcuggagugcaguggcaugaacacggcuuacuguggccuugauuucccgggcucaagugauugucuuaccucagccccuuaaguagcuggggcuacaggcaugcaccaccaugcccggauaauuucguauuuuuuugguagaguuaggguuucuacguguugcccaggcuggucuugaaccccuuaguucaggcagucugcccgccucggccucccaaaaugcugagauuacaggugugagucaccaugccuggccaggaucauuuuuuagaaguaguuuuuucugaucaaagucaugccuuguacaaaauuuagaaaauauaaaacgguagaagaaaugaaagcagcaaguaaaaguuacccuuaauuccuuaaggguaauuuaagcaaauaaauuaaaggugacugucuuagguugugugauuagggaaggccucuccaggaggugaauguccucauucauaccguaaacaaugagcuugugaugauuaggaacagguuguuccaggaagaaggaacagcaagugcaaaggcccuaaggugggaauuagcauagcgugucugaggaacagaaagaaguggcaguauguuuggagccuagcaaguagaagggauguggaaguaggucaggucagagagacgagcaggugccagaucagguagagccugggggauccugguaaggauuggauuuuauuccaagggcacuggaaagccaaggaaggguuuuccauaggacaaugacaugaaaagauuuacuuucuaaaaguugaucuuuugccugcuguguggagaggugacucaggugagcaagagggagaccaguauggaugaggagaguggccugugguuugaacuuguugguggcaaaggaggagagaaauaaagggauuugggauauauaugaaggcagagcugacuggauauaaugaauugguugugagaggugauggagagaaagaagucuacaaugaauccuaggguuuugcccugagcgccugccugggugaaugugcuauaggguugaaugaacuagaaugugucuaaccaaucuuuuguggaacauuuggguuauuugcauacuuugcugauuaagaaugcccuuggaagagcacaugcaugggcuagcuccuuccuuuuaucuuguugcacuccugacagcaagaugggucaccagcagcuguacuggagccacugcugaaaauucagccaggguucucgcucuugucgcgucuguucaaaccggcacugucugauccagaaauguggccucaauacgugcugccaguguuuccgucaguacgcgaacgauaucaguuuuauuaaguuggacuaaaugauccuccuucaaaggauuauccaaggcaucuacccaauacaaaaccacgauaguucuuuguacauaaaauaaacauucaaacaaagaacgcucuuacaaaugucauuguguacaaaucacuggacagauauacuuucucugggauagguuucuaggaaugaaacuacuggccaaaauagaacuuaaaucauagggagaauuuuuuuuuuuuuuuaagacguagucuugcucuugucauccaggcuggagugcaguggcgcuauuuuggcucacugcaaccucugccucccagguucaagcaauucuccugacucagcuucccaaguagcugggauuacaggcgcccaccaccaugcccagcuaauuuuuguauuuuuaauagagacgggguuucaccauguuggccaggcuggucucgaacuccugaccuaggugauccaccugccucggccucccaaagugcugggauuacaggugugagccaccacacccggccgacauagggagcguuuuaaacguagcuuacaaauauucacucaaguucuugguaguuuauaggugcuacuuuauuuguguacuuuuuggcuuaauaaauguuucauuuaggccaggaguucgagaccagccuggccaacauggcaaaauucuggcucuacuaaaaauacaaaaauuagcugggcuugguggcgugugccuauagucccagcuacuuaagaggcugaggcaggacaaucgcuugaauccaggaggcagagguugcagugagcugagauugcgccacuguacuccauccuggacggcagagcaagacucugucucagaaaguaaauaaaaaaaugaaaaauauuuuauuuagguauggauauauguagcauacauauaaacugauuuucugauuauagaaauaauauguauaaguuagcaaaaguuuauaaagaugaaaacaaucacuuguaauuuaccaacuggaaggaaaagucacugcuaauacuuuuuuuuuuuuuuuagauggaguuuugcuuuagauggagucuagccuugcucugucgccuaggcuagagugcaguggcguguucucggcucuuggcucgcugcaaccuccaccucccggguucaagugauucuccugccucagccucccaaguagcugggauuauaggcacuugccaccaugccuggcuuaauuuuuuguauuuuuaguagagacgguuucaccguauuggccaggcuggucucgaacuccugaccucaagugaucugcccgccuuggcuucccaaagugcugggauuacaggcaugagccaccuuccacacacacacacauagauuuugaguuacauuauuauugcauuguauuauaguauuacuguuuugaaaauugcuuuaacaaugugucaucuaguauuuuccaauuuuguuaaauacuguuuuuuaaugugaguuaaguacucauguauaauuccaauauucaaauauaauuuguuauuccauuuuuacuuuugaaaagguaaaaagguacaugcagauaguaaaauuuucaaauaauacacuaggaauagaguggaaaguuucaugccuaucccugacucuugguuccccaguuucucuccacagggguaucugcuuuuaacuuuuuuuggauguguauccaaagauuuugucauauaucuauagcauuuauguguguauagcagugccucuuuuuuuuaauguacacauuuguucuuuguauugcacuuaagaaaaacuuagcaguaaagcuuagauagugguuuccaucagcauguaucaguuuacuuuauucuuuuaaaaagauaucugcauuauuuuuuauuguacagauauaucauaguuuauuuagccuuucucuuacauuuuggccucagguccuuuuuaacacguuugaaaauugagaaccaaagaagcuuuguuuauguggguuacauauauagauguuaaauggauuugaaauuaaaauuuagaaaauuugccgggcucgguggcucaugccuguaaucccagcacuuugggaggcugaggcgggcagaucaugaggucaggaguuugagaccagccugacgaacauggugaaaccccgucucuacuaaaaauacaaaaauuagccgggcgugguggcacaugccuguaaucucagcuacucuggaggcugagauuuacuugagaauugcuugaacccgggaggcggagguugcagugagccaagauugccccacugcacuccagccuggacgacagggcgagacugugucucaaaaaaaaaaaaaaagaaagaaaauugagaaaauuuaaaaauauuaauucaucaaaauaacaauaauccacuguauguuaacagauuucugugaaaauuaacuauuuuccaaaaugaaaucuaaugagaaaaguacuguuauuuuugcacauuugcaaaucuuucuggccuaauagaagaaaacuuuauugucauaucugguucuucauucagucuuuggugcuauguuguuuugguuaaaguauuugaagaacaucuggcuuuauacacauguaauuaaaggggaacucauggaccccugaaaaggucucauggacucacaggaguccugggaccacaauuuaaucaguccccuguugauuggaauucagguuauuuauagucauucgauauacagagcaugcugcacugaauguccugguaaaugugucuuucaacaaauguuugagugccaggcaaucuuggcuugugggaugcaaagaggugaaacaaggucuguuccugaaggagcugcuguuuuuugguggaggcaggcagucagacaggcaagcaaacaagaagaaaauaacacaauugggcuggguguggugguucauguuuguaaucccagcacuuugggaggcugaggcuggaggauugcuagagaccaaguguccaagaccagcuuggauaacguagcgagaccucaucuuuacuaaaaauaauguaagaaaauuagcugggugugguuuuacacaccuguagucucagcuacucgggagguugaggugggaggaucacuugagcccaagagguugagguugaagugaucugugaucaugccacugcacuccagccugggcaacagagcaagacccugucucugagaaaaaaaaaaauuaacugaggcugcaagaugugcaugcuuacagaagaggcagcuaacccagcauuuaggaggaggugagauuugggaaggcuuuuuagaggaggcgauuccugagcugaguuuugacaaaugaguacagcuacaaaaagauggcauggucauugucacagcauaccugaaacuccucuuguagaguuuguuuaugguccacaagagguccuugcuuuuauggcuuggccuuaccuuuucuauuaucauuuuaguccgcauccaucucuaaugauauugucaaaggaaaggguuaucaugccugccccauaucaccuuuccagcccucauugcuugugcuugccuuuaagauauacauacacauaguggcauuguaguauaugcauuuaaacuucggcuuuuaacuucuggaacugaaggauggcaaacaauccuaaaacuaguaaauugggcuucaagcuguuaacuauaaauucacccauucugaaaggcauguugaauuaccuguucccuucaaaaucuaccaaguaaauuguuaaaugguauuauauuaugcuagucugcucuuuaacaaucuguauuggugcauauugugagaagguuuaaggaguuggaaauuuuguaaguuuuuuagaugauguacuuucacaauggacaaugaaucagauauuucaaccauguauuuuccuuuagcaaacuagauuuuuuuuuucuuugaggcggagccucagucuguugcccaggccgaagugcaguggugugaucuuggcucacugcaaccucugccuccuggguucaagcgauucuugugccucagccucccgaguagcugggacuacaggcuccugccaccaugaccugcuaaauuuuuuuuuugcauuuuuaguggagacgggguuucaccauguucgccaggcuggucuugaacuccugaccucaggugauccaccugccuaggccucccaaagugcugggauuacaggugugagccacugcacccggcccaaacuagauuuuuuuuaaaaaagcaugaguagauaauagaggcuuuuggauuacucuguguauuuuacccccuccacuugauguuuaagcucucagguuggccuuuaagacauaguacaaaaggucuuguuuguacagcuucauguaguugaauuuaaauggcugauguuauauuuuaacagucucaccucuaaguucugagaguuuuuguacuaguuaaacaacagauccaggagcaagcaucccuuacuuagccagacagauaauacugaaauaaugcagagucauucuuguuuaucaucuaacuuccaagaagcuagaaaucaacuauuuucugaucuucagcaccuucugucugggcagcaguaaccuguaacccuggcauuuuauaauucuugugacuuggucauaaccaacauuugcagggggcgaagcaacugccaggcccuggacugacuaaugaaugcaaauuaucucuaauucccacacagaucuccagagcaguuuuuguuauaucauuugcuuuacaaauaaauaaauggccucagaaagguugaguaacuaacuuggucagguacaguggcucacgccuguaacccagcacuuugggaggccaaggcggauggaucacuugagcccaggaguuagagaccagccugggcaacauggcaagacccugucucuacaaaaaauaaacagaguuagccagagugguggcgcaugccuguaaucccagcuacuugggagacugaggugggaggauugccugaguccaggaggcuacagugagucuauagugaggcuacagugagcuguguuugagccacugcaccccagucugggcaacagagcgaaaaccuucucaaaaagaaaaaaaguuggccgggcgugguggcucaugccuguaaucccagcacuuugggaggcccaggcagguggaucacaaggucaggaauucgagaccagccuggccaauauggugaaaccccgucucuacuaaaaauacaaaaauuagcugggcaugguggugugcgccuguagucccagcuacucgagaggcugagguacaagaaucgcuugaacccaggaggcggagguuguagugagccaagaucgugccacugcauuccagccugggcaacagcgccgagacuaugucuccaaaaaaaaaaaaaaaaaaaaaguugagugacaaauauguggcuucagaaagguugaguaacuuguccuaagucaaacagcuaguuaaagagaaacuagcguucaaaccuggggcuccauagcuaggauuaaacuucuucccauuaugucgugcugacaucugaguacucuagaaacuagugaaauacucaugucuuauaaaugccauguagggacagugugucuuagucuguuuguguggcuauaacaaaauaccugagaucaaguaauuuauaaacaacagaaauguauuucucacuguucuggaggcugggaauuccaagaugaaggugcuggcagguuuggugucuaauaaggccuguugacugcuuccaagguugcaccuugaacuuuguauucucacauggcagaaaggauggaggaggaaaagggcuaaaggccacauuaagcuucuuugauuuuauuuuuucuaauuuuaaaaauuuuccacuagagacagggucucacuuuauuggccaggcugguuuuaagcuccuauacucaagcaguucuccugccucagacucccaaggugaugaagccucuuuuauaagacacaagacuuaaaacaaaaacacaaaaacaauaaauuaaguuuuuuuuuggagaugaggucuugcucuguugcucaggcuagaguggaguggugcaauauuggcucacugcagccuggaacuccugggcucaagcaguacuccugucucauccuccagaguagcagggacuacaggcgcaugccaccacaccuggcuaauuuuuaaauuuuugguagagacaaggucucacuauauugcccaggcuggucuugcauuucuggccucaagugaucugccugcaucggcuucucaaaaugcuggaauuacaggugugagccaccacacugcaggggaggagcccuuaugaccacuuaaaggccccaccucuuaauacuaucacauugguuauuaaguuucagcauaugaaucuggggggcacguucagacccuagcaccauggauagcagggaacaaguaugcugaggcucagaaggcccuuuaaggguaggauagagggauguacuuuuuguuguuguuguucugucccuaaaacauuuuuuuuuaaaaaaccuaaaaaaggaagcacugacuuccuccucccaugaucaaaaggaccaaagggggucaaaaauagaagccauuugguugugaggagguagaaauugcuuuucaucauaaugguaagaguucaggaauaaugccugaacuugguguuauuuuauuauucauuugucccauuugucacaugucccagcauuagguauggggaggcgugcaaaaaaguaaaacuuguucucugucuuugagguaccgacagucuaggguuugagcucugaguucuacauuacguucccaggaggcauggcggugcgcaugcaugcagguagagcaugggggucauagacaaggcagcaaggagugcuuuguucacauguaccuuuugccuguaaugccuuucacacuucuuuaaucucucgaaguccauuucuacucucauugcuuccaugaagccuuuccacaccuguugcagcuacaggucauuuucuucucuaaaauucucucauacccauugguaccuuuaauuuguuauucauuaucucuuguaagauguucuauuucauaauuucaguuauugucuguugccauuugaauaguaauuuuuuuucaugacgguucaguucaacuaauguuuuaauaggcuauaacgagaggagaggagacagaaaaaaauaagacaccucauauaccuuaugccuuguaccugauaucuucuggaaguacucuaaagaaaaugagauaguacagugaggaagagugggaagacuacuugagauuguggcguuagaggccucuuugaggagguaauauuuaagcugagcucugaauaaggguaggagucaggcgugugaagauuugguagcaggccgggcacggugguucacaccuguaaucccagcacuuugagaggccgaggcagaaggauugcuugaggcuaggaguuugagaccagccuggguaacagagugagaccccgucucuauagaaaauaaaaauaaaguuagcuggacgugguggugcaggccuguagucccagcuacugggaggcugagguggaucacuugugcccaggagguggaggcugcagugagcuauggucacaccaccgcacucuagccugggcgauacagugagaagugucuuaaacaagaagauuugaggcagaggaagcaguauguggaaagagccuaauauaggagugaacucucaguaaguggagaggaugcgggaggaggcuuguaucuugagcacuguaaguggggaggagaugguagaagcggaggcuggaaagguagguauagggccuugaggcauggccaggaguuugggcuucauuguaacuggaugagaauccauggaagguuuucagguuguuacuuuuauuuuuuauacguaacagcuauacugaauauaaaauuugcauacaguaaaauuuauucuuuaaaaguguacaacucagggccgggcgcaguggcacacaccuguaaucccagcacuuugggaggcugaggcgggcagaucacaaggucaggauauugagaccaucccggcuaacacggugaaacaccaacucuacaaaaaaaaaaaguguaaaaaucagagguuuuccuauauuuuacagaguuguaaaacgaucaccacuaucuaauuucagaacauuuucauuucuccagaaagaaacccuauacccauuagcagucacuccccauuucccccuugccccagcccuaggcaguuacuacucuaguucuguuuguauggauuugccuauucuggauaguuguauguuaauauaugugacuuuuugugucuggcugcuuagcauguuuucaagguuuaucuauauuguaguguguaucaguacuuuauucauuuuuauugccaaauaauuuauugaauggguauaccacauuuuguuuacccauucauuccuuaauggacacuugggcuguuuccugcuaugggacauuuguauguaaguuuuuguauggauguaaauguucauuucucuuggguauauaccuaaggauagcaauacagguucauuugguaacucgacguuuaauaguuuguggaagugccuguuauccaaagcagcugcaucauuuuaccuucccacuagcaaugaaugaagguucguuucuucucaucgucaacuuuuaccuucugauaaaagaaaaacuucagccaaguuuaauugagcaaugaaugauucacgaaucgggcagcccucagaaucacagcaaauucacagagacuccaguacagccacaugguggaagaagauuuauagacaaaaaaagagaaaugacuacagaaaucggaagugagauacagaauggcuggauugguuacagcucggcauuugccuuauuugaacacaguuugaacacucagcaguguaugagugguugaaguauggccacugguauuggccaagacucagcuauuguuauagucacauacuccuaaauuagguuuuuagucuuaucuaccuaagccagguugcaguuuguccacaaguguaaccucccgaugggcucaccuugccugcugccuagacagagcggauuuaucaagacaggaauugcaauggagaaagaguaauccacguagagcuggcuguacgggagacuggcguuuuauuauuacucaaaucaaucuccuugagcauucaaggaucagaguuuuuaaagauaauuugguggguggggcuugggaaguggggagugcugauuagucagguuggagauggaaucauaggggguggaagugagguuuucuugcugucuucuguccuugggugggauggcagaacuuguugagccagauuaugggucuggguggugucagcugauccagugagugcaggaucugcaaaauaucucaagaacugaucuuagauuuuacagagugauguuauccccaggagcaauuuggggagguuuggacucuuggagccagaggcugcaugaccccuaaacuguaauuucuaaucuuguagcuaauuuguuaguccugcaaaggcagacugguccccaggcaagaaggggucuuuucgggaaagggcuguuaaucaauuuuguuucagagucaaacccauguacugaauucccucccaaaguuaguuuggccuacacccaggaaugaacaagggcagcuucaagguuagaagcaagauggagucgguuaggucugauuucuuucacugucauaauuuccucaguuauaauuuugcaaaggcgguuucacaaggacucaaauacugaaguauggaguccuucucaggucauauuuaguuugcuuuaaccaccccucccucccuaccuuucucucucuuucaauuuuagcuacccuauugaguauaaagugguguuucauuguggcuuugauuuguauuucucugaggacuaauaaugcugaacuucuuuucauaugcuuacugaccauuugcauauaucuucuuuggagaaauuccauucaaauccuuugcccauuuuaaaauuggcucauuugucuucuuguugaauucuuuauauauucuggauacaagucacuuaucagauauaugauuuacaaauauuuucuccuauccuguuucacuuccuugauggcucccuuggaagcacaaguuuuugauuuugaugaaguccagaugaucuauuuuuucuuuuguugcuuaugcuuuuggugucauagcuaaaacaccauugccuaauccacaguguagccauuguuuuuaaacaugggacugacaucugacucacauuuugaauagaucacucaggcuauuuggaaacugggguugaagguucuagagugaaacuagggagaacaguuaagaggcugucaguauugacagacaaauggguagacuuuaaacuuauuaagcacuuguaaaaucagucuauuccaaaagcauuuuguuaaucagaguaagaaauggucucuaccuucaacaauuuacaagauaaaaauauacucaauuauuuuauaaagcaaauuauauugagugcuauaaaaauaggaaugaaaacacuuuuuuaagaacaguagagagaagaguuacuuguaugaacuuuuauuaaguucauuuaaaaaaucucuagugucuaacauaccuugcuuaauaguuguuuguuauaccucuggacaaaagaguuagagggcuuugggaaagauggcauuagaaccgagccuugaaggaugaguagcagguggaaacaugugaaagcaggguauuuuugauguagguaucaugucuaugaguagacaauuaaaauuaagggaacuuugugaggugagaugacacacaccacaccuuuugucccagcuacuugggaggcugaggcaggaggaucacuugagcucaggaguucaaggcuguagugcaugaugauccugccugugaauagccacugcguuccagucuaggcaacacagggagaucccaugucuggaaaaaaaaaaaaaaaggaaccuucauugaaaucuagaguuggaggaauuauauguagaguuggagcuuacauguaauuccagauugaguuccucaaacuccuuuugguggcuguuacucguagcagaguaugauguggauuguagugggggaaaacuggagcacagccaagauggugccacaacaguuuagaugcggucuaggguaacaguaauggauaaaaggggaagugagaggaguggggguagugauggcagugucugauaggacuguaggagaauggugggcggggcagagccaagugcugcccuuugaaggggugaacuugaaugacugugccaggaaaguagucccauuuaacacaaggagggcaguccaggcaugaagaggauaaugagcuuaacauaccugugagaaguuucagguggagguaucugguggccuucggcacagcaagugguaggcacagggaguuggcuauaugcuguagagaaaauauaggugggcuuuagaggcaggcauaacucugccuccaccuuuuacuggcuuuguaaacuuugggggaaguuaauuaaacuugauuccugagggucagauggggucgucuguguaaaaugccuggcaaguaggaggcuuuucucuauuguuuguucccuucuuuucuggaguccuaaugcuuugauuucauuuauaaucuuccuuagugaauguggugcuuugaauggaagcacaauccagugggauuuaagcuguguguguguguguguguguguguguguguguguguguguuuaccacccagcagaggcuacacuugcucacuguuuguaaacccccuauuaguugugcuguccuucuauuuucccuuggacuucucuuguguucagucuuguccaaacaaaaauauuugcauuaaaguuauguguguuccucauuuggaagacuccuugaauccauaauugcuuuuuaaauuuuuuuugaaauagucuugcuuuaucucccaggcuggaggaguacaguggugugaucaaggcucaccgcagcuucaaccucccagacucuagcaauccucccaccuccguuucccauguagccaggacuacaggugcucaacaccacaccaccaauuuuaaaguucuuuugaagacgggggucucacuauguugcccaggcuggucuugaacuccuggacucaagcaguucucccacuuuggccucccacaguguugggauuacagaugugagccacuggggcuggccauacuugcuuuuuaagaauugugucaucuuggccagugcaguggcucacuccuguaaucccagcacuuuggaaggccaaggcgggcggaucacuugaggucaggaguuugagaccagccuggccaacauggugaaacccugucucuacuaaaaauacaaagauuagcuaggugugguggcuugugccuguagucucagcuacucagagggcugaggcaggaaaaucacuugaaccugaaaggcggaaguuguagugagccaagaucacaccacugcaccuccagccugggugacagagaaagacucucucaaaaaacaaaaauagaaacaaauuaugucauuguuaagaggggcaguuuucuaaguuuuccuguaggucuaaucggauggauuuuuuuucaggaucuuuuaauaugcugggcugcugauauaucugauucaacuucuggucugcuuuguuuuuugaacucagcugcuucuauauuuuuucuucugcauaacugguagaacagccaauguagucuacaagagagcuauaaaauauugauugcauauaugaguacaguuucccaguuuucuuaaaugguaacuauaaauacugucucaggacauaauuuaguuuuuccaaaagggagauagauuuuuuuuuuuuuacacuuguauuacuuuaguggcuuaguuuaaaaaaaaaaaaagaucaaggaucuagcuuggagcacaaaaaaaaugcaagaucuccuuuccguggagcucaguucuguuuugguuuucuaggguucuuagagacuaaacacuaugcauaacaaugaauguguuaauuuuaaugauuuguuccauuucuuaaugucuuagaauuggaagggauuuuuagucauucuauccaaguggccauucugugcuggauccauucuauagcagcugacagcuaacucgccuucucuggaaacaggcucuuucauugcuggacaggucuaauuguuggaagauuuuuuuuccccuuauacugagaugaaagccagccccuugaaacugucauccauaaacugucauccauuuguccaacuucagucuuuuguugucacauaaauuaaauccgcuagcucuucagauaauugaaaauaguugcuaggcagcacuucucugacuuaaguugucuuuuuuuccccaagaaaaauagccccaguucucucuaccauucuucccauaucauuucuaauucuuuuucagccuuucaccaugacccuuuuaaacugcaaugaccaccacuaacaacugguuaagugugguagaaccacuguagcuuuaguagguuacucugcauauucuuuuuuuuuuuuuuuuuuugagacagaguuuugcucuuguugcccaggcuggagugcaauggugcgaccucagcuuauugcaacuccgccucccggguucaagcuauucuccugccucagccucccaaguagcugggcuugcaagcaugugucaccaugcccagcuaauuuuguauuuuuaguagagacgagguuucaccauguugguaagucuggucuugaacuccugaccucaggugauuuacccgccuuggccucccaaagugcugggauuacaggugugagccacugugccuggcccugcauauucuuuuuguuuguuuuuguaaagaugagggucucuguuauguuaucuaggugggucuugaacuccuggccucaggugauccucccccgucaggcucccaaaguacugggauuauaggcaugagccaccacaucuggccugcucuccauauucuauucucuuucuaaauaaacacauuauuuggaaaguauuucugaacauuguccugcagggcacacuguagcucagccucauaaaagccuaccuaccauauuugagggugcauaccagggccguuucagaacguaccagcuacuccagguuacucaaaucuguaguccuguccuuugaguugggccagagauuuucucccuuggcuuaugcugaagaauaagauggcuaucuaaaauuaauggcaggacaaaaaugcugguagcaugguggaaauaacacuuagccuaggccagguguaguggcccauggcuguaaucccagcucuuuggcaggcugaggugggaggaccacuugaggccaggacuucugagaccagccugggcaauguagcaagaccaugugucuacaaaaauaaaaacaauuagccagcuguggugguguaccccgguagucccagcuacuagggcggaugagaugggaggauugcuugaaccuaggaguucaaggauacagugagcuaugauugcaccacugcacuccagccugguuggcagaaugagacgcugucucaaaaaaaaaaaaaaaaagaaaaagaaaagaaaagaaaaaaacacacuuagccuaaauauugcaggauaucauucagcggugaacaacucaugacugaauuuccccaaauuaucuuuauuuagaguuuauuuggauuguuuccacauaucuggauuuuuuaaauuccagaacuguauugauuuaugccaaaugacuuagugaugcaaagcucagagagguagugugguuguauuuaagaguguaggcucuggauuucgauccugauuugaccacccuagcucugugacuuugggcagaguagccaauguuuuguguuuacucauuuguaaaugagaguaaugauagagcuaacacacaggguuuucuaguauuacacagauucauauauauugacagccuggccagggugaggggagugaagcugaggcacugucccccagugaaaaguuuaagggggcaccaaaaacacucaguaaucaagauaaauaauaguuuaaugugauaaaaugaacaacauaccaaaauuucaaauaaauuccagaucuggccuggucaggaugagggugaaguaagacuaagucaggcauauguagggucagguccuauuguuauuugaacuuucugcaguuuuuuuaucauggauuuuuugggcauguuuaaaaguauugcauuaaaguauuauuuuuucuuggucauuaguuguucgguuuuguguguguguguggccccucacucacucccucacucuagguggugugaggccaguguauugguauuuguuauuagugauuacucuaggguuaguuuuguagaggaaaugaauuuuagugccucauggaaagucccucccaccuccaggauauuuucuguuagguugcgucagagucccaauccaaaucucauaacuaagaucaguuuuggccaggcgugguggcucacgccuguaaucccagcacuuugggaggcggaggcgggcggaucacgaggucaggagauugagaccacggugaaaccccgucuacuaaaaauacaaaaaaagaaaauuacccaggugcgguggcgggcgccuguagucccagcuacucgggaggcugaggcaggagaauggcgugaacccgggagacggagcuugcagugagccgagaucgcgccacugcaccccagucugggugacagagcgagacuccgucucacacacacacacacacacacaaaaaaaaucaguuuuaagguauuagaggaugucguucuuucuugucuucuguuaaauggugcuuugaaugucauguuucaaacacugcuggagcucagaucccagaaaaugaaaaaugugugcacuuagcuuaugcguagaggagccuagccaaaccaaacagcacguuugaaacuuugcuuuuccuuuauggcugagauugugaaagacagccacagaugguggcugagcucuagcuggaacugcuguuagucggcgcgagauguucuaagugacgggagccaggaacucacugugguguuucuagaaguuaaauuaugaugauaggaucuuccuguaauacugguucuguuccuugccuuuaguuauaucuuggaaaucugucacaugguuagugacuagugaaaggccaaaaaaauuugcagaaucagcuauuuaaagcuuuguucuugauaguucaaguguuacgcaaggcaaagcagcccucuguuaaggguuucaggcuaggugucuccuuguuagggugucauuccuguuguaauuauugguuugucuugucuucuuccuuuuuuuuuuuuuuuuuuuuugagacaaggucuugcuuugccauccaggcuggagugcaguggcacgaucauggcuuacugcugccuccaccugucacucaagagaucuuccaaccucagccucccgaguagcucggacuacaggcacaugccaccaugcuuggcuaauuuuuuuuuuuuuuuuuuugugcagauagggucucacuauauuucccaggcuggucuggaaguucugggcucgagcaaucugcuugccucaaccucccaaagugcugggauuacaggcauaauuauaggccuuuuuuuuuuuuuuggauauagacuuauucuguguuucagaaauaguugcuuuuuuuuuuuuuuuuuuuuugagacagagucucccucuguugccuagccugcagugagugcaguggcacaaucuccgcacugcaaccuccaccucccuggucaagcgauucuccugccucagccucccuaguagcugggacuacaggcgcccgccaucaugcccggcuaauuuuguuuuuucaguagagacgggguuucacuaaauuggccgggcuggucucaaaccccugaccuccugaucugcccaccucggccucccaaagugaugggauuacaggugugagccacugugcccagccaauaguugcucuuaaaaggucagguaaaacgaauguuguugaucguuugccuaaaauauauaggguugaauagacugauaaucaccauagcagcuaucauuggauuuuauuagguuuaaauuuaucugaagauugucaugucuuuaagucgcaaagaaguggaaucuaauuauauacuuagggcuaggcaugguggcucaugccuauaaucccagcacuuugggaggcugaaguggguggaucacuugaggucaggaguuuuagaccagccuggccaguauggugaaacccuagcucuaguaaaaauaaaaaauuagcaugguggcacaugccuauaauccccgcuacucgggaggcugaggcuugagaauugcuugaacccaggcgcagagguuaaaguaagccaagauugugucacugcacuccaaccugagcaacagagagagacuccaucucaaguauauauauauauauauauauauauauauauauauauauauuuaaacucauuacacuucccaaauauauauauauuuggaaugaguuuaaaacguaagcuuuacguuuuuuaaaacguaacuuuuguuuguugacugaugccagacguugcugccuuggugaaguagcucuacugcaccaaguuaaaaaaguuaaucgucuuuaaagacuguagguaucuucugguuuaguguuaaauaaaaagaaaaaagggaggggagauucuugucucgaauaugucaccuucuuuguaccaguuuuuagagagcagcuguggcagcugcugaauuauauaugccugcuuuguuuuccuccuuuuauuuggcgguggagaaagugugacaauuuuaaagugacucuaaaauuaguauaucugguggagcauucaauuucaugaaugugcuguuuggaauagcaguauggaaucaaauaagaugcagagacuuggguauagaauaagcuuacgaauggaaaucaggggccugaugcacuacaggcgguuugauuuaugacggaaacauccucagauauccaggaacucauauauuggaauagagacaacugugggaauagauuguccuacccagaaagcaaaaucuggcagaguuugagguuucuuauuggguaauuuuaucagcucguucuuagauuaauuaguagaauaagacuuccagaguugcaagaugaaaugcgaugcuuucuucucuucuucuucgcuauuucuacuucugggccaucuuggccagcaagagauuuuuuuuuuuuuuuuuuuuuuuuugauacgaacucucgcucuguugcccaggcuggagugcaaugacaugaucugugcucacugcaaccuccacuuuccgaguucaagcgauucuccugucucaaccucucagguagcugggauugcaggcaugugccaccaagccuggcuaauuuucugcauuuuuaguggagacaggguuucaccacguuggcuaggcuggucuugaaugccugaccucaagugauccaccugacuuggccucccaaagugcugggauugcaggcgugagucacugcgcccggccuagcaagagauuuuugaaccacaagucuuggucgucaguauugaaucauuaugguguguggcaugguaguggcugcaccauguuggaguaaauguguucucauggugggggauauuagugacccuggguaacaguccauggcacuuggcuugcaccacagaguuaacauacagcagaucagcugucccuguccuccagcuuuauauaccgaauuagaaagacuugggcccucauccuuuacucaguggcuucccggcacuccacaccacaucucuaauacuggguauuuucucuggucaccucuuccucagauugcauacuucccuguaauuuuucacuucugcguuucagucuuuccuuggaaaggcugcccuuucuguaugacuucaucccauguuggacccgacccuccuucuuuccuucucccaaagcacuacucauaccuguaaucccagcacugugggaggccaaggugggcagaucgcuugugcucaggaguucgagccugggcggcaugguggaaccucaucucuacaaaauacaaaaauaauuagccaggcgugguagcgcacgccuguagccacagcugcuuaggagacugagguggcaggauccccuaaacccgggaagcugaggaugcagugaggcauaauugugccacuguacuccagucugggugacaaagggagacccugucucaaaaaaaaaaaaauagacuacuuagcugaggugguuguauuaagguuuggggugauggggauuagagucuggcacaaggaaguugacauggcauguuagacaccgguguccuaaaaaccuaucagccauuccccacacaccccuucagccacugccugccccuccccuggcuuagguucagcucacugauuucuugcucuuuucccuucuggagagucugcucuuuuucuguuccucagcuuucaauccuccaauaccagaaggauuuggcuuucuaauccagaauaguuucccucuucacccucaaccccccaaauaaacccuagccuuaccuuuauugauccaaaaacucauuaguuuuuccugaaugaagggcccagagcaaagcauaggcagauguuuugacacucuaguuguuuuuuuuuuaaccugauuaaauuuuuagaugaaguuuauuuucccccaagucucucuaagaauacaaggaacucguuuucuuaauucagagacugaguuuucuuaauuuucuuucuuaaauucagagaccgaauuucccuuuggcaaagacagauccucgagugucaggacuuauuauuauuuuuuucuuggcuacaauuugccuucuuuuuucuuuuaacauaccucauuuacucacuuaauuuaaaaaauacuguugggauccuuugcucccugagccuuuguuuaagucacugagcucaacaagaccugcccuugagguguucucaguucacaaggggaaaggggaaagggacagaugguugaacaaagaauuacggugugagagaaauugcuugaggaagugagcaaaggcuuuggacacagggucuagggagcuacuugcuguagggcauguguuaagaguucaggcuuuggaaccacauugacugggaagccagccaggcaaguuacucaaacacuuucuauuucuucaaccacaaaccaagaauaauaaugguacuacuucauacgguuguuguaagaauuaauugagauaauacguacaagggaguauagaaagacuugacccaauauuugcuuauuuauuuuuucuuuuuaaaauuuuuauggauaucuauuuuuaaugugcuccaugguaggaauuagcuuaauccugcaauuaagugaaacacauuuuaagaauguauaauauuuucucuuuuugugugccacuuuuuauuuuaaacaaccaaaauaguggucaugaccuucauuugacaaccccugguccaguacuuccuaaguguuucauuacuguugccacugguaucguuguucuugcuggcuguugaaggaugauuguguguuggcccgcucaguggacugcuuguccuugcugauugcugaggagguccugucagaagaguguccgcaucagcucucccuguucccguuucccuuccggagguugcugagcagcacacauuuuuggagcccuugcuguaguucuccaacagggcauugccagaguuacuacagagagagagagggaagacucucaugggcagcaguagcaauccauccugugugagcagauggcacuggagaauagcagccuugcuucugcugagcugcagccaagauccuguucagagaggcagccaacaaggugcauggcacagccggauagauucacacucugggccuugugcaauggcaaggaauuacuauuuguguugcuuuaaaagugacauuccuccuuauccucugaaugcgucuaguacuugggcugugcucagguuacagggaggcuguucuaugguuuuuacagaguaagaaaauccagagggccccugagauuuccaauguaauccuacucuguagggcugaaagugccugcuaugguggauaccaaggcagauuuccagaacaugagcuugaggagacgguuaaacauucuggguuuaaaacucuucugugauuuuggcaaaucuuucagauuacuugccguuuuccuauuugcucccuugcccaacuucuguugcauucaucccaaucugcuuuucuccuccgcugcuuauauaaagccgcgugugguauuacaccagauguucaugguguguuuaugaaugcauguguuccuaucccgggccaagaaaauacacuugacauaggacguccaaaauuuuuuggcuuaugaagcuccaguaucuuuuacuuucacuacuuauuuaauuuuaaaagaagguuacuguacuguuuuauucuuugaauaaauaugaagggugaaauaauaauugaucugcuggcggaaugagaaagccuaaggaggaagaauugucuggauauccuuugugcuuagagauuggaucaccuucuuuuucaguaaugccagccccuccccuacccaaagucauggcuguuguccaugcaucuuuuuaucuuggcuauuauagaagcauacccacugccaacacauuucuggacccuggguacaaaauuagacuaagugaauauaaauauccagucuggcuagagagaaaagagugaagaggccucaugaagcauuggcccuuauucucaggaagcguucuagggaaaguaugguagaaagaacacuaaaugaugauucaggccugaguucccaucccgacuccaccucucacguuuagaacgggcauaaugaucaguugauuucgcugcccgugaaugccgggagacucuccuuagucuguaaaguccccuccucaccacagagauggaaccucugugguuuaaggaaagcugguguggggaggcuaguccucuacccuucacacaagccuccaaaugcagggaguugaagugccaccacagagauagcagaggucgaacggucuaccucucucuugcagaugaggaaacuugaggccacgauaagugaaauacauugcuguguugagaguccugugggcagugagcugaaagcagaacaaagagcugggacuccugauucccagccuggcaguaguaguuccuggugucauauuugccauugccucaguaugaagccauuccaguauuucaguguuuuuaaaaagguauugucccuugauaaaaugcagaugucaggaaauaaaucacauuacaaauucuuucauuuuuaaucucacaauuagugauuaagagaugcauauuuguacuuucgagcucaaaucuagguuaaauaauuuuucauuuuacuauuaaucugcuuuugacuuaggugauaaucgauugugcagaucacagauuugaguaauguuggcuacaacuuccuuugguugaagaccaacaauaauugccgcuaucaugagcuaaauauugcagacuaaaugacaaaggaaagguauugaagacggguguauuccauaugaggucucuuuuucccucagagaccagugacuaauaugccacgagcauauuagucuaauauccaaaggaacaaaaaugaguaggauuauagucuuuacaguuucaaaguuuuaaaaauuauauuaaauaaguuauaaaccugucuuuguugucuucuuuaggaauagcuuacaaaucccugcuggcuugggauuuauuaggacacuuuuaggguaaaauuuaucugugucacacagacacccagaggagauggcacaaagagaagcaguugaguuuuguuggugaagccuuguacaaccuuccuugaggugacuuccgcguaccuauauguuaaaaacgguaaauuguuuccuuaaugcuaaacuuccugcugcuucugucagagaauacuuuggaauccuaaucucagaaaucuuucagaguugacucaugcauuuuguggguguuuaagaaugucagauagcuucaggaggagcaagcauccacuuguugggaacagacccuuccuuguuaagagaucaggcuugggauccaaacacaaccugugguaaugaucuuucugcaccaauuuguguagacugaagcaacgguugugagaaccaagggcaacaugcaccaaauguccacuuauguagucuaaucagguaagagaaugcuuugcuuaauucaguaauuuuccucaguuauucaaggcuugccaaagaaucagacuauaagauagcauuuaaaaaaaaaaaacauugcugcacaugauguuucauuuguugagaaggguuuucugagucuuaauugccugaaagucaugaccguggcugucaggggugaacgauacaaaaaguaagguaugguaaaggguguaaugagaaguucaucuaauaauuuguaggguccuguggaugggaagguggaagaguucaaagguaugauaauucuucaucucaaguagaguggcucuugcuugacuguuaagauagccucuggccucaaggggauuauaaucugcucuggaggauuuguaaacaaugucuguuccacuggaggagugaaaugucagguaaagguacaaggccacugcauaugauuguacaaaucguggccuguugaggggaaccuggcuaaggggugugugaggccuguaguccaacccugguucugcccaccgagcuguguucuccggcacacggcugagucugccuggagaaaugagcaucuugaaaugugugcauagccacaauguguuuacucagcugggggcccacagggcugccucuucccaaagggaacaccucuguaguacagacaccgaaugaacuaacuuuagcccaugugcugguagauuacagaaggggggauuaacucucaagguaagauaggagaaaaaugaucagggaaagcuucuuagaggaacacacaaacugaaggguguuucuuccagccaacauuugcuagcccuucagaagcccaacuccagugugggaagcuucuuuuggaccugaggucagauugggguguccaccucugucuucuguuccgucuuuccuccacgagucuguagauugcgggaggguaggaaccacagucgcacuugacucugugccuggcacagacaaggggucaaaggaugaaugauaaggaaaugagggugggaggugagguugagaaguaguuuccagcuagaucagagagaccuugaaugcuauccuaaggaguauucauccaugccauccuacaagccaaggaacacacuguggugucagcaagggagcgacuugugccaccuuguguuuuuggaaggucuaucuuggaguugugucuaggauggauugggggagggagagggucugggagagaggaaaggaagcugacuggugaggagauauggaauuaaaggaugcuuauaauuugguaggaaacagccacauagaaacugaguuuuuaguuaguuagauacaguaccuaaaggaagcacugguuauacagagcaggaccagguauuuccuuacagucagcagcucgguucuuuaguaagaaccugucccuuuuauacaggugcuagugucauauuucagcagcauguaugcuaacaugcaaaguuguuucuguucaagaaaaugcucacaaacauugagaggcaguguguagugguuaagaaaauggacuggggccaacuugcuugaaguugagucugggcuguaugacuuauuaacucaguuacuuugggcaaguuacuuaaucucucuguguuucaauuuccuuaucuaagaaauagggaauauuauacccuagacuucauagauauuugugagcauuugaugaguucauguauauaaacuuucuagaaucggccaggugugguggcucaugccuguaaucccggcacuuugggaggcccgggcaggaggaucccuugaacucaagaguuugagaccaacguggguaacaugaugagacccccaucucuacaaagaaaaauuagccaggcaugguggcaugugccuguagucucagcuacucuggaggcugaggcgggagaaucgcuugagucugggaggucaagugugcagugagcugugaucacaccacugcacuucagccucggugacaaagugagacccugucuccaaaacaaaaagaaaaaagaaauggucuagaacaacccuuggcacauagacacaaauacuuaguaucuccauguucuugaaugaaauuugcaaagcagcaucauuccaagaccuuuauacauauguuaaucacaugcaacuuucaaaacaacccuaagugauauuauucccauuuuauuggugaggaaacggaggcacaaacuugacugaggcaaagacauacgugacaaaagucuuauagccuuuaaguggugccaggauuugaacucaggcagucuggcucuaaagcguauguacuugaccaauuauacuggauucagaauuuucuuugggccaggugcuggggcucaugucuguaaucccaccacuuugggaggcugaggaaggaggaucacuugaggucagaaguucgagaccagccugggcaacaugguaaaaccccgugucuacuaaaaaugcaacaauuagcugggcaugguggcaugcaccuguguucccagcuacuuaggaggcugagguguuuucuucauaguuacccauagcaagugucagagagugauuuaaaacuguauuuuugguaugaaggaaaagaaagucaagcuuugaacaaauaccaauugaaagguggauacuggaugucugaaaugagucacuuaagugccaaaaugccuuaaauuuaagaguuucuuccaugauuucugccucuaaaggacuuugacaucuauuuuuuuaaccaagguuuuuuauuuuuuaaagcuuauuuucuuacuggaagagauucagcagagugauauuagggauaacuuauagaaugaagucuuucuucacuguauuuuuucccccaaaguaguuauuucuacuucagugccaaaauauucuuacaaguggggagauaaagaacuugcagcuugaagaauuauaaagcucuacaguucaucuuugaccaggccccuugagaugcguguaugugugugcgcaggugcgcacacacgugugcacugccauuauuagugauguuuuggcgaagggaugauaccagggugagcaaggcuucuccuaguucugucccauacaugcagucugauacuucaggguagaguggucuuacaagggaauugagcucauuuacaggaaucuuacucucagcauuuucuguagaacaaugaaaagaacauugaguaauuaucucuuucuggugacuuagccaggcaucuugggaauuugcuguuuugugaacauucguucagcucugucuuguauaucuaguuugccuucacuuuauagacagucacaacaaaaagaggauacagaugugugggugugugggugcuagaaacaauaacaauuuuguaucucccacccagccuaagaaacagaguguuaucaguaccccauagcuccuuuuuccaucucucuccuccagcacuauccugcaucuuguaaugauucucuugcuuuaccauauacuuuuguauaugcauguagccaucaacauuauauuguauaauugugucuguguuagacuuuuucauaaaccagcaggcuccuaagcuguagaauuaagccuuuuuuuuuuuuuugagacagagucucgcucuguugcccagacuggaaugcaauggcgcuaucucagcucacugcuaccuccgccucccagguucaaggccucagccucccaaguagcugggacuacaggcaugugccaccaugccuggcuaauuuugguauuuuuagcagagacggggauucgccauuguuggccaggcuggucucaaacuccugaccucaagugaucugccugucuuggccucccaaagugcugggauuacaagugugagucacagugcccggccagaauuaagcuuuuauuauuuuuauuuuuggguugugccaguaaaugauaggaagccauucuuauaacuugacguuguuuugauaggccaaguugucaucuguuugaugucaccuggccaagcaaucugaagaagaucacagaugacuucugaugcccccucccuuugugguuucucugacacuuagggaaaugugccacagccuggcacagaguaguugcucaguaaauuuuuuauuuuuuagaggcaggagugccucucucuguugcccaggcuggagugcaguggcgcagucauagcuugcugcacccuggaacuccugggcucaagugauccucccacuucaaucuccagagucgcugggacuacaggugugugccaccacgccugacuaauuuuacauuuuuuauagagauggggucuuguuauuaauauguugccccaguuggucucaaacuccuggccucaagggaucaucccaucuugaccucucaaaguguugggauuacuggugugagcuacaacacucaguucaaggguacgauguuuguaucuuuagugccuugugugguaccugguacauagacuugcagaaaauuuugguuggagaagugguguguucagagaauuuucagcugugguucugagugauuggaguggcuuuggaaucgaggugaugaucuggggugaaacaggaguagcucucucauagguuacugcacagcugacuucuggcauguacuuuuccuuuccugugucacaaaacacacuuuucauuguccuuaugcuggccccaccugcguuacuuauugaaaaaaguauaugacagacagaaauaagacauucagauaaaaaaaaaaagaccucauuugccuuugcuuaaaguauuaguaguugagauuugauccugagagacuuucauuccaguugauggauuuuaccuaacuaaagucaauuauuuugagguguuaaucaccacuuuuauuaaaacaaaucuuuuugucuccagcgucaagaaacuaagguaaccugguuggcuuucuguaacccuggacuaguauuuuagagauaaucucuucaauagugaaagguggauuggcuggcagauucauuguuugacuaaacgcuuucauuuagcuugugaccuauagccuauuccucuuucauaguguauuuauguagaacuuuauuggcaguguaagagccucuauaucuuaauugugauaacuacugacuguuuaauuuucugccugacacagaguaaaauuccaugaacuuuugcuauugaaagcuuuugguggauuaguacccaaucccaguguuuaagacucugagcucuggaacaggccucaugcuagauugauauagggccuggcacauagaugcuuaauaaauauuagcugaaugaguauuuuguggauuuaaagaguauucaaaccacaaaacuaaccauacccuauauugucagagggaacaguguaccuuuuuuuuucuucccauuucaggaccaaaaucagccuuuuguauuuuggaucuuuacauauuuauuuauuuuuucuuuccuuuguuuuauuuuguuuugagucagagucuugcucugucgcccaagcuggagugaaguggcguuaucuuggcucauugcaaccucugccuccuggguucaagugauucucaugccucagccuccaggguagcugggacugcaggugcacaccaucacgcccagcuaauuuuuuguauuuuuggggguuuugccauguuggccagucuggucuugaacuccugagcuugggcaacccacccaaccuuggccucccaaagcgcugggauuacaggcgugagccacuguucccggccaauauuucuuucuuuuugagagucauucagucccugcaguguuuaugcugacuguccugcauauuuaggguugcuguagaauggauuuugugcuauauaaauauccguguguguguguguguguguguguguguguguguguguguguguauguaugugucuguguucucaugguuuuucuaaagaaaugucaucugcuuauuggcucuucuacuuacaggucuuuucuuuuuaaccagccuuaagaugaugcagaaugugaguccaacauccuacuccuucagcaguugacaguguuuuggcauaugugcugcccugaauacagugaucuauuucagucuguugauauaaauguggacagcuuuaauguguaggaauugaggcuaacaaaauaucuuuccauauccuggaagcaugaauuuuggagagaugaccaacuuaauagauagucuuaaguuuuguguuaucguauaauuuuaaaugcgguauuaucuuaaugcacaguuuaauagucuuaaauccugaaaauuuguauauuaucugaucuaguuagaaauugaaaauauauauuucucaagguuaccaagauuauaucuauuugaauuuaguagugauugaauggaauagguuguuaagaugaauugccacaaaauuuauauuguuguaagauauguagaacauugauuuucuucuaauauacuuaacauuguggaugauaccauccaucuaucuuucucucuauaugaacacauaauuuuguuauauauaauguuuggaaucugacacuucaucuuuccuuuucugaagaaagauuuuuuauaugucgccuuaaucauugguguuuuguuuaaucuuauaaacacaugauggauuuauuuguugguuuguugugaaacuuaagaaaaaggcaaagauaguggccucuuuggggcacccuauauuuauuacauuuauuugaaaccuuccuaguguuuucugaauuauuugugugugugaugugugugugugaacacacucaggauucagaagcugugugggaccauguauguguguccacagccuuucuuuggaauacugcuucagaaauuagagcagguaaguccaugcaugcuaucaucagcauuuaaugaugcugcuuucucuuccaagcaaacugacaaggguagaugaagguccaguuuuccgaaaugggccucagucuucugacaggguguuuuauuguaguuugcuguugucaugaggucuucauucagaugcggauauauuaaggucauuuugcuuugucugaggaucuuucuggguuuucaugguagagauugagauaugugggacaaguuugaucuuguaucagguuagaggacauguugcuugcccugcuucagagaagagccaaagcuggcaggaauagcugcaaaaguaugcugcacuuagaucuuucaauuaguaaauuagaguaagaugccucuggaagucuuccacagaguuauuuuaaacuuggggucguacugcuuguguugaauuaacucaagguucucucucaaggggcacaugaaggucuuccuccacugcuucugcuuaguucaggccuucaucuugugcuuggauuauuaucgcagccuccuuugcuuccaccaugccacauccaaaugucacauuuccaagggccugcgacccauguaggcacguaaggccccgugcguaguuuagugcucugcuguugucaucuugaaauucuucauuuuccaacaagaggaacaccuucaauuuguacuagucccuacgauuucaguagcuggucuuggcucuaggaauagcauuucuaaaacuaucuauuuaaaauuccucaaaguucacgcuccauauccugcccaucuagcaccaucucuuaguggugggcuuuucuuugacugucagugcuugaagaaguucuuccagguauaccaaagggccccacaucucugcaacauuugcuguugcuguuuccuucuucucauuuccccuacccaaccugguucacuucuauucauguuuugaaaugcugaagaaauaagguugggcugugaaaccgaauaugaccaucuuuuuuuuuuuuuuuuugagauggagucuugcucugucaccuaggcuggcgugaucuuggcucacuguaaccuccgccucuugggcucaagcucuucugccucagccuccccaguagcugggauuacagauaggcacaugccaccacacccgguaaauuuuuauauuuuuaguagagacgggguuucuccauguuggucaggcuggucucaaacuccugaccucaggugaucugcccaccuuggccucccaaagugcugggauuacaggcgugagcuacugugucuggccuaauaugaccaucuuaacucaugaucacacuuugcuuguaucauaccucuuuucaaaagguugcuaucuggugagguugggccauauuugauuuugggauaaugguucuauaauaacucuccaagaugaucauauugauuuuugcaagguaaaagaaaauucuccuaucuucaggguguucauucaugcaacauauuuuuuaaauuuuuaaauuuuaauuuaauuuaacuuaauuuuuugagacagagucucgcucugucgcccaggcuguagugcaguggugcaaucucggcucacugcaaccucugccucuuggguucaaacuauucuugugccuuagccucccaaguagcugggauuacaggcaugcaucaccauaccaagcuaauuuuuuuguauuuuuaguagggcaacgaguugcccaggcuggucucaaacuccuggccauaagugauccacccaccuuggccucccaaagcacugggauuacaggcacgaaccaucagccuggcccaugcaacacauuuuuaugggucaucuaauauaugccagacuauauuuuaagcacugaggauguggcauugaaccaacuguuuuaacuuuuccuucuuugagcuaauaauuucuaguagagggggcagaaagugaaugaacaaauaccucaauauauaauuagaucuggaguucuagaaaacaaugcaaaauacacauuuuggucuuucaccuuggaagauguguauuuguuguuuaucuaccuuaaaguuugguggaugagacuaagaauggggcucugggccuggcgugacuauugcagagugggacagcacccagguugucaguugcuccuugcaucuuuucugauagugauuguuuagaccuagaacauagauaccacacagguauuacccaagagaacugaaaacauacacucacacaauguauaugaacauucacuacagcauuauucauaauagccaaaaaguagaaacaacccaaauauccauuauauguaugaauaaaauguggcauaaccauacaaugaaauguuauuuagccauaaauaggagugaaauauggauacgugguacauugaaaacauuaagcuaagugaaagaaaacagucacagaaaacuaugauuccauuuauaagaaguguccagggaggccgggcgcgguggcucacgcuuguaaucccagcacuuugggaggcugaggcgggcggaucaugaggucaggagaucgagaccacggugaaacccuguuucuacuaaaaauacuaaaaauuagcugggcaugguggcgggcgccuguagucccagcuacucggagaggcugaggcaggagaauggugugaacccaggaggcagagcuugcagugagccgagaucgcgccacugcacuccagcgugggugacagagcgagacuccgucucaaaaaaaaaaaaaaaaaaaaagaaguguccaggguaggcaaaucuacagacagaaagauugguaguugcugggggcgagagggagaugagaagaaggagugacugcuaaugggucaggguuucuuucugaaguagugaaaguguucugaaauuagggaguggugaugguuguacaacauugagacuauacugaaagcugcugaguccuacauuuaaaaauggcagauguuauagugugugaauuaucacaauaaagcugucauaaaaaaaugcugggauuaccuucuaucugaaggugaggaucuuaugaagauuaaaugaaaugaaauaacauaaagcacuuaaagcccagugccugggacauaguaugcacuuaauuaaugguggugguuguugcucuugaaguaauacgguuuaaauaucuguaagcuggaacuuuuauuuauucacugcuacaucuccagaauaugaccuguuauggaguauguagccaauaaauauaauacuagucaaaugaauguggcuuguucacauucauguucagucacauucaccaauguggcugucuuucuuguuccgccuuuugcagcauguuagugaaucugcaucaacugggccuguguuuugagcuacuugucuagugguaguacucaagagauauggagcccuucacagcccaucuuucagugcuuaaguugggguuggggguacagacucagucuggggaggcaaggcuucuaccuaaauuaaaggugaaaguggggaggccaggcauggugucucaugccuguaaucccagcacuuugggaggcagaugugggcggaucacuugaggucaggaauuggugaccagccuggccaacauggugaaacccugucucuacuaaaaauacagaaauuaguugggcaugguggcgcacaucuauaaucccagcuacuugggaggcuggggcaggagaaucgcuugaacccgggaggcagagguugcgaugagcagagaucacacuacugcauuccagccugggugacagugagacuccauagcaaaaaaaauaaaaauaaaagaaaguggggucaaaugauucuugagccuuuuucuaguaauauaauuccgcuuuguguuuuuauuuuuauuuuuauuuuuuguuugagauggagucuugcucugucgcccagguuggagugcaguggcgugaucuuggcucacugcaagcuccgccuccuggguucacaccauucuccugccucagucucccgaguagcugggacuacaggcgccuaucaccacaccuggcuaauuuuuuguauuuuuaguagagacgggguuucaccguguuagccaggauggucuugaucuccugaccucgugauccacccaccucagccucccaaagugcugggauuacaggcgugagccaccgcgccugaccuacuuauauauuuuuuugagauggagucucgcugucgccugggcugaaaugcaguggcacgaucuuggcucacugcaaccuccgccucccagguucaagugauucuccugccucagccuccugaguagcugggauuauaggugcccgccaccuaauuuauuuuuuuauuuuuauuuuuuuugcgauagagucuugcucugucacccagugcaguggcgcagucuuggcucacugcaaccucugccuacuggauucaagcgauucuccugucucagccucccaaguagcugggauuagaggcacccaccaccacacucagcuaauuuuuguauuuuuuaguagagaugguauuucaccauguuagccaggcuggucucgaacucuugaccucaggugauccgccugccucgaccucccaaagugcugggauuacaggcgugagccaccacaccuggcucuuuguguuuuuuaaaaaacugaauuggucuguugagaaugugauucucucucuuuuuuuuuuuuuuuugagauggaguuguugcccagacuggagugcaauggcucaaucucggcucacugcaaccugcgccuccuggguucaagugauucucaugccucagccucccgaguagcugggauuacaggcaugcaccaccaugccuggcuaguuuuguauuuuuaguagagacaggguuucuccauguuggucaggcuggucucauacucccgaucucaggugaucugccugccucggcuucccaaaguguugggauuacaggcaugagccacugcgcccagcugagaaugugauucuuagcauucauuauaaguuccccagagagcagaggauuucauuugugguaaaacacauacgcgugcacacacacacacacacacacaccccacacauuuaguucuuagaaauguacagauuuaaacugauaguuuguucugcugaaccuaacucacaauuucuacauauaggaaauuaauguuuuaaaugaagauagaagcaguuuucuccugaaaguauuuaugugguuuuguuaaaacuucacauccuuuuaugaacuuggcauuccacuaacaacacucagcugcuuuuacaauugugucagcaagguuccaucugcuuauauugagguugaugaaaagaaguaaagcuguuguuguuuguauuauguggcauucuuuuuagaucacuggaacuuuuuuuccuuuggucucuguaagaaaugguugugcuucucaucuuccuuuagucuucuguacauugugugguugaucauguuccuuguuaccauaaacuguugagaggcucagugcccaauuuguggccuaccucuaggaauuauccagggcuucucuuuaucagcuuuuuuauguaccauccugcuucuugacuuuauuuucuacucuuauuuuuuucuugaccaauuuaucuuucuuucuuucuuuccugcuuucuugguuucuuucuuucuuuuuuuuuuuugagacagggucuccuccuguugcccaggcuggcauucaguagugcagucaaugagcuugagcucccugcaagugcaaacuccugggcuuaagugauccucccaccucauccucccaaaguaccagaaguacaggcacgagccacacacguggccacuguuucuuucuuccuuuuuuuggggggggggcgggaggagggguggugcuaugcuaucucaaagagcugcuuuuauaauuuuuugggagauaaauguguuaaauaagcaacagucccaccuuauugacgugaauauuuuaaaaacuuaaaacaugucuacaacuuccuaggaauuucuucccacaucaggaaggauggagagaaggcaaaacuaagaguugguaagcuuuguguuugggaaauuuucuugaauaccucuuuuuuucuugucuuuuuaauagaaguuggugagauggcaaagcaguauauagagaaaagucuuuugguuccagaccaugugaucacacgccuaaugauguccgaguuggagaacaggcguggccagcacuggcuccuugauggugaguugaaacuguggguaaaccgaauuucugggaauagucaguuaaggucuugcacacucccuuaacuucuuaccgaauggaaaaugccuuauuuucuaaacuuucugucauuuauuuaauauugcaauuuggcaacaugauaggaacccauuguggugaagccucuuauuucuucugucuccagaucaccaucaugagaaccacugacuugaagcaaauauucacuaaauuucuguuauugcuucagcccuuuuguuuccguaagccauccugaguauaacuccucuucaaucagagguucuuucauucaccacagggcacacaaaauacaauuaugaguuauuauuuuucaccugucagauuaacagagauagaagaucggaaaauccuuuauugaguauguaggaaacaaauacuguugaaaguauaaaaugagcaaccuuuguagagcaguuagcauuauauauacuuucugauccagcaguuccauucuggauuucugccuaaagaugcaaggagguuuauuucagcauuauugguaaauaagaggacauuauuacugacacuauaaaagaaucauuauauaugugguauucugaggacacaaagaagaaaauuauucuguugguaggaggagggguuggaacaacuguauggaaagugaugaauagauagaugguccucagauagaugaguggggauagggaagguagguuuuuuuuuuucagcagagggacaaugugaacagggugaaaggggaaugaguuaucuuaguauuuuuucugagccugcaagcagagguuggcagaggaaauccugggguggauagccuuugauuuugccauaaagaugguggaacuggauuuuguuggcuuuagggagcacugaagaguuguuaaguagggguauaauaugaucauauuucucucagaaagacuauucuguuagcagcacaggagagauuaggugcuggggcauggaggagaguugugacuacaaaccagagaucauuggaauaacuggacuaagggaugucgaaggccugaauuuaagcaauaauagcagugggauggaaaggaggcaccauucauaagagaguggauugaggaaaaagaauugauaggaguuguggcugauguuagguacuacagccccaggguuuucuuuuauugccuuucaggcuuuuugaguuucucagcuuucaucacccucucugcccuuaccuaggcauguuaauuucucuagacucuacuuuuaacucacagaaguuagcccuuuucuuagucuguuuucugcugcuacaacagaguacuuuggacugggcaauuuauaaagaaaagaaauuuauuucucaugguucuagaggcuggaaaguccaggagcauggugucagcaucugaugagggccuucuugcugcaucaucccauggcagaaggcaucaaauggggaagaagugcaugccucugagagggaaugggagccgaacuuauccuuuuaucaggagccuauuguuuuaucuagaacccacuucugugauaagagcauuaacucauucaugagggcagagccuuugugaccuaauuaccucuuaaaggcuccaucucccauaacauuucauugccaauuaaauuucaacaugaguuuuggaggggacauucaaaccuuagcauucugccccuacccaccucccccuccaaaacaacucguguccuucucacaugcaaaauauauucauucuauccuauuagcccccaaagucuuaacuuagcaucaacucaaaaguccaagcuaaaucagacaugggugagacuuauaaaguacaauucauccugagacaaauucccuucagcugugagccugugaaaucaaagcaagucaucuacuuccaaaaugcuaugguaggaagguguaugauggacauucccauuccaaaggaagaaauaggcaagaagaaaggggcagguggucaccgauaaguccaaaauccaacaggggagacauuaagucuuaaagauggggaauaaucucuguggacuccauauucugccuccugggcacacugggaugggaguugggcuuccagggccucagaagccccacccucuguggcuuugcuggguucaauccacucagcagcucucauggguuggaguuguauacugguggauuuacaguucugggguguugacaguggcccacucccauggcuccauuaggcauugcccuaguggggacucuggggcagccuugacccuacaguuccacugggcauuguccuaaugggggcugucugcaguggcucuguucugcaauagauuucugccugggccuaccaggggcauucauugaaaucuagguggaggaagccaugcucuguaggucuugcauucugugagaugccaccaaggcuuaucccuuucugagcagguggagccacgccugaagcuguuugaguuaugguugaggaggccaaggaaugcuauccaucuucugaaaccauucuacccuccuagaucucugggucugugaugggaggggcagucuggaagaucuccgaaaugccuuuuaggucuguuguccauugucuugauugauagcaccuggcuuccuucuagccaugcuaaucucuuuagcaauagguuguuugaccacacacuuaauauucccucuggaacaugcuuuuccacucuuuacauggccaugccgagaauuuuccaaauucuucuguuuugcuucucuuuuaacuauaugguuaucccucaguaucugcugacaguaaggggugugggaagggauugguuccaggaccacucccucauaccaaaauccaugcuuacucaagccccacggucggcccuguggaacccauggguaugaaaagucaguccuccaugugcaaggguuuugcauccugcaaauacuguaugcauuugguugcgaauguggaacccagugauauggaggcccgacuguauuuauugaaaaaauccuuggcccauguuguggcucacaccuguaaucccaacacuuugggaagcugaggugggcagaucacuugaggccaggagaccagcgugggcaacauugcaaaaccucaucucgacaaaaauuagccgggugugguggcaugugccuauaaucccagcuacuugggagcugaggugagaggaucacuuuagccugagagguugaggcagcagugaggcaugaucacaccauugcacuccagccuggaugacagagugagacccuguuucaaaagaaaagaaaaaaauguuuguauaaagugugcccucagaguucaaacccguaucuucaauggucaacuguauuugauugucucuuugcucucacauugcauuuuaugcaauuaaaaguaaccacacagcagcuugaaagcuuuacugcuuaagauacuucuuccaccacauauccuaguucauugcucuuaaguuuugcaguccauaaagcccuagggcacagacaaaauuugucaaggucuuuguaaccguauaacaagaauaaccuuuacuccaguuucuaauauguucuuuuccauuucugucugagaucucaucagaauggacuuuacuguccaauugcugcuaauaugccagucaugaccacuugaguaauuucuuuuuuuuuuugagaugaagucucugucgcccaggccagagugccauggccugaucucagcucacugcaaccuccaccucccagguucaagcaauucucuugccucagccucccaaguagcugggacuauaggcaugugccaccaugcccagcuaauuuuuguauuuuuagaagagacaggguuucaccaugguggccaggcuggucuugaacucaugaccucagaugauccgcccaccucggccucccaaaguguugggauuacaggcgugagccacaccaugccuggcccacugaguaauuucuaagaagauucagaccuucccuacagcuccccucuucuucugaguccucaucagaauugcccuugaugcaucauucauggcaaucuaggguguuacuagccgcuuccuccaaauucuucagccucuacccauuacuugguuccaaagcuaugaccgcauuuuuagguauuuguuauggaaacagccccacuccuugguauccauuuuuugucuuagucuguuuugugcugcuauaacagaacaccucagguuggguaauuuauaaagaaaauaaauuuauuucucacaguucuggaggcagggaagaguaagacgaugguucucacauuuguugggagccuucuugcuguguguuggaaggcaacacaugaugagaaggcucacacaagagagggaauaagggguuaaacuuacgcuuuuaucaggagcccacuccugagauaaccaacccauuaauucauccaugagggcagagcucucaugaccugaucaucucuuaaaggccccaccucccaauaccuuuaaauuggcaauuaaauuucaacaugaguuuuggagagaacauucaaacuauagcaccccccagugcuuuuugucuggguauucaucaugacugauaaacuuugacuuugccaccacguaacaguaauuucucuaguuuacauuuuuaaauugugagucuucucaucuugcaaaaugaauuuguauaguuuuagggaacuuaaaaaucuguguuuaaaaaggaucaucuguguuaaacuccccuggaaagaggguuagugugauaauugagagcauggacccgggugcugccagacugccugacuugaauccccgcucugccacuuucuggcagccugugugacccugggccucugguugcucaugaaacacaaauuagcaaagaggggcaaagugagcaaauauauguaaagugcuuaaaagagugcuugccuuauauaagugcuguaugaguguuugucauuauuuugugacuaguguacagguccugaaguuuuuugggugggggugacuauuugaaguguucacuucaaaaauagcucuaaaaguauuuagccaggcagaauaaaagucaguuucaguuauggaauguuuucucuaucuuuucagugcuugcuuuugccaugacuuccucucaggguugaauaacugaaguucuuugacaucauaggccuguuuuagugaaguacgucauccucccaagugauuugguuaguauuuuucuccuugaaaacccaucuggucacuuuuucaguugcgauuuuucuuuaaagcucuggaauaaauccauuuggcaagguguggagugcgagggaugccugguuccuauguucagcuuuagacuccuuauguuacacaggcacaugcucugcggaggacgugccuguugagcgugcuaaaggugauugaauguggaaaggucgaaaaaggcauucugaugacagaugacucaucaucuugguccauauggcuguagagaggcauccugcaaaugguggguggaaaugaguagaguggauccaagccaagggaaccccaaguggggauguggggaggggagggagggugaguguucugugguuuggucagcuuugcucuugcuaaaaaaaaaguucagcacuaccuucccuucacugugcuuuccaguuggguaagaaauauucuuguuuuguuuuguuuuguuagagauggagucucucucugucacccaggcuggagugcaguggcauaucuugguucacugcaaccucugccuccuggguucaagcgauucuccuuccucagccuccugaguagcugggauuacaggugcacaccaccaugccuggcuaauuuuuuguauuuuuaguagagaugggguugcaccauguuugccaggcuugucuugaacuacuggccucaagugaucugccugccucggcugcccaaagugcugggauuacaggcaugagccacugcaccuggcuaauuuuucacuuuuuuaaaaaagggucacauauuagaccguuuucacacugcugauaaagacauacccgagacuggguaauuuauacaagaaaaaggguuuaauggacuuacaguuccacguggcuugggaggccucacaaucguggcagaaggcaaggaggagcaaaucacaucguaccuggauggcagcaggcaaagagagacagcuuggcagggaaacucccauuuuuaaaacuaucagaucucaugaaacuuacugacuaucaugagaacagcacggaaaagaccagcccccauaauucaguuaccuccuaccagguucaucccaugacacgugggaauugugggagcuacaguucaaagaugagacuuggguggggacacagccaaaccacaucaggccagcagugagguauagccauagagagagauguauuaguaacuguuuuuuuucguuucuaaacuugccugcuuacuugugccuugaaauaguaaucuagaaguuccccaaaucgguucuaauuuaucuuuauguaccaagauguaguagaauuaucugccauaugauuuuagggguaacuaucaaaauauuuuaaacugguauuucaaaguuugguuuuguagaaaacaaccuuaaauuuuggaauuguaaaugaaauguaauuuaauccuuuucauugguaauaaugauaaccuuuagcacgagagucaucauuuuguccauaguuguauuuagaaccugguuuguuuguuucauucugugcaauguugaacacuaacaagugcuuucugaagguaauucuguuuuuagcauaagucagaguuguuugaaugugugcaguguuugugucuauuuucccugagagcuaaaugauuucagacuugagauguuccuggcuacgcacucacuuagagcccuugguguagguguaugaucagaaacuaaacuauagaugcuggagccagaguauuuugccuugauuuugcgaauguguuuuaccauacgaggcuaguacauaacaacucugaccuuauccucuccacauuuuuccuucugauucagaccucugaggagugucacaucccacugggcgacauaugucuauagaaaaaagccaacaguaucuucugaaucacaucuuuuaggaaaugccaaggguaauuuuuuuucuucuguugcccuugugagucuaggguaucuuucaagaauaaaguguauaauagauuuguuuagaagguuacugaagaauucugcuuucauaauuaaaaaaacagcuuuuucuuccuguguguauguguuuauguguaggagggcaguaguuuaucuuagucauuuaucuuuaaauauuuagccgugaaaaaucauagccacauaacccuucuaucucagguuguuacuaaggcagugauguauauucugguaucuugaauggaaaguuuaaagcaauuguggugauuucuaaagaaugaagaauaguuguaaaauuuguggagcucuacuagggugcuguggccaucuaugccugccaaauguggauugcacaauuaaaauguuugguuccucacugggauuguucuucuugacauaaccaugauuugccccucucauuguagcucuguucauucaguaagcauuauuauaucuaauggguccugaauauuucuaaagugaauaaagugcaaguaugacuaacuuugcacuaggcuggugacagugaagaagaauguguggaaaagaaggauuagagguagacuaagcuugucagggagcuccugacauaggaggguucagagacauauauucagccacacaugguacaggugagguguuccaagagguaaguggaaugauuuuugcaaguaaggaguggcauuuuuggucaaaaugauugcaugaaaaaagauggguguguguuuagauuagucuuagcgcuacauuuuuggaaacucuauccaugccccaagacaauguaaauaugccugacaguuuuuuuuuuuucaucauccaaaauucugauuugaggagacaguugggugugguagcuuaugcuuguaaucccagcaguuugggagacagaggcaggaggaucacuugagcccaggaguuugagaccagccugggcaacacgaugaaagcccucucuacaaaaauauagaaaaauuaccugggcaugguggugcaugccugucuauacucacagcuugucagaggcugaggugggaggaucaccugagccugaaccuggggaggucaaagcugcagugagccgagauugugccacugcacuccagccugggcaacagagcgagacuccgccucaaaaaaaaaaaaaaaaaagaauuugggcagugacccuuagaugaauguuauuuucuuuguuggcauuuuccccccuggacuuugaagguagaguuugaucaaggcauuucuuuacuguguguuugcaugaaggaucagcaguuauuuguugaguuugguuugcauaaaaaaauuauuuuugggcugggugcgguggcucacgccuguaaucccagcacuuugggaggccgaggugggcgagucacgaggucaggaguucgagaccagccuggccaacauggugaaaccccaucuuuauuaaaaauacaaaaaauuagcugugcgugguggugggcgcuuguagucccagcuacucgggaggcuaaggcaggagaaucgcuugaaccugggaggcggagguugcagugagccgagaucgugcuacuguacuuuagcccaggugacagugcaguagcccaggcgacuccaucucaaaaaagaaaaaaaaaauuuguaaccagauaacuguaacaguguuccccugaaugcugugucuuuaaguuuguguuguaaaguagguuugacaauuuuuaucauguuagaagaaagaauuguaaaacccaagaccuauguuugauuauauagcuugaguaucucuuauccagaaugcucgggaccagaaguauuuuggauuucagauuuuuuggauuuuagaaugucugccuuauacuuacugguuggguaucucuaauccaaaaaaaugcaaaaucugagaugcuccaauaggcauuuucuuugaggaucaaguuggcacucaaaauuuuggauuuuggagcauuucagauuucagauuuuccuauuagagauacucguacuuucuaacaugauaaguauuuggauauucucaaauaaaauaauuuguagacauauaauuaauuucaaguuaaauagugcacuaagagagaccacaugacugcuagaagaagaugggcaauaagaagaaaguguaucuacuucacauaagacuagguaacagguuuuuguuuuguuuuguuuuguuuuguuuugucagaauuuuguuuuugcugcccaggcuggagugcaauggugcgaucuuggcucacugcaaccucugcgucacgggcuccggugauucuccugcuucagccuccugaguagcugggauuauaggugccugccacuaugccuggcuaauuuuuuguauuuuuaguagagacgggguuucacucuguuggccaggcuggucucaaacuccugaccucaggugaucugcccaccucagccucccaaagugcugugauuacaggcgugagccaccgugcccggucuagguaacaguuuucuaaacagaguaauacugguugaauuacacaggaaauaccacuauucagugggguuaaguuaugaagagacauuugggugacaugugaccugaaauuuuagcacacugccaucuucuuacacacuuuauccaaaguacacagccugaucagacuuuguaucuagcugcugauugcacugaagcuauugcaacuccuuuguuaaugcucccaggugaucgcaugcauuucuucuggugcuaagcauucauaauuuucgauaaguauuuauugaucagcagcugugugccagacaccacaguagagcaacaaagagacuagguggggccuggcucuccugauacucagaauccagugguguuuucagcuggguuuuguuuuuuuuuuuugagacggagucucgcucugucccaggcugagugcaauggcgcgaucuuggcucacugcaaccuccaccucuuggguucaagcgauucuccugccucagccucccaaguagcugggacuacaggcagugccaccacgcccagcuaauuuuuguauguuuaguagagacgggguuucgccauguuggccaggauagucuccaucucuugaccucgugaucugcccaccucggccucccaaagugcugggauuacaggugugagccaccaggcccagccaguuuucagcuuuuuugcuacccuaggcagugaggguuaucuuuaauuucuuuaauuuaaaucaaaacccugauaacucacuuuuucucuuagugacuuuuccuacguucugcacccuugcugucaauaugagcucagaguagcugacugaaaaacaugauaaagccuuggaucucuucucuuucucauuuguuauagauucuguccugcguucguguccuccauguccauuuccaguguuuuucuucugauugaacugacugcugcuuuggggugaggaacaguuguaccacaguauaguagacaaugguggcuuaucuuaugugugucucagagauugacuagauuuuaacauuaaggaacauuaaggggacaauauggaaaacauauguauacacauauuugacuggacccuagcaaagcuugguucauggaucaauaaacaaauugaguauacauuuuuugugucuugauaagcuaggcauccgucauucccaagagggaguagcaugcuuccugaccucauaguccaggagugccgcacaaaugguugcagaauagguagggucuugggagcaccagugaagagagagugaaaggugauggcuggcgcagagagggaaguaacugacccucuuuugaaggugagggaggcagguauuaggaaggcuuccuggagaagcugacacccagaaccauaauuggaaggugggaaugaagcacauuuuagagggagggaagaucacauggaaaagcucuagagguaugaaacaacaugguguauucuggaaaccacaaguaguuggguaacccuggagcuaaaaauaugagcagaugaggcuggacaaguggacaggggcaaaaguuaaccuuucaugaaauuuagaaacagggaguugaguaagcaucaaaguuaauauuaaaaaugagggggaguuaaaaguaaaauuuaaaacuuugaguuuaaaagugugaacaacauauuuuuaaacucuacuuccaacauuuaaaaauuaacuggauuggccgggcgugguggcucacgcuuguaauccuagcaauuuaggaggcugagauggguggaucacaaggucaggagauugagaccguccuggcuaacacggugagaccccaccucuacuaaaaauacgaaaaauuagccgggcgugguugcaggcgccuguaguuccagcuacucaggagacugaggcaggagaauagcacaaacccaggaggcagagcuugcagugagcugagaucgcgccacugcacuccagccugggcaacugagugagacuccgucucaaaaauaaaauaaaauaaaauaaaaauuaacuggauuauuaaccuuuuaaauuuagaucuacauuugacauuaaacugugguuucucuguauuugggugugucuugacuuacauguucagaugcaccuagcccauuugccauugcugcuuaauuagaaguugauaaaguaagguacaggaugaaauacuucaacuccuaaguuuagguguuaggagaaccugcuucccuaauuuaugaaacagguaauucauccaguuccugggaauuggaugaauuaagaaaauucauuacaaagcaucauucaaggcauuugagggcauacuuugcuaauugcuaauuuaauaauaauuauugugcacuuacaaugcacaaaccaugaugcuaagaagacauuaacaugauagaaaaagcauggguuuaugaaucagaccugaauaucagucuguaacuuacaagcugcuguguagucuuuuuuuuuuuuuuuuuuuuuuuaagaugggguugugcucugucacccagacuggaguguaguggcaccaucauagcucacugcagccucaaacuggguucaagugauugauccucccaucucagcucccugaguagcugagacuacagaugcaggccacuacgccuggccaauuuuaaaacuuguuguagaaaugggauuuugcuauguugcccaggcuagucuugaacuccuauccucaagcaauccuccugucucagccccucagagugcugagauuacagucaugagccacugugccgaguuguauagucuugagcaagcaaaguuuucuuucuuggauucuuuuucuucauccaugaaauuagcacguucauggcauagguuugugaggauugacuaacaaauguaaaacucuuaguggaguucuggaaaauaggucaucaaaugguagacauuugauauuauuauuuauuauaauugauuuuaagcuccaauagaaauaccuugauacuuacauagauguuaggacuuaacauuucaauaauaacuuacugagaaacuucacaaaaaauacugucauucuaaugaauaaggaucaacauauucaccccucauaaagcacauuugggcaaagcauaaaaccaccccucuuggccuggcgcgauggcucacaucuguaaucccagcacuuuuggaggacgagguggguggaucacuugagaucaggaguucaagaccagccugaccaauauggugaaaccccaucucuacuaaaaauacaaaaauuagccaggcgugguggugugcaccuguaaucccagcuacuugggagggcugaggcaggagaauugcuugaaccugggaggcggagguugcagugagcugagaccgugccauugcacuccagccugggcaaugagagugaaauuccaucucaaagaaaaaaaaaaucaccccuccuccauuaaaccuuguguaguaauguaaaacaaaacaauguaaaacucuugauuguccugucaccaguaagagaacccagauuuuggagagauggacagguugauuagggcuaaagggagaaugagauguggaaaacugcagagaauuuaauuuuaucuuuuucuguaauacaugaucacuauaaaacauccaagccauauggaaaaaugcaacggaaagcaacaaaucaccugaaauuccaccagccagaaacaaccagggugaacaguugaaaagcaucauucuagauaccucucugugcgcauauguagauggaaauguguaagaaggcaucagacuuuauaugcuuuaaaaaaguauuuaaucuuacugaauuuuuuuuuuuuuuugacauggagucucgcugugucgcccaggcuggagugcaguggcacaaucucugcuaacugcaaccuccaccuccuggguucaagcgauucuccugccucagccucccaaguagugggauuacaggcacgcaccaccgugacuggcuaauuuuuuacauuuuugauagagacaggguuucaccauauugggcaggcuggucucaaacuacugaccucaagugacccacccgcuuuggccucccaaagugcuggaauuccaggcgugagccaccauaccuagccuuaauuuuacucaaauuuaacaguaacaaaacuaaagugaaccugaaggaguuauuacggagcuucagauaaaucuuuguucaucaccaaggauauuaauuccugugagagcucuucaacauuauaaaagccacugggagacugacauauuuguuuucuuuuguuuuaaauucacauuucaaauuuagacaggaggcauugucuccacagugaacccugagggaacuuauacuuccuuuaaccuccucuuacccuucaucucucccaguuuuuguuggcuuuugucauuaaaaauuuauuacaguuuucuucugcaaauguaauuccucaguuucuuacauuaaaaaaauuuaggugaauucugugcacugguucuuuuacccaccucuacucauuuuauuuugauuaaucucuugguuauaucucugugaauauacuagaaaucauugaaauguacacuuuaaaugaauuaauuguaugguacgugaacuguaucugaguaaaggugcacugcuguuuaacacagcuuuuucauucaacacuggguugacuggauuuugcuggauauuuuuuucgucccucccuccucuccccucccugcagaagagcucauaauauguuugagaaugucuaauuuuuuaaaauuagcuaacugauauuuuugaguuguucuugugucuuucaaaacauugcaaccauuguuacauuuucuucuggccugguuccccauuuuauuuuauuuuuauuuguuaaauagagacaggucuugcucuggcacccaggcaagagugcgauggugcagucguguuaauagcuugcugcacucucaaacuccuggauccucccgccucagccucccaaguagcuaggacuacagguguaugcugcugugcccagcuaguuuuuuauuuuuuguuuagacagggucuugcuauguugcccaggcuggucuugaacucuuaggcucaagcaaucuuccugccucagcucuccaaaguacuuggauuuacaggcgugagccacuaugcacagcccuuuuccaccuguuucaaggugauuuuuuuucaccccguauagacuuucuaaagaguuauuucuucauacuugaagucaguagaauaacuugauguuguuguuauuuauuuauguccuauauagaguguauccuccugaucugcaauucaguucuuuccuuucagggaaguuuuccuguguuauauccuuuuugucauuuguucagauuucuauuucaauaauacuaguuauauuggauauucuauugacuauuuuuugucuuuauacuuuaaauuuuucuugcuucuguguuuccuucuacuuucaggcacacucauaucuuuuauuuugagggcaggagagaaugaaacuuuguuuauauuccauaacuguuugauuauuuuucaaccuguaugugccaugcaccugugcugugggcccuugcacuuacuguucccucuaccggcagugcccugucuccagauauccguguggaucgcuggauacagaucccuacacagauaacccuuccucagaaggucugucuuguaccauucugucuaccuacgucacucuccuuacauuauuauaaugugacauuauguauuuaugagcauauucgauuuuccauuccuccccuaucccuccacccccagugcaggccccagaaagcacagguuauauccauuuuguucauggcuauauugccaguaccuauaacagugcuuggcauauaguaaagacuuguacauccaguugcagacaggucaugccugcaaucuguagcugagccuuuagaagguauacuugaauucuguuacuuuucuggggauaaaaauaugggccuauggugaaaucauuuacaaauuucuuuagucuuaauugagauacagugggaccgguuuuccccuaauuuguguauggggacuuauauucaaagaacaagcaagcaggccggacgcgguggcuugugccuauaaucccagcacuuugagaggccaaagaggagaaucacuugaguccagccugguuaacaaagccagaccccaucugcgugugcgugugugcacgugcgugcgcacacacacaaacacacacacacaaaaccaauguccagguguggcgauguuugcuuguaguccagcuacuugggugggggguggcugaggcaagaggaacccuuaagcccaggaguuagagauugcagugagcuaugaucgcaucacugcccuccuuccugggugacagcgagacccugucucaaacaaaacaaaagaaacaaaccacgcagaauucuuaaacagaagaggcuuuaagcaagggguuuguagaugacagcuccuuccucaauggaauaugcauuuucccuuaugggaaaagggcucagugauuuuaguauaacuuacuuaagaacaaggguuauaagguaacaguuuuaucugugucuuuauucaggaaaaauccucgcgaugaucccagaggaucucagugaagccauuugggaauuuccccaagaauuccuaccugaaaggaauuuaucuuuuauuucccuaagccucuuugaagaugcacacuugugguuuaaaaccaaauuuucuggaguacuuaucuucugcuuaucaguggaucaccaaguagugauuguagcauaucuagguuuuuaaagucuuuuucuuuuucuuucuuuuccuuccuccucccuuccucccuaccucccuucuugccucuaucuugcccugucacccacgcuggagugcaguggcacgaucacagcucacugcauccucagucccuugggcacaagaaguccucccaucucagcuuuggggucuuuuucuauuaaccuauaagcuuccugagggcaggacccacuuauuucaaaucucuuaaacccugggaucuauaacuagugucccaggaagcugccaugagcaggaaguggguucuagagcucucagcacuguggggaguguggggcucacagagugguaggaggaagcauaaacuucaguugcugacaucuggagcacagcugcuguuuuuuuuuuuuuuuuccuucuacuuucauuuuagguuuaggggauacaugugcagguucguuacacggguaaauuucguguacagaugauccugucaccaagguagcguaguaccugauagguagcuuuccaaccugcacccugguccugguucaagcagucccuguugucugcugugcccaccuuugugcccauguguauucaaugauuagcuaccccuuauaagugagaacacaugguauuugguuuucuggucuugaguuaguucucuuaggcuaauggccuccagcugcauccauguugcuacaagggacaugaucucauucuuauuacggcugcauaguauuccaugguauauggaauauauaccacauuucuuuauccaguccaucauugauggguaucuuggaugauuccauguuuuugcuauggugaauaguacugugaugaacauacaaguacaugugucuuuuugguagaacaauuuauuuuccuuuggguguauacccaauaauaguuuugcugauagucguaaguucuuugggaaaucuccacagugcuuuccacaguggcugcacuaauuuacauucccacuagcaguguguaaguguuccuguuucucugcaaccuugcuggcauuuguuguuuuuuuacuuuuucguaguaggacagcugcugcuucuuuucaccaucuguuaauaauaacuggaugacauggaauauggaggucuuugauacauguacaaauaaacauuguguaaacagauaaggaaaguauacgauaggagagagaaaaggccuuuaugaagcagguuuuggugguaauuaauuugcuacuaaggcuuccaguuggugaugugagugauuugaacuccugggcuagggaaggcuguggaagaauaaccaaccaccugcuuucaacuuuaagcuaaucaucagugauugauugucaugaacaauggcuugcauuuguaacuugguucuuacuuauucaacaacugggaagagaugggcgguccgaagcaacuauguuagcuccagaucuuaauggagguaggaagggggcugaugucgcauagccuuuucacaagcugccaaacccaggcggauguuggaaguugcccuucugaacugcccuuucauuuccaucaggcggagggcuugcuuugcugccugggaacguggugguggacucuggcucugcacccuuccugcagagugaaugcgcuccaaauuagaaaaacagaaguguccuacuuucuauuccccaccacugccucagcuuguugccgcagcaccuccugcuucagcugcccuuccuuggguucuuggcauggcugggaggagcaggugccaaggcccaguggccagcacugcugggaacacaauaccagucaggaauuuaaugauaucucacugcacuuaguaaauauuuuguggggggggucuuaaaaaaaacaaccuguagaugucauaauuagugauauaacaagacagauucuggaagaaauuuaaaaauauaaaauuucagcuuucaaucuggauuggcuguuugaaugaaaagagugagcagcuuuucuaggcuugguuaggggaugagggauagcgauagucugguguggaagcaugauaaagcaugcgguggaacagacccucugaggagcuaaagggaggaaagcaagcaguccaugcuuaaacaugaucuuuauuuuacguuagcucuuggcauuucuacuucuucaacaauuaauggaauauauucacauuuggaaugggcuaauuaaggaaccuagaauaacgcuagucagucauuuagaaagccuuucuuggaguguuacuuuuaguaaauguaaaagcauacuucaacuuguaauucucucuaaauggaaaaauuauaaaugcugccaccuguugacaaaauuugagggugcauucuacuccaguuggucagugaucccugccgacaggggaucuuacuggcuggauaaugacccucagcuaaaaaugcuuuaaaaugugcuggucugacuguaccuuaucugacauucuguucuuggcggcugauuggugugagaaguacaccugaauugcuuugauuuguuuagcccaacuugagacacagauguagaucaauuuaaagaaugcugaagcucccaugcuaccuuauagaauccaucauuuaagacaccauuucauauuguaugcccugaagccuuaaaguggaucuguggcugaaaaguauguuuuucuuuuucuuuuuuuucuuuuuuugagauaagagucuugcucugucacccaggcuggagugcaguggcaugaacauggcucacugcagccuuggccuccuggacucaagcgauccuccugccucagccuccugaguagcugggacuaaaggcauauaccaccaugccuggcuaauuuuaaauuauuuuguagagacaggaucucacuuuguugcccaggcuggucucaaaauccugggcucaagugaaauccucucaaaaugcugggacuguagguguugaccauucuucucggcugaguauccauauuuuaaaagucuuguagaugaauaaauacuacuacuuacuugguagagcacuugcccuuaugucuaaccagagugagagagagccccuuuucaggaccugugacacagcaccccaaacuuuggaggcagccuuagccuauccccagggccucugugaccauugcugggucuaggacaccacacucgcccugaaaguggcacucuuugaggccagucacuuccaacucugccuuucauuucugagaggaagguaagccauccuccuguucuccuuucuuuuauauccgcuucgguuucuuuauuauugauuccccuccucaccguacccucuggaauccuuuuuccuuaacaguuucccccacccuccucgccacauacacaugcuauuugcagaagucuccacuuucuguauuaaagaaaaccuagauuuccccuuaggaugcuacuuucuuucuugucuuuucuguuaccgaggacuuucuccuaugugaaaaucucauguugggugauggugguggugguauuauuauucugucuccuagugugucuuucauccuuuucuaaaagcucaaaucuaucuuuauccuucauaucuuucuucucaaaccugcuguuugucuuuuuaccuccagucccacauugccuucauuuuuucccaguaccguccgcccccugccaugcaauuuauccugagccagccacuauucuggaauuuacauauaguaauuugcuuauuucucacaaugacuuuaugaauuagguauuacuauuuucauaggcacagagagguuaagcaaccagggucacaaguaaguggcuuagcuggaccucaaacauaggcagcuugccucuggaucuauauuccugugaaucaacuuuuccuuagucauguguuucaggucaugugcaaagaugcucauugcaguaugacuggaaacaacuuggauguccaccauuaggggauugguuaaauuaugcucuaucuaaaccaugcuguacucugcaguuauuaaagagaaugauucccagcacuuugggaagcugaggcaacaggauuguuugaggccaggaguucaagaccagccuagggcacaaaccaagacccugucucugcagaagagaaugagacaguaauauguaauaugaagaaaaaaaucuccaaagagaaaaagcaagaugcagaacauuuguuguguguauguggggagaaaaucuggucugugcguguagcacuggaucaggcgguuccugaagccauacaagauuuagauuucucaagucguuuuguaagcugccugucagagacaucaggaucaggcauuucucccugucugagaauuugcuucucacagucugcaguuuucuguucaggaggaagacagcauggugugguacauggcgugugauuguagagacaaauagcacuugauuuaaagcuagauuagucacuuaucaugugaucuugagcaagucacuucacuuuucccagcauugguuuuuacaguuuuaaaauggggauaaggccuaccugacagaauuauuguuacuuuugagauaauauuuacucauucaacaaauauuuucauucggcacuuacugugugcaaagcacgcuuacagcacuaagguuauagcaguaaacaagaacuuaaaauguucuacucuaauuuaguuuacuucugguaggaauagaaacacuuaaaaaauaagguaaaucauauauggcaaauggugaugaauauucugaaggaaaacaaaaagaaaauaaagggugaauaggaguguuggcgugugguagaggugcaguuuaacaggacaguuagaaaagucuuaacaaggcaccacuggagccaagauuuggaagagcugaggauacacauggguaucuggagcaaaagcagagggaauaugaacugugaauguccagggugggcaccugcuugagagcugcaaggaugccgguauggcuggcacggagacguggacagagaaaugaggugagagagguggcaggacaggggcccagauggguaggccuuugcaagccuguacaauuuuggcuuuuccucugcauguaauauaucuggcacauaagggaugcucuacaaaugguaacuguguuauaaggaugccaccaugaugcccugcuuuuuagguagguagaagaaagauagacaggguaacauuuuaggauucuuuuuuuuuuuugagacaggguuucccugugucucccaggcuggaauucaguggcgcgaucucagugcacugcaaccucugccuccugggcucaggugaucuucccaccuuaaucucccaaagugcugggaugagccacugugcucagccuaggauccacccaugcucacccacccaacuuuuuauuuuauuuuauuuuauuuugagacaggaucuuggucugucaccuaggcuguagugcaguggcacagucacagcucacugcagccucaaccugcugggcuuaugcaauccuucuaccucagccucccaaguagcugggacuacagacgggcacuaccacgcccaccuaauuuuuguacuuuuuguagagaugaggucucacuauguugcccaggcuggaggauucuuuuuaacaauuacuuuuuauaugccugauacagcagcaucguugcauagaaagagagaacacuuuagcagaaaucuaaggaccagaugucauaugcauugugcuguuggcuuucacugaauccaagcuuaauuaaacugaggcuaauaacuucucuauccaccucauaggguuaaugagaagaguaagagguaaguaaauuuauagaaaugcuuugugaacaguuuaguauaugugaagcauaaaggcuauguuugcugaguugcagacuuggaagccauguaguccagcuccuuccaaggcacaguugucuugucuuugugaaugcuucuagaaaagggcacucacuacagaaaauaccacaaagcugccacuuuucuugauuuggauccuuaguuacaguuaacacagccugcacgugcacuaguuccuuggaaguuauaccauguugcuaccucaagguacacuuguauuaucaacagcuuaagagugagucuuuguguugaauuuauccaucuguaacccaaaugaaaccucaccgugauaagguauugaaccagaucaggaaaguagauuaaggagcuuuacuauuaaagagucagguaggugaugaaaggggcaaacugaaaaccaguggaaggaggcuuauggaaguaguggcuguguugugcccagguucugugcugugcugggguugagcucccugugacucaugacuaccugugcugagcuguaacugccacagagagcaccagggacuccccaagcucuuagaaaaaacccagaaaaggaauuaaauguggguggaugagggccuuucuuuccugcugcugcguuuuuauugaauugggaaaugagcugagcuccuaggugagcucuaccaagagcagcagcaaccguuuauuaaucagcacacucuccaugugcccagcacuuugcaucuuauacauuugacagggauugucacuuuuaauccucaaacugcccugugcaguaggcauuacccuuugucaugggcugaguuguggguguguccucugaccccgaauuccuguguugaagcccuaacugcccccccaguaccucagauugugacuauauuuagagagaaggucuguaaagaggugauuaacuucaaaugaggucauuagggugggccccaauccaaucugacuggcguccuuauaagaaaaggacauuuggacguggauacauagagugaagaccaugugaaggcagcaggagagacagccaucuaugaaucaauuagaggccucugaaggagcaaacccugcugauaccuuggucuuggacuuauagcuuccaggauuguuuaagccacccagucuguggcagcccuagcaaacuaaugugcccucauuuuuguuguuguuguuguuuguuuguuuguuuguuuugagauggagucccucucuguugcccaggcuggaguguaguggcacgaucucggcucacuacaacuuccaccuccggguucaagugauucuccugccucagccuccugaguagcugagauuacaggcgugggccaccaugccuggcuuauuuuuguauuuuuaguagagaugggguuuugccauguuggccaggcuggucuugaacuccugaccgcaagugauccacccgucuuggccucccagagugcuaggauuacaggcgugagccacugugcccggccccuuguuucauaucugaugaaacuaaggaucugagaguagaugaaacuaaggaucugagaguauaugaaacuugccaaaguucucacaguuacggcuagguaaagucccgggauuaaauccaggugcgucugauuacagguagagauaaaucuaggcauuaaauccaggugugucuguucccaaagcuugugcuuauaccuaauguguuauugaguccugaaugugucuaccuuaaggcuauuucuccucacuuuugaaauagugaguggcacccagaucuuugacuuauuucugguccauuguucuuacuaauauaccaugcuugccuccccugccaccacuuuccuuagagguaagauacugcacaaguacaugagagccucuggagaagaaugucacaaacaggugacuaaguuagggaguucguaaaucuggaaagauuugcauguguuugggacuuuccuucccagcucacuucugaugaagugagauagaggcgacuuguucuucaaagugguuuguuaccuacuuagaaguagaguuaagccugacagaaaaauggggcagauaaguguuuagugucauacuugcacuguugcugucacugagaaguuuggugguucgucaugaaucgggguaaauauuagaaauacccaaguccugcucucacuccuagauguucuacucuaggaaagucugggacaggaucugagcauccaucaucauugauuuuuuuucuuuucuuuucuuuucuuucuuucuuucuuuuuuuuuuguuugaggcggagucuugcucugucaccaggcuggagugcaguggcacgaucucuacucacugcaaucuccgccucccggguuucauugauucuccugccuuagccuccugauuagcugggauuacaggcgccugccaccaugcccggcuaauuuuuauauuuuuaguagagaugggguuucaccaaguuggccaggauggucuugaucucuugaucucaggucauucacccgccucggccucccaaagugcugggauuacaggcgugagccaccauguccgacccugauuuuuucuuuugagucuuccuuggugauuuugaugugcucaucaaauggagaacccuugaaguuguggaaugguuuauuucuauaguuguuccuucuaaaccagcuuuagguaccuguugcuuguagucuaaaucacuggaauuaauuaucaucuguggucuuuagcaggucugaaugugagaguccaguagguagcaggugcuauccaacauguuuuugaaauuuuucuugcugaguucagccuauuuuguacacuuugcauuuuacuccuccagagggcucuagagcucagcugagcagacuggcuuguuacccucauuagacaaagaaacuagccaauaagauuugagcuuuuauuuguuggaggaacuaauguuauguuaucuuuuagagcuuccuguucuuuucuuuucuagugcuucccccgcucccagcucucaaccucuauccgauauaaagacuguuuucuugucaaggucacaguuagugaugcuagaacacaaggcagagacuguggcuaagcuuucaggucuuagaagagggaucucuaaaauucuuuguuuacauuuaucagugagaagguugaauuuacaucuucaauauauggauaauuauguauaaauuauuuauuuacccaugcaguuucacuaaugugauugcagugcuuuuuuuuuuuuagacagucuuacucugucacccaggcuggagugcagugguacaaucucagcucacuguaaccucugccucccagguucaagcaauucucguaccucagccucccuaguggcugggauuacaggcaugcgccaccaggcccagcuaauuuuuguauuuuuaguagacauggaguuuugccaggcuggucucgaacuccuagccucaagugauccaccggccugggcuucccaaagugcugggauuacaggcaugagccaucaugcccggccacuaauacgacauucuuuuaaaagaaugagccaagcccucccugccucccgcuuccccaaaguucaaauauuuucuuucuguacuucagugaagauaacuuuggaagccacugcuuuagaaaaugcuuuucauugauguggcagagguuugcggggaaagaguuuauagaugaucuugagguuguuugggcuguagguaccuuucuuuuuuuuucuuuuuucuuucuuucucuuucucucugucuuccuuuucuuucuuuucuucuuuuuuuuuucuuuuugagacaggagcucacuaucucacucugucacccaggcuggagugcaguagugugauuguagcucacugcagccuugaacuccuugggcucaaguaauccucccaccucagcuucccaaguaccuguaacuacaggcaugcaucaccaguaaaagcaauuuuuuaauuuuuauuuuugguagagauggguucucucuacauugcccaggcuggccuugaauuccuggccucaagugaucccacugccucggccuccuaaaguguugagauuacaggugugagcgacugugccuggccuugcaggcaacuuuuuauuccaauugccaucuugacauuguagugaagagugaguuguccagggaaaggcagaaccugacagucauugagaggggacuuuauguggauggcucacaggcaguaaggaaggcuuuggaggaagcauuggagaguuagcaagcaauagguaccugaagcaguggcguggguggauuuugucacauucaacucagugagcacucaaaucagcuuggcauucacacagacuuagggguuucaaugcagugcugcauauucauguuugagccaccaacuuccugcaguaaggaaaggaauucuuugaauuguaagugcuacagggccaugaauacccauuuuuaaguugucaucuugauacuuccaauuuugaaaggguagagaugggcugguauccuuaucugaauggauuuaaaguuucucuucuggauguugcaucuuuuauuauacuuucagcucuucaucuaccugguucuuuaacuaggauauaaagacauuuuuuuagaaaaugauaguagauccagcaagauuuuugucagagcagauaaacuggagugauuuguuuaggaaaaaguuaccacuguguagccccaccagagccaaaccuggaguuacauuuaaacaggucaaucucugaagaaaaguguaauuuggggucauaugaccuaacuccugaggucacccagagcuuauacuuaaaucagaaaaggaagagaugcccaugagcccaaauuuuaauuuuguuauuuccacacauuuagaaaaguaggaagaauaaguuuugcauuaucccaauagauuuaaaaacucuaguuccuuuuaaaaucuuuaaauagacuuaaaacaauuucaaauuuuuuccagcuuuaucgcgguauacuugacaaguaaguguauauauuuaagguguacaaugugaugcuuugauacauacagugugaaaugauuaccacaguuagguuuaauaauuaacauauccaucaucucacauagguaugauuucuuauguguguggcgagaauccugaaaaucaacucugagcacauuucaaguguacaauacaguauuuaugauagucaccaugcuguuaaucagauugccuaccuugguuaaagugcagacucaggugaaggucuggauggaggaucauacuuuaauugauuuagacucuaaaauaaauguauauaguuauuuuugcuaaccuaagaaccuacucauaaauggcuaguguuaaaaugauguaagauaaaaugcuuucccuucacuuuuuuaacagaaguggaaauggaggugauguaacuugccugaggugacacagguaguuaagagcagagaaaggacuagagccaggacugguuuagugauuuuuaguuuagcgcauuuuaaauuuuuaucauaugauuccuuaaucuuugagucuuccaaaugcagaagcuagguuauagaauagcauauuuuauuuuaauauuacauuuauggagguagauauucuugguuaaagcucauuuuuaaaaaauaauuucaacuuuuagauucagaggauacaugugcagguuugugacauggauuuauuauguggugcuaagguuugggaugcaaaugaucccaucacccagauaguguaaagcuccuuuuagaaugguauaugcagauuuaauucugucacugaaaauguuucaagaacuaauuggaacugggcaauagcuugcauuucacuuguuuuguucuuugcauuuagguuuuccuaggacauuaggacaagccgaagcccuggacaaaaucugugaaguggaucuagugaucaguuugaauauuccauuugaaacacuuaaagaucgucucagccgccguuggauucacccuccuagcggaaggguauauaaccuggacuucaauccaccucauguacauguaagaauauacaaagugcuuucacaaccugacaagaaaaagacaaacaauuuccauugaaaaguggagaaaaggauaugaguagaccauucaaaaaagaacaaaucuacaugaccaaaaaacauuuuuuaaauguucaaauguaguugucagggaagggacauuuaaguauuuaaauaggauaucacuuuggaucuauuggacuggcaaaaucaaaauauaaaaauuuuuaauuuuauauuuauuacugauaaauauauguauacaauguauauaauuauauuuauuuuauuuaaaaaauaaaacuaaaagucuauugcuggugggaucuggggaaaauaauacucccuuuuuuuguuagcugaaguauuacuagccucuuuuuaaagcaacauaacaauguacauucagaauuuuaaguaaauaauuuaauucaggcuacuuuuaagagaauagcuguggaaauggaagcauuagcagguuaggucauguauagguugaugcuuguuucaauguugcuguagugggcaaaaaacaaaaccaaaaaaaucucaaaaaagcaaaugaauguccaucuguaguggaaugguuaaauacauuggagaauauuuauaccaucuuggaauauaauauagucaguaaaaagaaugaauuagcacuacuuaaaaauuaauauacuugauuuuuagauaagcuuuagguuuacauaaaaauuaaauggaaaauccccucccucacccuagcuucuucauuauuagcauuuugcauuaguguaguacauuuguuacaguuaauaaacuaauauagaaaaguuauuaacuaaaauucauaguuugcauugacguuuucguuuuuuauagucuauggauuuucacaaaugcacaaugacaugacauuuuuccaucauuacugcauuauacagaauaguuucauggucuuauaauuuauauuuccugugcucuaccuauuaauuccucccugauuuucgccaaacuucugaaaacuacagaucuuuuuacuguccuuauaauuuugccuucuauagaaugucauaucguuggaaucauauaguauaucuacuuaucagacuuggcuccuuucacuuagugauaugcacuacacauucuguguuuuuuggaggcuugguagcucauuuauuuuuguaagugaauaauguuccauuguauggauguaccacaguuuauucguuuugaagaacaucuugguuccaugucuuggcauuuaugaauaaagcugcuccaaauauucacgugcagaguuuugugcaaaauguaaguuuucaacuauuuuggguaaagaccaaggaguguaauugcuggauuguaaguguauauuuuagcuuugugaguaacuggcaaauugucuuccaaacugguuauuugauuuugcauuuccaccagcaauaaauguuucuauuucuccauaucaucaccaguauuuaguguaguaaguguuuuagauuucagccguucugcuaggugagcauuauaguuuuuugacauggagaaaucuucugaaaguguuuuucuuuuuuauuuucuuuucugagauggagucucgcuccaucacccaggcuggagugcaguggcgugaucucagcucacugcaacguccgccuccuggguucaagugauuuuucugccucagccuccugaguagcugggauuacaggcaugugccagcaugccuggcuaguuuuuguauuuuuaguaaagacaggguuucacuaugcuagccaggcuggucucgaaccccugaucucaagugauccaccugccuuggccucccaaagugcugagaugacagguacgagccacugcgcauggcccugaaaguauuuuucaaugagaagugcaaacagcagaaugaucccauuuuuguaaaacagggacuacaccucuuuauguauaucuguuugugugugugagugugugaucuauagcuuuauaagaucagggagaaagucaugagggcuguauccugggcuggaacuggaugagggaaaggaaucauaguugaugugcagaguggguaguuaagugacuagggaaggcuaaaggaauaaaaagauuacccuuaaacaguucaaaguauaacauugauacaguuaccuaaaauuagacauguguaaagguauauguguaaagauauuuuaacaaauuuucuuaaagaauuauuguuuuuuugauaaagacuauuugguuuaugauaaagacuaucugauaaagacagauugagcugucuuuaucauauaauagugaacgccaguuuugggugguagauaguauuacuuguuauucaaauguggaauacaugccuuacuagguuagucuuuauggaaacauuacacuuggauauagauggagucaguaauuacuauagaaaauuucuucgaggggcuaagaauggcuucccaacuccugggugccauugugucaguaaagucccagugagacuuuuucacuaagcacuccuuuugaagucuucuuuuaaaaauguaaaagcaggccaggcuuguuggccugggaggucaaggcuguagugagcugugauugugccacugcacuucagccugggcgacagaguaagaccuggccucccucccaccuccaaaaaacauaaaaauuuucuaauucuuguauuagaucccuuccugauaucugucucaagaagcuaugaugggggaaaaaugggugggaauaaaaaaggaguucugacaauacagaugggaaaacugaaguccaacacagacgcuuuauauuuugcauuuguccagaccugcugacgcagagauucucauaaaauuugaaaagccuuaccacugaguugcuuuucaaagccuggguuucccucaaagaacaucugcaauuaccaugcugcuuuugaagaccauagugaaagugcuaaccuagaccagcucuaccagcuguggugaaguggcuauguugucugggauauauacccugggguucgucaucucaugccaggaaaauuuaggacacggacgcaaggaguuuaggagcggagguuuaauaggcagaagagaagagaagagaaagagaaacagcccucucuacagagauagaaggggcuccaaguggaaaagaccagcuggugguggaugccccggauuuuauaguccagggugaggagauggugucugauuuacauagggcucacagauuguuuggaucaggcaugauguuuacacagugcuggagaaaggcugguggccccacccuaaccuuauuauacaaaugaacucucccuguccugcuucugauaguacacguggcugacaaagagaagggaagauggagccgccaucuugaacaugucuagucccuaguuccugccagcauucccccgugcaagcucccagcuugcuugucuaugucugcagcucgacuuuacaggcugaucuuuguuagaaaaugauuuggggcugcuuuucauuaaagagaaaagccuuacugaggauucccaugcccuuaccaucugccuaagugauuucuucuuaacuccugugucagugguagccggauucccugggaaggagggacgcuguugcucuagcaucauucugcuuuuuggaaacaggguuguauuugcugaugcucugaaauucuggaaaugacuuucugagccuuguggcuguaaguaaaauaaagaagguggcaauagagguaauauauucucccauccccaucucucuugucauguuggguuaacaaccauagaauacacaugugauaauuacauggcuuacucauaaaucauaagaauaagucauauacccaaggcccugagcuguaauggaauuuuagugcauuucaaauuuauagccaguuucugauuauccaguugaguugccugugccucucaguucuguucuggccuaccuuuugacagguuuauuucuugugacuaucuccccuggugaguaauagucauggaugugggaggcaaaauucaaaacguguccauuuugcaauuuuaaggaggcaugauuccuggggagauuaaaacaaauugaaaaucaagguguuuuuuuuuuaauuauaauuuuucaguucucagaauguuugucccugauugucauggguaauuuaauaauuucuauuuuaauacaccuuuaaauaugucauuuuuuaaauauucuaauucaugccuucuguuucucuuuuccuuaauuuuagugguuaagaguuucacuaaaauaaauguuauuuuuuauuuuuuauuauuuuuauuuaaauuuuuuugagacagugucucgcucugucacccaggcuggagugcagugacacgauuucacugcaaccuuugccccuggguucaagugauucuccugccucagacucucgaguaguugagaauacaggcacccgccaccacacccggcuaauuuuuguauuuuuaguagagacgggguuuugccauguuggccaggcuggucucaaacuccugaccuuaagugauccgcccgccuuggccucccaaagugcugagauuauaggcaugagccacugcgccccaaccaacugauaaauguuaucacguaugaugagaguggggggguucuugccuuuuuccccaaacuuauaguaaguguauucaauauuuaaccuuauguaugauaucagcuauaacuuuauuauaauguccuucaugagauuuugggggggaauagaaagcuagcaaaauaauuagacaaacauacugcagaaaaucauauacauuuucaaaucaaauacauaaaaccagccaggcgcaguggcuuaugccuguaauaccagcacuuugggaggccaaggcagguggaucaccucaggucaggaguucgagaccagccugaccaacguggugaaccacacugucucuacuaaaaauacaaaaauuagcugggcaugguggcaggcaccuguaaucccaccuguucggcugaggcaggagaaucacuugaacccgggaggcggagguugcagugagccgagaucgagccauugcacuccagccugggcaacagagugagacuccgucuuaaaauaaauaaauaaauaaaauaaaaccuguauuaaucagaacuagcaguuaagguauauuuuuuguuuuacauugagaaagaagcaacacauaggaaaagcuaaaauaaaggauuuaacaaauccaacaccagcuuaccuuuugaguaauauaauuuaggugaggacacagucacuucaguuuuuuuucccuucuguauguuccuacaguguaugucauuauuugaucuaguaaaauaaccugaauaagagaaauuucauagaagcuccagaauagaauuggaaagcuggcagagaugguacugaaccguauucuccuagauuaguauuuuuccuaaguaagccaaguuguuuuuuugagauuuuguuuuccgcauuaagaacucaggcuuuauuuuagaagacaagguaguuuuagggauauuuagagaaccaagaugacaagguuuguuguuaggagagguugcaugcaauuuuaggcugaauugaaaguaccauuuaucaacagcacuggaacauguuugaaaagaucugaacuguuaauaaagauuuaaugucagcucccaggaaauaagguuaacauacuguuaagugugcuauuucuuuuucuacuacucuuaaaauuaccacugucaccaaggccuaauucaucaugugguaggaguuaaagaugaauacaugguuuugcacagaaaaguuuuuaaccuaugaaauggcccaacuguugucuauauuaauugguuuauuugguauuuguaggguauugaugacgucacuggugaaccguuaguccagcaggaggaugauaaacccgaagcaguugcugccaggcuaagacaguacaaagacguggcaaagccagucauugaauuauacaagugagugugcuucaauauuuucaugacaaaggacagacuggaaagguguggagccugcugggaggaacacggggcugaggcagaguaguguuucuuuaagacagauaaacacuagcgauccaaaaccuucccagaagucagaugaaaugcuggagcuguacaugaaagauaagguucaauacuuuuauccugaaacuguuagaacauaaggacccaaaccugaucaucucugucugcuuuggauguaaaacaacauugagauuuauuuucauuuucuuaaaaauuuaagugacugagauaguggucccacauauguugauacucccacauauaaauauaugguuuggauagaagauuagaagacacuuggugugucccuucuugaagugucuguaaggaguuuaacaaaaaaaggcuaaaaccguaaaccagagauuaaaaauucaaauggcugcaggggcuagggcagguauuggaaaugagucucaaacauggugggggaugugucaagcuagacaguugagugacaggucuugggcuguuccggccaguuaucauucuagggcacgcaggccaaugauucccauuuuucaggaauagcagaaaucugguuuucuguguguaugugugugagggggaaucucaguuuucauauuggcaacauauuuaaauuuuuuaaauaacaugcaagucaaacaaaacuuuaugcugagugcauucaaaacagcaguuuauacucuguuacaaucacuuucuggccuuguagucccccccaaaauuuagcaaaccuuaagaucagaguuuuaugaucauauuauuaugauacaucaauuauguauuccaugauugacuaaguaauauagguuuuaguaaagcuuuucagugguucgcuuuugaaaauuauauauuggggcacauuuggaauggccccuauaaugcuauucuuugauauguuuuaaagggggagaaaaaagguggcaucaugacaagcauaccagaauugcaaaagcuaugaccuuauuuauguacacccaguggagguguugauaccuuugaaaggggcuguuuuagcacuuagugugguauaugauauagaccaugagaucaugcuuguuuuauaucuaggaucuucugcacuaauacguggaaaagaaaccuaaaaagccauuguauguugggcuuuguuuuucaggagccgaggagugcuccaccaauuuuccggaacggagacgaacaaaaucuggcccuacguuuacacacuuuucucaaacaagaucacaccuauucaguccaaagaagcauauugacccugcccaauggaagaaccaggaagauguggucauucauucaauaguguguguaguauuggugcuguguccaaauuagaagcuagcugagguagcuugcagcaucuuuucuaguugaaauggugaacugauaggaaaacaaaugaguagaaagaguucaugaagaggcccuccucugccuuucaaaaggcuggucaccuacacauguuuaaggugucucugcacaugucucaagcccaucacaagaaagcaaguacaguguggauuucaaaugguguguaacuucagcuccagcugguuuuugacagcuguugcugugguaauauuuuugacaugugauggugauagucucugguucuccccauccccacaaaggcuguugaaccacagcaccaggaagccugagaaugaauccugagggcucuagcccaggcuuugucccaggcuuucuggugugugcccuccugguaacagugaaauugaagcuacuuacucauagugguuguuucucuggucuugagugacuguguccacaguucauuuuuuuccgguaggaauaacuccuuuucuacauccacgcuccauagagucucuccuuuucagacauccugggaugaaagaauuuggcuuuuuuuuuucuuuuuuuuuuuggacaucuguuuucacucuuaggcuuuuaaacaauaguuauugcuuuuaucccucucagauucuaauaacugagagcgauggggcuauauugaaucucuguaugcacugagaacugagcuaugaagaggaucuuauuaaacugcuggucugacuuuauggauugacacuguuccuuucuuuuauugugaaaaaaaaaaaaaacccugaaagucuugggaacccccuaaagucuuuugggaauccucaaaaagcaugggaaguuaaguauuuagcuacauaaauguuguaagaucauaucuuauguauagaaguaauaagaccauuuggaauuacuggacuaauugaauaguuaagguuucuauucgggacaauaaaauguauuuugaaagugcugcuaacuauugaugcugacaguguuucacuccuaugagugacccaaacauauuauaaauaugugguaaagggaauggagccugugggguugagcagaauguuguacuagcugugccuggacugaguauaacagcuuuaugauuaugagaaaacaaauucuuuauuuuuuuuuucuguuccaaagauucauccuaugggguggccauaaagucuagaauuagauacuaauauuuugucauucauuauaacauaucaauaaaccauuuguuaaaagauuugccugguuuccagacuugguggccaccuugaauaauucuugcugucuucugggaaggaugaugaaauuuauuccugcugccuuaaaaauauguaucccuucuucacccaucaugacuguccccagugaguguccuuuacuauucuugggagugacuccugucuaacuuuucauacuggcgagaagaaaagaagccuauuuuaacacuuuagugguguugaaacacauuacuuacuuucugaagaugucccagugaauccucugucaauucacugccauauguaaucuauaugauaaggaaugcaucuuccuucuaaguacugcccaaacucuugccagcuccucucccauugucccuucaugugaauauuucuuggcuaccuuaguggaaauauagaucaguuuucuccccauccauccucucaaacauaaugagauuguuuacuuuuuagauuuaugcagugaaaaugcccagucaggucugaaucgucagugcauuauauugacucugagcacuuuagaauuuagaguugcaauugaaugccagcuguggagauggggugcauaucagauauauaaauaaagcucagguuugcuagggaaccagguauagagaaaaauaagucugauaugaggaaaauugcacaauuuagaguaguuaugccguagagaaaauuuccacaaacuaggaaauguagagaguuauucuauagaauacucaaaagaggaaaguaugugauuuuuggaaacaggaaaaucuucaaacuucuuucuucacuucccuuuguguuuagcugacccuccaaugugaucauugccuuuggaguuugggagagguacgggaaguggccugaucccugcuuccauacuucacuccuccauccauccuucccucccucuuccccuccagcuaaauggacaauucuagccaacauugagucacucaauaagucucaacaguggguguguuugcugagauuguccagcgguugagcaguuuggucucaccucccucgcuaguugagaccaaaaagagacaaauaacuuuuucauggucuuugaaacauaaugcuuauuucguggucaauggcuuuaaaaaaaucuguuucuuguuuucuucaacaaacucacuaguuuucccuuaaaugauauuguaaaaauuaaaguaaucuugaaaauguuuugacaaaaguaaaauuaaagggacaucuuuucuuguuuuguuuuuuuuuuuucuauugccacacaugaccguuccuucaccuuuaagcaaagagagugguucagaugguuucuaagaugccaaccugaccucgcauucugucauucuacccagcucuuaauucaauuugcuuccauuauccuaacaggcuucuuucuuacuuagaacuuggaaaggcugcuguauuuaauacccuccaacacuaacgcagacuuaagauagguacuguuuauugaaaaccuacugagugaaaugugcgguuuuaggaccuucauaaacaucucauuuaaucuuucuagcauccugugaaacagccaugauuucacguugauaaacaaagaagacaggggucccagggaugugaagcaucuugcccaggcuucugcugcuggugaccaguguagccaggacuccagcccagguuuuccugacucagaagacugagcuuuuuccuggauguuauuaauagcuaauuguguccaagcaaccaagggccuugagucugcuugguucugcuuauggccucacaucaagaaauggagcuaguccaugucuguagucccaaugcuuugggaagccaugaugggaagguugucggaggccaaaaguucaagaccaggcugggcaauaucacaagacuccaucucuacggaaaaguaaaaaauuagccagucauggugguguacacuuaugguccuaguuacucaggagacuuaggcaggaggauugcuugauccuaggaauucgaggcugcagugagcuaugauugcaccucugcacccaagccugggcgacacagcgagacccucucucuuaaaaaaaaaaaauagcagagcucaccaaagugauguucaccuuuuuaugacauuccuuuuucuuagcuuaagaaaagaaagcugcuagaugagagucuuaguuuuccugcauaagaccuccuuuaugaauagaauaaaagacugucaaaguaggcugggcuugggcccaggcuaaucuaugaaggaagcaagcucguguuccuuaccuauccuuuugguguccauuggauugugccccgaaguggccuuuacccuugagccguccccagccauggugcucacacauaggcuuuugagcuccuuggagcuauccagauccugcucacuuuuccuuccugagaucagaacaaaucacccccuuacucccacuccaaacaaggccuugaugauaaacuaauccuuccuaaaaugcugguagguaaacaagcaaugaugaagcauugaacacagguuaacuccugacuuuuguaccauugucuauuccauuacacauuaacaugacucugaaugccagauccaaaccuuugcccaccaucugcuugucgugcaacaguugaggcaguaaccaggggagauucacuuccugucuuguccuuccccagggaucaccccccugcugcccucuagcagccaaacucagaugaguuccauuguuacccuaggugugcccaucucuuugguagggaaggagaaagguaagaauagccaucagugaggaaggauucuuggagcgaggagccacugugguuuuuccugcuauuuaagauguugagaccggauaacuuuagaaagauaccugcacaaacccauaaauagugcuuuuauaaaguuuaguucaccggaaccugaguucaguauuugacauuagcuuuuuguccaaagaguugaagccugcuggaggucuuugcucaaauaauaaauaccacauauuuccaaguguguucagguauaggcacuagguacugucuguuuacuucauguuaggcacauuacaugcauuggcuaaucaaauccucaucaauuacauauguaauaaucuaaacuugccuccuuguauuauaaauggaaauaauccuguuuauuuaaacggguuuucauguaccuguagggauuaggaaacucaaauggccuuuuuaauaccuuucccuaguuugagcucccuguucucuuuaacagauaaaacaacauauuugcuucagccuggaaucuguuuuuggugcuuuggugcagagacaggaaaugggcacucagagucacacugguaguugcacacuguaucuacagagggcgugucucaucuguacucugcuggguuacaggauuucaguagguauuuguguccaccugagaauucuguuuauuaccuuucauuugacagugucuuuccuuucugcaguugauuuugcuagagaggcaauucauaaggugagguccuguucauaguaugacuugcuuucucaauaucuccuucaauuuuuaguaacucuuggucuauuuggugucuuuaaaaaaaauaaccuaguaauaaagacuucuuuuaauguggaaauguggucugguaguaaguuauuucuuuccacauguaacugacccaaucugguuuccaaaugagaagugugcaggccccagagguugagaagccauauuucaacugugaaaaaaaucugcuuccugcaucuguugaaauauaguuguucauacuugccaucccuuaucuuucuuguaacaauuugcacaguucuugccagaauaaaugccauuaucuguauguuucagggaguuccccaauuugaucauuuuuguguguguguggugugugugugagagagagagauacugcaguaaaacauuucuaaaggaugaaagcucuuguauggcauagauaugaauuccuuccucugguaauaauuagguuauucccagaagcacagugucauucuuuaaauaaaagcuuuccuguuuaaagcuuuucaaaggagcagaccaccuugaagauucccccuaggguugauaugugucuaauucauuuuauaaaaauuauucuugucuucauuuuaaagcuuuggcuauauagucagaaauguccuaaauaacaaacuauuuuguauuuaauuuagggaagacuaaagggaagaaaaaugaaaacucagucuuuauguaagcuccaaggauauuagggcuuaaagggcuuuucuaguuuuaugagaauuuguacuacugauuuuuauauauuccuguuuuugagaugaacagaucucuggggaaauuguugaguuacaauggcauuucacugugaucccucucaagcucagaucaguucuauaacccaaugacaaccugucucuuugguuuacuguccugugaaaugucagcucaaguuucccagaagucguguguuuaugaugagucagagugcuuuuccucggugggacaguugcuggcccucuuaauuuugguguaugugcuuccaaguaucuaaaccuccagucugaucuguauaugcuauccuaacuguuaauuguauuauugauuauguugauuaucuugcuugaagguucauacuuuucaauuugauagaaauaaaguuuuuuucugcuuauagcuagcgaa

SEQ ID NO: 191388 - RNA, 11719 nt, Homo sapiens
gccacuuccgggcgaagagguuagcgagaaggaaccccuccacgcagcgacgacgggaccugacgucacuuccgcgcgccgccgcaaacgucagugucgggcgcagacggcggcagugcggcuugcucuuggaaguucaggcucgguugucuuuugggagccauggagagugacuuuuaucugcguuacuacguggggcacaagggcaaguucggccacgaguuccuggaguuugaguuucgaccggacgguaaaagcagccugccgcccgccgggagcggggaccaggccugggggccggcgaguggggaggccgagggucggaaaucuguggggaacuagaggagggagggacugagaccugugcagugcagaucuuaaaggaacgccacugugucugcuccacggggucuuucuauccauucagcaaacguugacugaacgcccacugugugccaggcucuguuccacucuuugggaauacggcagcgaagguagacaaacuuccccucucguggaacuuguguuuuacugccgggagagagaucauaaacaaaaagaugauuccagauagcagugaguggucaaaaaauaacaugguagaauaauugcuggaugggcugcuuuuagauagguuggccauuagagagcucucuguaaaggguauauugcagccgaguccuaauuaacaagaagggcucagccuugugaagcucauaaggaagaccauucuacacaaagggaauaccagaugucaaggcugcagggcgggaaugagcuaggcgugucucagguggucagugugguugaagaguggugagcugggagauagcaggagaugaugucggauagguagguaggagcggcaccucuuaggucuuuauagaccacgguaaaaaguuuggacuuggaaggccuuuuuuuuuuuuuuuuuuuugagacggcuuucgcucuuuuugcccaggcuggagugcaauggcgcgaucucggcuuauugcaaccuccgccucccggguucaagugauucuccugccucagccucccgaguagcuggaauuauaggcgcccaccaccacgcccggcuaauuuuguauuuuuaguagagacggaguuucaccauguuggccaggcuggucucgaacuccugaccucaggugauacgcccgccucggcgucccaaagugcugggauuacaggugugagccaccgcgcccggccgggcuuggaagguuuuaagcagagaagaaaugugaucucuucuugaaaaagcauucugguuauugggugcggaaugggcaagaguggaaacagggcuauugauuaggagacuguugcaguugucaagacacgaaagauguugggggccgggcgcgguggcucaagccuguaaucucagcccuuugggaggccgagguaugcggaucacuugaggucaggaguucaagaccagccuggccaacauggugaaaccccgccucuacuaaaaauacaaaaauuagccgggugugguggcagacgccuguaaucccagcugcucgggaggcugagacaggagaaucucuugaaccuggggcggagguugcagcaagcugagauagugccacuguaccccagccugggugacagagcaagacucugucucaaaaaaaaaaaaaaaaaaagauacugguugggacuacagagauaguagaaauggagagaaagauuuaggaaacuguuggaggcagaaccaacuggacuuugaucguugauaggauuuuguuggcagaggcacuguggugaaggaaagagcaaucaaagaugacagaagacauccacuaaguggggcacaaagaugaaucugacaggccucgacugugagggagauagauuuguaagcagugauaaaacagcacauuagguguugugguaaaaagaaacagaggaggcucgcagcagagaagggugcaccuaaccaagccugagggucagaggaggcuuccuacauaaaaugaugggaggaggggaugugaggaauugguuaggagacgaagaagagucaagaaggcauuuuagacagcaugcaaagaagcugaaaaccaaaaagugcuugggauguuucaggcagaaaccaaguaguuugacuucagcugugugagagaagaauauuggcaggaaugaggcuggaaaagcaggcaggggcuuagcuuagcuguaugccauguugaggaguuuggauuuuaccaggaaggcaguggaaagccauugacuuuaucaaaguauuagaguaaccuaaucugauagaucuguuaccacaucaccuuguccacuguauggacagugaacugaaugugaagaaacuugaggcagagagacagcacagaggcuguuggaauaaauucacugggcucaucucacauguaugucuucuagucuacaugucuucuauuuccuucugucuucuccucauccccaccauuaaucugucagaugcacacaugggcaaagggucuuguguaccaaaugugcucagugauaaaagcagcagcuucuccaucacagaaauagaguauggcacagucacaugauaauauauguaaacugcauccuacaguuuucaaaauguuuucacagcucauuugagccucaggagguccuaugugucgguaaguuaucaguuacuaggccuguuuucaggacauucaccugcaaaaaugugauuugacaaagucagaaaagagccugccuguguuuauaccccaccugagcugcuuuuugcaguaguugaguuucagcuguauauuuggcuguuuaagccugaagugaagaacugaaaagacuaguauuguugaaauaccuuaagaguaaauaauaaaucuguuagacacuuuuagcaaguuagauacauuuugggcaacugcugaugccuuggcaugguauugaugcuuuauucauauguuuuuauuauacguugaaauuguuuuuugcccccacagggaaguuaagauaugccaacaacagcaauuacaagaaugaugucaugaucagaaaagagguaugagccuucugccuucugagaguccuucauuugcuacauuucagcuuuuugucuugcauuguuuuuauuguuucuaguaguauugaaagauaaagaacagggagagagacacaugucuguagacagcuucuggauuauuucccaaaucaucuuuuaguugggauuuuuuuauuuuacauuguggaaucaauuacugguaaccuuugacauaccuugguuugaacccugagucugcugcuuacuaccccaugugaccuugggcaaguuccuggcugaacuugauaaaucucuguuucuucaccuguaaaaacaggaauaauaaaagcuaccucccacucccaagugcugucauaaaauuaaauauguucuauuuaaagugcucuauauucccuguguacaugguacacaaugaagagcuauuuaauuuacaucugagugggaaagggagcaugggaaagcaguugacaucauugaaugcauguuagaugucaggcguggcaucuuauuuaacccugauuguaagcccaugugaugggggaggguauuauagcccccuuacaaauaagaaaauaaaggcccagguauuaauuaugaggcuuguucugaguuaccccugcuaguaagagauacagcaggaauucccaauccugccccaguaaaguuuguauucuccguucugugauuucuacuacaucauuaaggcuucaucaaagcuacucuuuccuuuuaaccacuuugccaccuuugaaaaugucuuagcauauauuuucauauuguuauuuuagcuauugauuuuaugcuuauucacacaugucaauauccucacuauuuuuuuacacaggcauaucuuuuaaaauacauuuugcuccucaggaguguauuaccuaguuaagaauaacuggccgggcgcggugacucacaccuguaaucccagcacuuugggaggccgaggcgggcggaucacgaggucaggagaucgagaccauccuggcuaauacggugaagcccugucuguacugaaaauacaaaaaaauuagccaggcaugguggcgggugccuguagucccagcuacuuaggaggcugaggcaggagaauggcaugaacccaggaggcagaguucgcaaugagccgagaucgcaccacugcacuccagccugggcgacagagcaaggcuccguuucaaaaaaaaaaaaaaaaaagaauaaccagggcaugugggugucgcagucucuuuuuugcugcaacaaaaugccugagacuggguaauuuguaagcaguaaaaauauauuucucacaauuuuggaggcuggaaaguccaagaucaaggcgcuggcaaguucagugucuagugagggcccagucucugcuuccacaacugugccuuguuuuugcauccuccagaaggaaugaaugcuguguccucauauggugaaagaacaagaaaggggccagcuaguucccuuaagcucucuccuaaagcacuaaucuaucccuggggccucugcccucaaggccugaucaccuccuaaaggcccuaucucuuaacacuguugcuuuggggauuaauuucaguaugauuuuuuuggaggagacaaaaacauucaaaccauggcagggggcacucacagaccuguuuuggguuucguugugaguuggguaugugggcaggcagaagggccaugugaacaggauguaccaggagguaguaacagcuagauaggggacugaggugcaguuacuggauacuucugaccgugucccucaccugcaucaugccgagguugagcaugaaugucuucccacuuaaggagaugccagaaauaagucugcaggaacaguuauuuuuaucuuccaucacuaucugagucaaagcacugcuuaaggauacaacauacauuuuguuuuuuaacuugcguucaggcuuauguacauaaaagcgugauggaggaacugaagagaauaauugacgacagugaaauuaccaaagaggaugaugcauuguggccuccuccugaccgagugggccggcagguguguuuuauugauuauccuguagugcagaaaucuuacaaauaagaccccccacacucccuccuccacuuaaagcuuuuguugccuaucucacuuacuaacuacuauggacaaagcauuguggagauacaaagagaaauagaacauaauuauuucaacaaucuaaugaaaggaaaaucauacaaauaauucaguguauguauuuaaauucauguauauuuauauacauuaauguauauauucauucugagcaccauuuugguaacuaaaaaauaaaagccacugucauauugaacugaauuaacagaaaagguauuuucacucuugacugcuaccauccuaauccagacuucuaauagauuuccuuguuuuuccucuuguuccauaccauccauuuuuccauccugaaagccagugugauuuauuuauuauuuuuuuuuugaguuggagucucgcucugucgcccaggcuggagugcaguggcauaaucucagcucacuguaaccucugccuccuggguucaagcgauucuccugccucagccucccgaauagcugggauuacaggcguccuccaccaugcccagcuaauuuuuguauuuguaguagagauggcguuucaccauguuggccaggcuagucucaaacuccugaccucaggugauccgccugccuuacccucccaaagugcugugguuacaggcguaagccgccgcauccuacuggucugaucuuuaaaaacguaaauuugcuuauguauuccacugauuuaaacuccaauggcuucccacuguacuuaaaauucaaacucccaccuuaucuuuuaccgggcuuccaaucugucaugguguucaaaccuuacuagcuucauuucuguuccucagacauaccuaggugguucuuacuucagggccuuugcacuugccacauuccgccuaaaauauucuuccuuuaacuuuauacaagacugucucuauuauugaggucuucaaaagucacuuccucagugaugucuugccuguccauccaaucuaagaagucgcuucccaucauuaagaaaaagaucuguuguguugucuuuuuguguuuuuuuuucuuuuugcuuucaguuuuaucacaauauguguugucuuuguagcacuugcuauugucuaaaauugucuuacuugcuuuucaguguuuuccacugcuguaucucuagugacuaaaauaguacccauguauaguaaaagcucaauaauaauguauuuguuaaauuaauaugaaaacccauauaaacucauuccuaauaaucucaaaaugauggaccaacccuugaagaguuuuuuuuaaaaauccacccucaguacuuacuaaaguuaacuuuaauuuauguucaagggagcucaguaauaucauauauauguauuuugcuuuaccacuuauaaaauuuuuauuucuauuaacucguucuaccaucacaacaauucuguaaagagggaagggcauauuccuuuguaccagcaauaagccauuggauacuguaauuaaaaucaauuccauuaauaauugcaagaagaguuauaaagaacuugggaaugcauuuaacaagauguacaaaacuugaaagggcuuuauagaaggacaaaaauauguaucguuuuuguggauggcaagauucaguaucauaaagaugucaguuuucaacaaaguaauuuauaaauucacucuuaauucaaauaaaaaucgcaguaggauuuuuuucccuuuagaaucaaauagaaugagcauuaaauucauggaaaaucagaggcaagaguagccaaaauaauacuggaaauuucuuacaaagcuguggucauuuguaguaugauauugccucgggaauugacagcuaaaccaauggaacagaauagagagcccagaaaccaaccuaugaauauauggaaacuuagaaaagugugcuacagagguggacuuucacauuaaugggaaaagaacgaauuauuuaacaaauuguaccaggacagcugacaauguauuuauggaauauuuuuaaaauuaggccauagaaaucaaaaauuuuaaacagaauauagacuuguauuauuucuggguagagaaggaguuuuuaaaacuccuuaagggguaagauugguaaauuugacuucuuuacaacuuagguuugacaaaagauggcaagauaaaguugaaagauaagccauagacuggaagaaguuaucugcaaaacauaaaacuggcaagaguucuccauccagaauauauaaagaauuacaaauuaauaaaaagacugucccguggcagaaugugcaaagguuaugaauagauaacuuacaagaucaaacaaguggcuaauaugaaaagauuuacggcuucauuuguaaaaugaaaggacaacagugagauaccauuucagacccauuagaauaaaaacagaaaaaaaucugccgaauuuaaaaaaugauaugagaaaagagugagaauaaaauuaguauaaccgcguuagggaguaauuuuguggcaucuggcagcauuuaaaauacuaggaauuauauggagacauauucacauguacaaggagauguauagaagaauauucuugcuacauuguuuauaggaauaaaaauuuaaaacuuaaguuuauuucaguagggaaauggaauaccacaagcauuuaaaacuaaugagcuagaucuguguaacucaacauugauaaaucucgaaaacaauguggaaugaaaaauguaaaaaguauguauaauaagaccauuuuguaaaaauuuuaaagcacacuaccacgucuaggccaggugcagugacucaugccugcauucccagcacuuuuguucuuaauugggaggccaaggugggaggaugacuugaggccaggagcucaagaccagccugagcacagugagaccuuuuuuucuacaaagaaaaaaaaaaaaacccuaaaaauuaacugggcgugguggcgcauaccuguaguccuagcuauucgagaagcuaaaggugcaguauagcaugagcccaggagcucaggguuacagugagcuaugauccuacuacuauacuucagcuucagugacagagugagauccuguaucuaaaaagaaauaaguaaaaacauacuaccaaaucugaaacaagaguggaacaaaucgggauacaggagggagaacagaaugggagauggacauaaacuuuguaauauuuuacuucuuuuuuaaaaaaaaucugacacaaguauggcaauaauuuauaaaucugaguauuggaaacaucucaguuuuuucgauuuucugauugaauuauaacaaaaaggauauaugaaucaaaaagaagaaaaaguaaauaggccucacaagaauaugaauuccacagggcagagaucuuugguuugcuugguuuuacuuaucuguccaaagcacugagaacaauagccagcacccaguaggcuacacauagauacuuuuugaagguuaugguacucaugucacuguuuggaaauugagauccaacaucauacauguagggagugacaaaguggggaucaaaccuaaggucuggaaguugccuagauagauuagauucuuugguuuuuguuuuuguuuguuguuguuggagacagggucucacucuguugcccaagcuggaguacagugaugagaucauggcucacugcagccuugaccuccuggggugaaggaauccucccaccucagccucucuaguagcugggaccacggaugcacaccaccacacccagcuaguuuucguauuuuuuguacagaugagguuuagccaaguugcccagacaggucuuaaacuccugggcucaagugauucuccugcauuggccucccaaacugcugggauuacagguaugagucaccacacccaguccaauuguuugguauuuuuaaaacauagguguauucauguuacuccacauuguugacaaugaaaacucauacaaaauacuacauaggcugggcgcaguggcuuauaccuauaaucccagcacuugagaggcugaggcaggcggaucaccugaggucaggaguucgagaccagccuggccaacauggcgaaacccugucucuauuaaaaauacaaaaaaauccauccuggcuaacacggugaaaccccgucucuacuaaaaauacaaaaaaaauuagccgggcgugguggcgggcaccuguagucccagccacucaggaagcugaggcaggagaaucgcuugaaccugggaggcggagguugcagugagccgagaucaugccagugcacuccagccugggcaacagagugagacucugucucaggaaaaaaaaaaaaaaaaccuacauagauuuuuccaaaucugagaaaugguagggccuuaaggguacaacuucuucuaaauaugagcuguauuuaucucuuguuucuagugcccagcacaguuuagugcucagagugaacugcccuuguuuuuguggccaucuguagucaaguuugugugauuuggcaaaugauuaauccuucugugugcuugaugaauaauccaauucuacuugacuucgauuuucuaaaauguuucuaggagcuugaaaucgucauuggagaugaacacauuucuuuuacaacaucaaaaauugguucccuuauugaugucaaucaauccaaguaagugugcaugauccuuauauccaguugugucuguuuuggagcagauugauaagaaaccuuaaccaaauugggaccauuaugggaagagcuggggcaaaugcaaaaugcaggugggcagcuuuguccuucuuguuagggaggaaccccaaauuauuuuugaggacuugcuccuauuacuuuugguguuucauucagccauugcuacugcgagcuucuuguugacacacacauauagauuaaugcauaggagcagccagaagaaaaaauggaauaugccaaaaaagugcucaugauaaacuguagagucaccgagucugaauagcuuucucagugugacuguugagacuggcacaucuuaaaaucugacuucagugaaacuugacauuuuuuaggaucuaaguuuuauuuuauuauaaauuuauuauuauuauuauuuugagauggagucucccacugucacccggacuggagugcaguggcgcaaucucagcucacugcaaccucugccuccugaguucaagugauucuccugccucagccuccugaguagcugggacuacaggcaccugccaccacacccggcuaauuuuuuuguauuuuuaguagagacaggguuucaccauguuggccaggcuggucuugaacuccugaccucaugauccgccugccucggccucccaaagugcuggaauuacaggcgugagccaccgcgcccagccuuaaauuuauuguuuuuuacaaaagcauugguuuggugaaaagggaucaagauuuuaaaauucauguugucaguggggcagauuaucaaguugaggcaugaaccuaugugcuacaaagaauccuuagaauuuggcaacuucuuuggcucuuacguuuugaggguucaggauuagguacggcucacuuuuggcaaauguugggcguaauugucuuccuuuggacacucuucuuagccagugaugccacaguaaucuucaaccucuugguccugcuuaguacuacuacuuuuuaaaaaaguuuuccuaacucgggccgggugugguggcucacaccuguaaucccagcacuuugggaggccgaggcaggcggaucaccugaggucgggaguucaagaccagccuaaccaacauggagaaaccccaucucuacuaaaaauacaaaaaauuagccaggcguggugcaugccuguaauccuagcuacucgggaggcugaggcaggagaaucucuugaaccugggaggcggagguuacagugagccaagaucaugccauugcacuccagccugggcaacaagagcaaaacucugucucaaaaaacaaaacaaaacaaaacaaaaaaaguuuucuaacucugaaaguaauacaugcucauuguagaaaauacaggaaauguagaaaaguagaaaggggaaaaucauccacaaguuuaucaaucagacaaccauuauuacuaucuugcaguauuucuuuuuagucuuuaaugcauuuauucuaugcauuaauacaauauauacuuuuuaagaagcauaaaaaauacaguugagauuaauaauuguuauuuuaauuauauuuuuucacuuaauguaagcauuucccuauauuaaaaacucagcauauuuaaauuaccucauaauauaccguuuuaauauauagucuuuuccuuuuuagggacacuugaugggucaaaguuuuaaugccuaaacuuuuuuccuuuuguauuuuagggauccagaaggcuuacgaguauuuuauuaucuuguccaggaccugaaguguuuggucuucagucuuauuggauuacacuucaagauuaaaccaaucuagacugaauauugguguggacauggggggugggugggaguagaaaauuuuguguauaucagggcaguauuuuuuuaugaacuauaaaugauugucuuuaauaaauaugugauaaaauccaauuuuuauuauuuuauaaagaccugaacaugugaa

SEQ ID NO: 191389 - RNA, 13774 nt, Homo sapiens
uacauuuacguacagaugcuuauauuuaaucuuaaaagguaguccuauauaguucuaucagaaaccguaagagcucuuucagaccacuuuuauuaacucagguauuacgaaaggaaccauugaagaauaugaaagcucaaauaagauuaaaaaaugcuuuaauacugcugaagucuuucaauucuagagcaggcauagaauauauagaauguuuaccuuaugaccagauacaaccucccaagaaaaacuggauccugcagggcagcuggucuucacaguuccugcugggacuacaguugcagaagucauuccaucacuuuucucuuuuuaagggaguuaaguacagguaaaggaacucuucuagcaaagaucuuaauaaucucuugauuaucgauguccguggaggcuuuuuaguccuuccuuugcuucugcauucuugacccuuggcuucuuucacucacucucuccuaauucuccugucuuucugaaugggccauuccaguuuucaauaggugacuucuauuucuuccuguguugguguugccuaugguucuguugugugcauuucugauauauauuaacacucugggaagucuuauugacagauuccaccauuacuuaaacauugucaauucuggccuagaucgcuauguuaaacucuggucccuaucuccaacuuuaugggcuuuuguuuuuagcuauaccauagcugucucaaauuaaacuuguuaaacugaaugcaucauuuucauuacuaccaccauccucuaauucucugccccucuaaaagcugucucuuccugcuguauuuucugacuuugugaauggcacgacugucuagcaauuuaggucaaaaccaugacuaauauuagauacuuuccucuccaucaaaucuuuuucaaucccguuacccuacugcuacugacuaggccuggauaaugucaaugcuuauaugauaaaggcuggauaccuuaaccuggauuucaagcuugugggcaagaacaaaugaaacuaugaaaaaaugggcuguauaaaggguauuaagugcugcucucuguugaacuguuugaugaaacuggcuuuaaugauccagaagcagccuuacauuugaaugcauucuauucuuucaaaacugcuacaaaccaguuuucauguuuauuaccacuugcugcugcuggaaaaaaguuaggagcaacuauguuuuacuccuuugaucuuugaauaacagcagcagcacaaaucccaggauucucaaagcaguuccaaccacaacaaaccaaaaacuaaacuacagcgaaaugggaaacagguguguccgguuuaauaaaaagggaaagggucaucagguggccacagccuuuccuugucagucauauccccaaccuccagauccuuuauacucucauaaguuugaauacagucaagguuaguugggucaaaaacugauguugauuaugauuaaaaagauacaaaacucagcaccuccuucauuaaaaauaaagguugagaaacuugauaagaaaaaaacuaaaauauucuuauagcugccugggggagaucuuaauccuuccacauacagauauccuuauauccacaggaggccauguggacuaaaaccaaacugaguccauuacucauucccucuccggcucuucuuguggcucuucuuagaccugaaauggcaacacauauaaauaauuauauuaagaagcagccaggcacgguggcucacgccuguaaucccagcacuuugggaugccaagguaggcagaucaccugaggucaggaauucgagaccagccuggccaacauggugaaacccugucucuacuaaaaguacaaaaauuagccgagcauggcggcgggcaccuguaaucccagcuacucaggaggcugggacaggagaauugcuugaacccgggagguggagguugcugugagccgagauugggccauugcacuccagccucaaugacagagugagacuccaucucaaaaaaaaaaaaggaguccugagaaagaccuugguaugcugacauugauggggauggagcugacacucaauauucauuaaacugcuugguauuuuuuugacucagagcaacacucuugagucaggcauuacuauccaaauuuuaccauugaggaaaugaccucuuagagguuaagaguacaccaaacaggcccggcgcgguggcucaugccuguaaucccagcacuuugggagaccgaggugggcggaucacaaggucagauugagaccauccuggcuaaaauggugaaaccccgucucuacuaaaaauauaaaaaauuagccaagggugguggcgggcaccuguauucccagcuacucgagaagcugaggcaggagaauggcgugagcccaggagguggagcuugcagugagccgagauugcgccacugcacuccagccugggagacagagcgagacuccgucucaaaaaaaaaaaaaaaaaaaaaaaaaaaagagugcacccaacgguauauggcacauggggguuucuaaugaaaucuuaucaaaugaaagugacuuguccaaggucacucaacuguuaaguuuuaaaacuugggacuaaaccccauguuuucugagaccaaagcucauccauuguccaaagcugcaauccuguaaagcaaaacagguaucagcuugaacccgggaggcagaggcugcagugagccagguucacgccacugcacuccagcuugggagacaagcacgaaacucaguucucaaaaaagagaaaaaagaaaaaguuaucuaaccccaguaauucucaaagcaauagaccaauuuugucuuguaaugcaggagaauuccuaacaucccccaacaaaacaagaaaauuucagguccaguuaguuguaauuuggacuauuucuguaaaguuaaaauagaggucaauucauuaccuuucgggagacuuugaguggcuccugugucugugacuacggugaugaccuggggaagaaaaggccauugcauaagauccuacccuucuacucuuauuaaacugucauucucaccuccccuaauaccugccauuggcuuaauauucuuuuggccuaugcaggggacaccucuuaguggaagcaacucugaauuaguggaggaagagggagcaaagaaaguaguaaugaaaccaguucaaauacauauacauucaagggcuuuaugacuaauuucacaaacaucauauuggguuuucacuauuauguuagaucuuauuccuccaauuuuagaugaaaaaacuaaagcaaaccuuaucagcaaagcuuauaagugacagucaagcugugaaccuuaauuuucaaauucuauguccauuugcuuuucuguuaggcaguacagucaggcacuccuguacugcaggaggcuaacuacuccuuuuacauuucuuuguuaagacaaccuguggcaaaaggcccacaagcuuuaccuggggacuuggaacgggaucugugccgccgaucucgggaccugcugcggugacgucuuggacucuugcuccgaugccuuucucggcgaggggaggggcuguagaaaagacuggucagacuaccagaucugguuagcaauauacauauaacaccaauaccaccacccccuccccaaagcccuauccuucaucacaaaugacugaaggccuaccuucuccuuuugggagaucgacuccgccuauaaagaggagaggaagaagaaagccuagguuggcgcacuggaugugguagauugcaaaaacggccccaaucuuauccuucacgcuucucuguaucacccaccucuguauccaugucuuuugucacguaacucuagcacccucccauucuaacuuuaggacuggugacaugacucgcuuuggcuaaugagauauuugcaaaugugauaaaagcagauacuggaaaaacauuugcaugaccggguuuguuugcucuugaguucugccacuaccaugagaauaugcccaacuuagccugcuagaggaugacacagagaagagaaauuucccccgucauccaagcuaaggcaauuccauaccagccaguagacagccgacaacagaacagguacuuuaaaaacugccuauccaagcucugcuuaaaucauugacugcagacuugugaaaggaacaaaugguuauuguugucugccaaugagguuuuauaggugguuguuuugcagcaacagauaacuaauauauugggcaaacauucuccauagacgugcauuuuuccuucucuaaaauccaaacuucuaggcuacagugcucaaaaucuucugggaaaaggccaaugacuaggcuuuaccuucugggagaccggcuccuacuccuccuguagcgcagugugggagagcgacggggcuuguccaagucucgguagcuucuccggcggugaucaggugauggcacucuuuccaacuggaaacaagaugauugggucauugaaaggcacaggcuuauaaagagccaucuaggaacacuaauuauacuucacgccccaucuugucccaaaguccaucuccaugugacuuuaaagcacaguaaccugacuacaaagagggaagcacuuacccuauuaacuaacaaaacuuauuaugagcuauauaagacagccaaaaugacucauaggagagggaacagaaacagaccuguguguguguauguguguauguuuaguuuaucugcagccugggcaacauggugaaaucccaucucuacaaaaaaaauacacaaauuagccagguaugcuggcacgugccuguaguuccagcuacuugggaggcugagaugggaagacugcuugagccugggaggccgagaaugcagugagccacugcaccucagccugggcaacagagcaagacccuaucucaaaaaaaaaaaaaguuugcuuccuggaacaacugggcagcuugguuguuuucaacuuuucagcaccguaacuaguacugaaagaacaugacuaugcgguugacauuuucccccuccuaaacaagguuuauuccuuaggauaggugcaauuaugaaaguguucuuucuuuccaaguauuuaauagcugccaccauuuauuaggcaauuauaaugugccaauacucugcuaagggcuuuaaguuuauaaucuuauuuaauacuuuuaacagucuuggggaaaaaaguaucauuaaccucacuuuacauaggagaaaacuaaauuuaaguaauuugcguaagauuauacuacuaguauauggcagagcugaggugcuuuuaauaaggaaauauuguuuuuggcuagaguuagaaaaaaaauuuuuuuugagacggagucucacuuuugcccaagcuggagugcaguguugcgaucuuggcucacugcaaccucugccucccggguucaagcaauucugcugccucagccuccuggguagcuaggauuacaggcacccaccacaacgcuggcuaauuuuuguauuuuuaguagagacgagguuucaccaccacguuggccaggcuggucuugaacuccugaccgcuggucauccacucgccuuggccucccaaagugcuaugauuacaggcuugagcgaccacgcccggccaauagaguuaaaaauuaaagucuaaaaacaaaaaaccauucccauuuucuauuacucccuccccuacaaccauaaaagucucaggugccagaccuucucauccuccucuucuuccucuucacuggacuccacaucauccauguccucuuccagagcacuaacucgaggcuccaguugcucagcuuccucuaauacauagcguuucuacagagaaaaugaugagaguuagggguuguugccauuuccccuauuucuugaaaccucaacacugggcuucaggguuccaaggagcaacagcugaggcaauuucauuucaaagacaguucaagauuuuccuaacaaguuuaauagaccugaaaucuauaaaguucuccuauaaacauaaauacaaaccugaagagaacaucuucauuuucuauugacucuauucccuguaccuuauacucuaaagucaugggaauaucaaucaguauagguacagccuagaaccaaaaguaagggcuucacacacagagaaaauccaagggcuaauaaguucauggcugguaguuccacuagaagaggccuagcccuagaguaguaccaaaucuccaguagacccaggaucucgggagcuguugauauucaugcauuuugaacugguuccauuuuaaucugggauauggcuuagcaauguuuauuugaguggcuaaggaucagagaggcaaagcugauuucaaaaaugccaaauggcuaaauguaguggcauguacccguggucccagcuccuugggagacugagguaggaagaucccuugagcccaggaguuuaagaacagccugggcaacacagcaagacauugucuugcuauaagaauugggcccucaaaguagguuuucaaauuuauaaucucauucuuuccacuacaugcccuacagugccaacauggaacaggagagcuguaucacacucauuuccugaaaagaugccucauggauaaucguuuaucacuaggaaagggaagcaggauggugaaggcaaguuuaaggaauuaauggcucagucucccacuccuggcccuauuuuuaucuguuuuauguccuggcuuuuuacaugaagauuaguuuaaaaaaaacguucaugaaguuaaaaacucccuaccuacucuagcuacaauacccuugauguaacauccugaauaaauuucuuuuuucaugauagacagguaaugugcugacuuuguaacaagguuugagggaggcacaacucacacaugcaccugaacuacaaaaggauggagaaaaacaaaguuuccuuguuuuaaaccauucacuuuuaaagcccuacccuucaaauauuuuaucuauuuuccucucacucccaauccacuaucuugggacucccagacaggaagacuauucauuaagaggacccauaagauccacaggcuucaguguuuaagcuguguguauguguuugucugucugcccgucuaggaagagaagggugacucugguaacagacuuuuauuucuuaccuguagucggggcagaaugauaucacagacucucucacugugcaauaguucaucaauaaacucaucaacaugcaucaauucaaacucugcaagaaaaagucauuagagcaaacaaccuggaaauaaaagauuuagaugccaaaaaguaaaagaaguguuaagacuucauaucaggacaucuaugugcuaggccucuuuagaagagauuaagggaugaaugaagaugucccaauuagcaggagacaaacacaaaaacaagcacaaacaguccugaauuauguagggaugaucuugaagagaucauauaacuuaaauauaauuucucaucugaaccuucaauguuucugaauuuagaacauguaucuuauauggcacauggagugauagcuuuugagaacuggcuaggagugguggcucacgccuguaaucccagcacuuugggaggccaaggcaggcagaucacuugagguuaggaguucaagacaggccuggccaacauggcgaaaccccaucucuacuaaaaacacaaaaauuagcugggcaugguggugggcacauguaaucccagcuacucaagaggcugaggcaggagaauuauuugaaccugggaggcagagguugcagugaccugagaccacaccacugcacuccagccugggcaacagagugagacuccaucucaaaaaaaaaaaaauuauaugucuauauauauguguguguguguguauauauauauauacaucuauauauauauaaaaguaucauuaaccucacuuuacauaggagaaaacuaaauuuaaguaauuugcguaagauuauacuacuaguauauggcagagcugagguguuuuuaauaaggaaauauuguuuuuggcuagaguuagaaaaaaaauuuuuuuuugagacggagucucacuuuugcccaggcuggagugcaguggugcaaucuuggcucacugcaaccuccgccucccggguucaagcaauucugcugccucagccuccuggguagcugggauuacaggcaauuuauauuauauauaaauuauguuauauauaaauuauguuauauauaaauuauauaugauuauguauauuuauauauuuguauguaaauauaauuauaaaauguauauauauguguguguauauacacauauacaaauacauauauauacauacauacauauacauauauagcuuuugagaacuuccaugguaaacauuaccuuacuucugggguucucaaccaugggcaauuuugcacaugcccaucccccuacuuagaaggagguguuacuuccaucuaguggguagaggcuagagauacugcuacucauucuaugaugcacaagccaauccucacacaaaaguuauaugacccaaaaugucaauagguucagaaauucuuaguuuuacguaauaaaauaauaaauaaauaacuccaucauggccaugaccauguccaucuuguucaccaugguauuuacaccacauagcacaguaugugacaugucaauggcacuuaauauguauuuauucaaugaaugaaucaauaaguuuaaaguauaauaccaaauucuauuuuuuuaagauggagucuugcucugucgcccaggcuggaauacagcggcgugaucucggcucacuacaaucuccgccuccugguucaagggauucuccugccucagccuccugaguagcugggauuacaggugugcaccuccacacccugcuaauuacuguaguuuuaguagauauaggguuucaccauacugacgaggcuggucucaaacuccugaccucaagugaucugcccauguuggccuccuaaagugcugggauuagaggugugagacaccgugcuuggccccaaauucuuaaccuucuacuguuuaaugauacauguagggggaaagguaaauguuccuaucuucuguuaugacaccaagugagaaaagguuuugacugcauuaccuggaaucccuccuuagcacauuaaguaaucuccuuguagaagguauggagcugccucucuuggauauacuuauuuuucagugggauuccuguauaaaaaugaguagucuuauaugcugcagugugaauuacaguguuagaggagaggccaguagaaagaacugugaagauguaaaauauggaaaacuaauuuugucugagagggcuggggaagguuuuuauggagaagccauucugcagcuagaucuuuugggauggagcacauguaaagggggcauaugaugcaaggcagggauuaacauaagaugcacuuggaaagggagacagacagaggcaggcuggguaaggccaacacgaagcuaguagucagacugaaaacucccaugagggacaagggaaaaccugcauagagacaguaacaauguagaugaaaaggagcauucacacugucuaugacaaugcaaagguagaaguacugguaaaauaaaaacuggcuuaaaaaugacaaucaggagacuuagcaccauacuuacccccauuucgguucuggcucuugauuuuucgauagucauuguacaaagguuccaaguacuuguagcaaucaauugcagugccugucagccucauguaaagugcccccagcaugcggacauaccugagagacagaugacagugaaacaacaggccauccuagaaguuccugaguuuuacaacuagcuguucucaugacaguaguggauaaacauguucuucucuuuggcagguaagaaagcugcaauuguggagguagaaugcagcagaagaaagacagcuaaaauauggagaccugaguucaaguucccaugcuaccauuuauggcugugggaacaucauacauauugaucaacuuucaaauauaucaucaguaaaacuagaauaaaaccuauuuaccucacaggauuacucuaagaaucaaaagaaauacugaauuuuauuuuauuuuuuaaggcagagucuugcucuguugcccaggcugcagugcaguggcacgaucuuggcucacugcaaccuccgccuccugggaucaagcaauucucaugccucagccuccauguagcgaggauuacaggcgcccgccaccaugcccagcuaauuuuuguauuuuuauuuauguauuuauuuauuucuugagacagaaucuugcucuguugcccaggcuggagugcaguggcacgaucucaauucacugcagccuccaccuccuggguucaagcgauucuccugccucagccucccaaguagcugggauuauaggcaugugccaacacacccagccuaauuuuuguauuuuuaguagggaccgguuuugccauguuggccaggcuagucucaaacuccugaccucaggugaucugccugccuuggccucccaaagugcugggauuacagguguuagcaaccaugccuggcauauuuuuguauuuuuaguagagacgggguuuccccauguuggccaggcuggucuugaacuccugaccucaagcaauccaccugccuuggccucccaaagugcugggauuacaggugugagccaccacaccuggccauauauugaauuuuaaaacagaaagaagauauauuuaauaacaauacaagaacaaguacacauaaacaugacugcugguuuuggaaaaaaguaagucaucuggguucaaauucugacuccguaauuuacuaagucugugacacuacuggucaaaucauguguuuucucaauccuuguaaaacggagauaaugcuaccuaauuuauggcuugguauauaaacaagaaaugcauugaaagugcuaaguauagcacagagcacacaguaagugccuaacaaaaguuagguauuuucuagcuguuaaugcuuuauuagagucguuccagccaggggcgguggcucacgccucuaaucccagcacuuugggaggcgaggcaggugggucaccgggucaggagaucgggaccauccuggcuaacgcggugaaaugccgucucuaguaaaaauacaaaaaauuagccggguguaguggugggcgccuguagucccagcuacuugggaggcugaggcaggagaauggcaugaacccaggaggccgagcuugcagugagccgagacugcgccacugcacuccagccugggcaacagagcgagacucugucucaaacaaaaaaaagaguuguuccucuucccuuuuuccuauaucuaacuacuuaaauuuccucuuggguaacuaggaggcuuuugaaagucauaguuucuuuguacgagaagcagaauacuguagcaaagaauaugaacucugaagccagauuugccacuuacuagcuguuugaacuugggcaaaauuaauuaaucucugugccucaguuuccucuccuguagaauagggauuaaaaguuuagaagguuguugugaaagugaaaugaauuauuauaugcaaagcccuuacagcauggcacauaagaagcuauuaugucugucuccuauacuuguuugugauuuccucgagaaucgguaauacgguaauaagcugacauuuucuagguguuuaccaugcagcaagugcuguguucagagaucugcaugcauuacguucuuucacucuuauauuauagucaccauuuuacagauaagcaaaguuuagaaaauuaaguaaccucuccaaugucauaguuaaugggcaacagaaucuggaugugaacccagaucuuacaccucuuaaccaccaccuuuuguuguuugauuuucaccccugagcguccagugccuaccaacauaucaggcacucacuuuugcuuaauauguauuuagugaaucugugaaauccuuuuucagggaaaaauuaccaaaacugagaaaguaaaguagaagauuaauacaaucagaacagauaaaauacaaacuuggcagggugugguggcucaugccuguaaucccagcacucugggaggcccggggggggaggggauuaccugaagucuggaguucgagaccagccuggccaacauggugaaaccccaucucuacuaaaaauacaaaaauuagccaggcgugauggcacaugccuguaaucccagcuacucgggaggcugagacaggagaaucacuugaacccaggaaauggggguugcagugggccgagaucgcaccacugcacuccagccugggcaacacagagagacucuguuuccaaaacaaaaaacaaacaaaaaauacaaacucaagggcucaaaagcaaaaaucuggaguggaacucucuagaaaugagauacauuguguacaccccucuuaaccaaagcccaauucuaaaccgccaaaauuaaaccucuuauauuagcuagugaacauugcacucacuugaaaucuucauuuuugauaaacucuacaaugauauccuucucggguugaauuugaagcaucuucaagguuaaacacagaaaggguguugguuuuauguugccaccauagacgccacccacaaaccuuaacuccauggcuuuaucgacuacaaguucagcuaaaaaacaaaaacaauacaguaacauauuagggcuaagcucuuccuaguuggaguggaguuaguucaagcuuugguucuccuaaauauacaucaacaguguaauauuaggagaacgaauguguauuaauaacaguaacgacaacagcuaauauacauugagaauggauaauaaaauagguacccugcuaagcuuuucauauuaucucacuuaaccuuuuuuaacaagucaugaagaaaguucuagcaauguucuuauuuccagguaaggaaaaugagggcuaagaaagguaaagugacuugcucaagguccacagauugucacaggacauggauuuaaagccacaauucaaaucggaagauuaccuggaagacuucucugaagcacugauauuuauaaauacuggaaccggcccagaucuaagaauaguaagaucaugaauuugguuucaggcauauuaacguuagguccuuaaagaccuucaacagauugugucaaaguguuauauccggaucccugagcuuaacacuguugcaacccagccugcuaucauuaaauacggaauaacucacaacacccaacugagacagccuucagaauaugaccuuaccagauucaucugugccucuaauacucaacacaagacgaggcacuuagcaggcacucaaaauuuuucugaaugaucgacauacuccguuccaguaccacccccagaggccagucgcuaguccuacccgcgcucggucaggagaaaugggccacaagggggcugagaggcgcuccgcgcgcuuccacuuaccuguaaguccaaagcacuccucuuuccaguacuuggacucauagauucgcguucgaaugaucuucuccaccagauauugaggguuggugccauggaugcugugcgcauccuucacuguacgguuagccauuuuagaaugccuucaauucuauuuccgucggauccuuuaaugccucacauccagguucagaaaaagcaccuagaggaauggagaaagguggaagaaguuucacuaaacagcuuaggcgaccaucuugaagccggaaacaccguaguguaaagggcuuccgcuccccgcgucgccuaucgaaucaaugauggcggcugcauguu

SEQ ID NO: 191390 - RNA, 13774 nt, Homo sapiens
aacaugcagccgccaucauugauucgauaggcgacgcggggagcggaagcccuuuacacuacgguguuuccggcuucaagauggucgccuaagcuguuuagugaaacuucuuccaccuuucuccauuccucuaggugcuuuuucugaaccuggaugugaggcauuaaaggauccgacggaaauagaauugaaggcauucuaaaauggcuaaccguacagugaaggaugcgcacagcauccauggcaccaacccucaauaucugguggagaagaucauucgaacgcgaaucuaugaguccaaguacuggaaagaggagugcuuuggacuuacagguaaguggaagcgcgcggagcgccucucagcccccuuguggcccauuucuccugaccgagcgcggguaggacuagcgacuggccucugggggugguacuggaacggaguaugucgaucauucagaaaaauuuugagugccugcuaagugccucgucuuguguugaguauuagaggcacagaugaaucugguaaggucauauucugaaggcugucucaguuggguguugugaguuauuccguauuuaaugauagcaggcuggguugcaacaguguuaagcucagggauccggauauaacacuuugacacaaucuguugaaggucuuuaaggaccuaacguuaauaugccugaaaccaaauucaugaucuuacuauucuuagaucugggccgguuccaguauuuauaaauaucagugcuucagagaagucuuccagguaaucuuccgauuugaauuguggcuuuaaauccauguccugugacaaucuguggaccuugagcaagucacuuuaccuuucuuagcccucauuuuccuuaccuggaaauaagaacauugcuagaacuuucuucaugacuuguuaaaaaagguuaagugagauaauaugaaaagcuuagcaggguaccuauuuuauuauccauucucaauguauauuagcuguugucguuacuguuauuaauacacauucguucuccuaauauuacacuguugauguauauuuaggagaaccaaagcuugaacuaacuccacuccaacuaggaagagcuuagcccuaauauguuacuguauuguuuuuguuuuuuagcugaacuuguagucgauaaagccauggaguuaagguuuguggguggcgucuaugguggcaacauaaaaccaacacccuuucuguguuuaaccuugaagaugcuucaaauucaacccgagaaggauaucauuguagaguuuaucaaaaaugaagauuucaagugagugcaauguucacuagcuaauauaagagguuuaauuuuggcgguuuagaauugggcuuugguuaagagggguguacacaauguaucucauuucuagagaguuccacuccagauuuuugcuuuugagcccuugaguuuguauuuuuuguuuguuuuuuguuuuggaaacagagucucucuguguugcccaggcuggagugcaguggugcgaucucggcccacugcaacccccauuuccuggguucaagugauucuccugucucagccucccgaguagcugggauuacaggcaugugccaucacgccuggcuaauuuuuguauuuuuaguagagaugggguuucaccauguuggccaggcuggucucgaacuccagacuucagguaauccccuccccccccgggccucccagagugcugggauuacaggcaugagccaccacacccugccaaguuuguauuuuaucuguucugauuguauuaaucuucuacuuuacuuucucaguuuugguaauuuuucccugaaaaaggauuucacagauucacuaaauacauauuaagcaaaagugagugccugauauguugguaggcacuggacgcucaggggugaaaaucaaacaacaaaagguggugguuaagagguguaagaucuggguucacauccagauucuguugcccauuaacuaugacauuggagagguuacuuaauuuucuaaacuuugcuuaucuguaaaauggugacuauaauauaagagugaaagaacguaaugcaugcagaucucugaacacagcacuugcugcaugguaaacaccuagaaaaugucagcuuauuaccguauuaccgauucucgaggaaaucacaaacaaguauaggagacagacauaauagcuucuuaugugccaugcuguaagggcuuugcauauaauaauucauuucacuuucacaacaaccuucuaaacuuuuaaucccuauucuacaggagaggaaacugaggcacagagauuaauuaauuuugcccaaguucaaacagcuaguaaguggcaaaucuggcuucagaguucauauucuuugcuacaguauucugcuucucguacaaagaaacuaugacuuucaaaagccuccuaguuacccaagaggaaauuuaaguaguuagauauaggaaaaagggaagaggaacaacucuuuuuuuuguuugagacagagucucgcucuguugcccaggcuggagugcaguggcgcagucucggcucacugcaagcucggccuccuggguucaugccauucuccugccucagccucccaaguagcugggacuacaggcgcccaccacuacacccggcuaauuuuuuguauuuuuacuagagacggcauuucaccgcguuagccaggauggucccgaucuccugacccggugacccaccugccucgccucccaaagugcugggauuagaggcgugagccaccgccccuggcuggaacgacucuaauaaagcauuaacagcuagaaaauaccuaacuuuuguuaggcacuuacugugugcucugugcuauacuuagcacuuucaaugcauuucuuguuuauauaccaagccauaaauuagguagcauuaucuccguuuuacaaggauugagaaaacacaugauuugaccaguagugucacagacuuaguaaauuacggagucagaauuugaacccagaugacuuacuuuuuuccaaaaccagcagucauguuuauguguacuuguucuuguauuguuauuaaauauaucuucuuucuguuuuaaaauucaauauauggccaggugugguggcucacaccuguaaucccagcacuuugggaggccaaggcagguggauugcuugaggucaggaguucaagaccagccuggccaacauggggaaaccccgucucuacuaaaaauacaaaaauaugccaggcaugguugcuaacaccuguaaucccagcacuuugggaggccaaggcaggcagaucaccugaggucaggaguuugagacuagccuggccaacauggcaaaaccggucccuacuaaaaauacaaaaauuaggcuggguguguuggcacaugccuauaaucccagcuacuugggaggcugaggcaggagaaucgcuugaacccaggagguggaggcugcagugaauugagaucgugccacugcacuccagccugggcaacagagcaagauucugucucaagaaauaaauaaauacauaaauaaaaauacaaaaauuagcugggcaugguggcgggcgccuguaauccucgcuacauggaggcugaggcaugagaauugcuugaucccaggaggcggagguugcagugagccaagaucgugccacugcacugcagccugggcaacagagcaagacucugccuuaaaaaauaaaauaaaauucaguauuucuuuugauucuuagaguaauccugugagguaaauagguuuuauucuaguuuuacugaugauauauuugaaaguugaucaauauguaugauguucccacagccauaaaugguagcaugggaacuugaacucaggucuccauauuuuagcugucuuucuucugcugcauucuaccuccacaauugcagcuuucuuaccugccaaagagaagaacauguuuauccacuacugucaugagaacagcuaguuguaaaacucaggaacuucuaggauggccuguuguuucacugucaucugucucucagguauguccgcaugcugggggcacuuuacaugaggcugacaggcacugcaauugauugcuacaaguacuuggaaccuuuguacaaugacuaucgaaaaaucaagagccagaaccgaaauggggguaaguauggugcuaagucuccugauugucauuuuuaagccaguuuuuauuuuaccaguacuucuaccuuugcauugucauagacagugugaaugcuccuuuucaucuacauuguuacugucucuaugcagguuuucccuugucccucaugggaguuuucagucugacuacuagcuucguguuggccuuacccagccugccucugucugucucccuuuccaagugcaucuuauguuaaucccugccuugcaucauaugcccccuuuacaugugcuccaucccaaaagaucuagcugcagaauggcuucuccauaaaaaccuuccccagcccucucagacaaaauuaguuuuccauauuuuacaucuucacaguucuuucuacuggccucuccucuaacacuguaauucacacugcagcauauaagacuacucauuuuuauacaggaaucccacugaaaaauaaguauauccaagagaggcagcuccauaccuucuacaaggagauuacuuaaugugcuaaggagggauuccagguaaugcagucaaaaccuuuucucacuuggugucauaacagaagauaggaacauuuaccuuucccccuacauguaucauuaaacaguagaagguuaagaauuuggggccaagcacggugucucacaccucuaaucccagcacuuuaggaggccaacaugggcagaucacuugaggucaggaguuugagaccagccucgucaguauggugaaacccuauaucuacuaaaacuacaguaauuagcaggguguggaggugcacaccuguaaucccagcuacucaggaggcugaggcaggagaaucccuugaaccaggaggcggagauuguagugagccgagaucacgccgcuguauuccagccugggcgacagagcaagacuccaucuuaaaaaaauagaauuugguauuauacuuuaaacuuauugauucauucauugaauaaauacauauuaagugccauugacaugucacauacugugcuaugugguguaaauaccauggugaacaagauggacauggucauggccaugauggaguuauuuauuuauuauuuuauuacguaaaacuaagaauuucugaaccuauugacauuuugggucauauaacuuuugugugaggauuggcuugugcaucauagaaugaguagcaguaucucuagccucuacccacuagauggaaguaacaccuccuucuaaguagggggaugggcaugugcaaaauugcccaugguugagaaccccagaaguaagguaauguuuaccauggaaguucucaaaagcuauauauguauauguauguauguauauauauguauuuguauauguguauauacacacacauauauauacauuuuauaauuauauuuacauacaaauauauaaauauacauaaucauauauaauuuauauauaacauaauuuauauauaacauaauuuauauauaauauaaauugccuguaaucccagcuacccaggaggcugaggcagcagaauugcuugaacccgggaggcggagguugcagugagccaagauugcaccacugcacuccagccugggcaaaagugagacuccgucucaaaaaaaaauuuuuuuucuaacucuagccaaaaacaauauuuccuuauuaaaaacaccucagcucugccauauacuaguaguauaaucuuacgcaaauuacuuaaauuuaguuuucuccuauguaaagugagguuaaugauacuuuuauauauauauagauguauauauauauauacacacacacacacauauauauagacauauaauuuuuuuuuuuuugagauggagucucacucuguugcccaggcuggagugcagugguguggucucaggucacugcaaccucugccucccagguucaaauaauucuccugccucagccucuugaguagcugggauuacaugugcccaccaccaugcccagcuaauuuuuguguuuuuaguagagaugggguuucgccauguuggccaggccugucuugaacuccuaaccucaagugaucugccugccuuggccucccaaagugcugggauuacaggcgugagccaccacuccuagccaguucucaaaagcuaucacuccaugugccauauaagauacauguucuaaauucagaaacauugaagguucagaugagaaauuauauuuaaguuauaugaucucuucaagaucaucccuacauaauucaggacuguuugugcuuguuuuuguguuugucuccugcuaauugggacaucuucauucaucccuuaaucucuucuaaagaggccuagcacauagauguccugauaugaagucuuaacacuucuuuuacuuuuuggcaucuaaaucuuuuauuuccagguuguuugcucuaaugacuuuuucuugcagaguuugaauugaugcauguugaugaguuuauugaugaacuauugcacagugagagagucugugauaucauucugccccgacuacagguaagaaauaaaagucuguuaccagagucacccuucucuuccuagacgggcagacagacaaacacauacacacagcuuaaacacugaagccuguggaucuuauggguccucuuaaugaauagucuuccugucugggagucccaagauaguggauugggagugagaggaaaauagauaaaauauuugaaggguagggcuuuaaaagugaaugguuuaaaacaaggaaacuuuguuuuucuccauccuuuuguaguucaggugcaugugugaguugugccucccucaaaccuuguuacaaagucagcacauuaccugucuaucaugaaaaaagaaauuuauucaggauguuacaucaaggguauuguagcuagaguagguagggaguuuuuaacuucaugaacguuuuuuuuaaacuaaucuucauguaaaaagccaggacauaaaacagauaaaaauagggccaggagugggagacugagccauuaauuccuuaaacuugccuucaccauccugcuucccuuuccuagugauaaacgauuauccaugaggcaucuuuucaggaaaugagugugauacagcucuccuguuccauguuggcacuguagggcauguaguggaaagaaugagauuauaaauuugaaaaccuacuuugagggcccaauucuuauagcaagacaaugucuugcuguguugcccaggcuguucuuaaacuccugggcucaagggaucuuccuaccucagucucccaaggagcugggaccacggguacaugccacuacauuuagccauuuggcauuuuugaaaucagcuuugccucucugauccuuagccacucaaauaaacauugcuaagccauaucccagauuaaaauggaaccaguucaaaaugcaugaauaucaacagcucccgagauccugggucuacuggagauuugguacuacucuagggcuaggccucuucuaguggaacuaccagccaugaacuuauuagcccuuggauuuucucugugugugaagcccuuacuuuugguucuaggcuguaccuauacugauugauauucccaugacuuuagaguauaagguacagggaauagagucaauagaaaaugaagauguucucuucagguuuguauuuauguuuauaggagaacuuuauagauuucaggucuauuaaacuuguuaggaaaaucuugaacugucuuugaaaugaaauugccucagcuguugcuccuuggaacccugaagcccaguguugagguuucaagaaauaggggaaauggcaacaaccccuaacucucaucauuuucucuguagaaacgcuauguauuagaggaagcugagcaacuggagccucgaguuagugcucuggaagaggacauggaugauguggaguccagugaagaggaagaagaggaggaugagaaggucuggcaccugagacuuuuaugguuguaggggagggaguaauagaaaaugggaaugguuuuuuguuuuuagacuuuaauuuuuaacucuauuggccgggcguggucgcucaagccuguaaucauagcacuuugggaggccaaggcgaguggaugaccagcggucaggaguucaagaccagccuggccaacgugguggugaaaccucgucucuacuaaaaauacaaaaauuagccagcguuguggugggugccuguaauccuagcuacccaggaggcugaggcagcagaauugcuugaacccgggaggcagagguugcagugagccaagaucgcaacacugcacuccagcuugggcaaaagugagacuccgucucaaaaaaaauuuuuuuucuaacucuagccaaaaacaauauuuccuuauuaaaagcaccucagcucugccauauacuaguaguauaaucuuacgcaaauuacuuaaauuuaguuuucuccuauguaaagugagguuaaugauacuuuuuuccccaagacuguuaaaaguauuaaauaagauuauaaacuuaaagcccuuagcagaguauuggcacauuauaauugccuaauaaaugguggcagcuauuaaauacuuggaaagaaagaacacuuucauaauugcaccuauccuaaggaauaaaccuuguuuaggagggggaaaaugucaaccgcauagucauguucuuucaguacuaguuacggugcugaaaaguugaaaacaaccaagcugcccaguuguuccaggaagcaaacuuuuuuuuuuuuugagauagggucuugcucuguugcccaggcugaggugcaguggcucacugcauucucggccucccaggcucaagcagucuucccaucucagccucccaaguagcuggaacuacaggcacgugccagcauaccuggcuaauuuguguauuuuuuuuguagagaugggauuucaccauguugcccaggcugcagauaaacuaaacauacacacauacacacacacaggucuguuucuguucccucuccuaugagucauuuuggcugucuuauauagcucauaauaaguuuuguuaguuaauaggguaagugcuucccucuuuguagucagguuacugugcuuuaaagucacauggagauggacuuugggacaagauggggcgugaaguauaauuaguguuccuagauggcucuuuauaagccugugccuuucaaugacccaaucaucuuguuuccaguuggaaagagugccaucaccugaucaccgccggagaagcuaccgagacuuggacaagccccgucgcucucccacacugcgcuacaggaggaguaggagccggucucccagaagguaaagccuagucauuggccuuuucccagaagauuuugagcacuguagccuagaaguuuggauuuuagagaaggaaaaaugcacgucuauggagaauguuugcccaauauauuaguuaucuguugcugcaaaacaaccaccuauaaaaccucauuggcagacaacaauaaccauuuguuccuuucacaagucugcagucaaugauuuaagcagagcuuggauaggcaguuuuuaaaguaccuguucuguugucggcugucuacuggcugguauggaauugccuuagcuuggaugacgggggaaauuucucuucucugugucauccucuagcaggcuaaguugggcauauucucaugguaguggcagaacucaagagcaaacaaacccggucaugcaaauguuuuuccaguaucugcuuuuaucacauuugcaaauaucucauuagccaaagcgagucaugucaccaguccuaaaguuagaaugggagggugcuagaguuacgugacaaaagacauggauacagaggugggugauacagagaagcgugaaggauaagauuggggccguuuuugcaaucuaccacauccagugcgccaaccuaggcuuucuucuuccucuccucuuuauaggcggagucgaucucccaaaaggagaagguaggccuucagucauuugugaugaaggauagggcuuuggggaggggguggugguauugguguuauauguauauugcuaaccagaucugguagucugaccagucuuuucuacagccccuccccucgccgagaaaggcaucggagcaagaguccaagacgucaccgcagcaggucccgagaucggcggcacagaucccguuccaaguccccagguaaagcuugugggccuuuugccacagguugucuuaacaaagaaauguaaaaggaguaguuagccuccugcaguacaggagugccugacuguacugccuaacagaaaagcaaauggacauagaauuugaaaauuaagguucacagcuugacugucacuuauaagcuuugcugauaagguuugcuuuaguuuuuucaucuaaaauuggaggaauaagaucuaacauaauagugaaaacccaauaugauguuugugaaauuagucauaaagcccuugaauguauauguauuugaacugguuucauuacuacuuucuuugcucccucuuccuccacuaauucagaguugcuuccacuaagagguguccccugcauaggccaaaagaauauuaagccaauggcagguauuaggggaggugagaaugacaguuuaauaagaguagaaggguaggaucuuaugcaauggccuuuucuuccccaggucaucaccguagucacagacacaggagccacucaaagucucccgaaagguaaugaauugaccucuauuuuaacuuuacagaaauaguccaaauuacaacuaacuggaccugaaauuuucuuguuuuguugggggauguuaggaauucuccugcauuacaagacaaaauuggucuauugcuuugagaauuacugggguuagauaacuuuuucuuuuuucucuuuuuugagaacugaguuucgugcuugucucccaagcuggagugcaguggcgugaaccuggcucacugcagccucugccucccggguucaagcugauaccuguuuugcuuuacaggauugcagcuuuggacaauggaugagcuuuggucucagaaaacaugggguuuagucccaaguuuuaaaacuuaacaguugagugaccuuggacaagucacuuucauuugauaagauuucauuagaaacccccaugugccauauaccguugggugcacucuuuuuuuuuuuuuuuuuuuuuuuuuuuugagacggagucucgcucugucucccaggcuggagugcaguggcgcaaucucggcucacugcaagcuccaccuccugggcucacgccauucuccugccucagcuucucgaguagcugggaauacaggugcccgccaccacccuuggcuaauuuuuuauauuuuuaguagagacgggguuucaccauuuuagccaggauggucucaaucugaccuugugauccgcccaccucggucucccaaagugcugggauuacaggcaugagccaccgcgccgggccuguuugguguacucuuaaccucuaagaggucauuuccucaaugguaaaauuuggauaguaaugccugacucaagaguguugcucugagucaaaaaaauaccaagcaguuuaaugaauauugagugucagcuccauccccaucaaugucagcauaccaaggucuuucucaggacuccuuuuuuuuuuuugagauggagucucacucugucauugaggcuggagugcaauggcccaaucucggcucacagcaaccuccaccucccggguucaagcaauucuccugucccagccuccugaguagcugggauuacaggugcccgccgccaugcucggcuaauuuuuguacuuuuaguagagacaggguuucaccauguuggccaggcuggucucgaauuccugaccucaggugaucugccuaccuuggcaucccaaagugcugggauuacaggcgugagccaccgugccuggcugcuucuuaauauaauuauuuauauguguugccauuucaggucuaagaagagccacaagaagagccggagagggaaugaguaauggacucaguuugguuuuaguccacauggccuccuguggauauaaggauaucuguauguggaaggauuaagaucucccccaggcagcuauaagaauauuuuaguuuuuuucuuaucaaguuucucaaccuuuauuuuuaaugaaggaggugcugaguuuuguaucuuuuuaaucauaaucaacaucaguuuuugacccaacuaaccuugacuguauucaaacuuaugagaguauaaaggaucuggagguuggggauaugacugacaaggaaaggcuguggccaccugaugacccuuucccuuuuuauuaaaccggacacaccuguuucccauuucgcuguaguuuaguuuuugguuuguugugguuggaacugcuuugagaauccugggauuugugcugcugcuguuauucaaagaucaaaggaguaaaacauaguugcuccuaacuuuuuuccagcagcagcaagugguaauaaacaugaaaacugguuuguagcaguuuugaaagaauagaaugcauucaaauguaaggcugcuucuggaucauuaaagccaguuucaucaaacaguucaacagagagcagcacuuaauacccuuuauacagcccauuuuuucauaguuucauuuguucuugcccacaagcuugaaauccagguuaagguauccagccuuuaucauauaagcauugacauuauccaggccuagucaguagcaguaggguaacgggauugaaaaagauuugauggagaggaaaguaucuaauauuagucaugguuuugaccuaaauugcuagacagucgugccauucacaaagucagaaaauacagcaggaagagacagcuuuuagaggggcagagaauuagaggauggugguaguaaugaaaaugaugcauucaguuuaacaaguuuaauuugagacagcuaugguauagcuaaaaacaaaagcccauaaaguuggagauagggaccagaguuuaacauagcgaucuaggccagaauugacaauguuuaaguaaugguggaaucugucaauaagacuucccagaguguuaauauauaucagaaaugcacacaacagaaccauaggcaacaccaacacaggaagaaauagaagucaccuauugaaaacuggaauggcccauucagaaagacaggagaauuaggagagagugagugaaagaagccaagggucaagaaugcagaagcaaaggaaggacuaaaaagccuccacggacaucgauaaucaagagauuauuaagaucuuugcuagaagaguuccuuuaccuguacuuaacucccuuaaaaagagaaaagugauggaaugacuucugcaacuguagucccagcaggaacugugaagaccagcugcccugcaggauccaguuuuucuugggagguuguaucuggucauaagguaaacauucuauauauucuaugccugcucuagaauugaaagacuucagcaguauuaaagcauuuuuuaaucuuauuugagcuuucauauucuucaaugguuccuuucguaauaccugaguuaauaaaaguggucugaaagagcucuuacgguuucugauagaacuauauaggacuaccuuuuaagauuaaauauaagcaucuguacguaaaugua

SEQ ID NO: 191391 - RNA, 31643 nt, Homo sapiens
acggucugggggcggggccacgccgauuggcgcgaaguuuucuuuucuccuuccaccuucuuuucauuucuagugagacacacgcuuugguccuggcuuucggcccguaguuguagaaggagcccugcuggugcagguuagaggugccgcaucccccggagcucucgaaguggaggcgguaggaaacggagggcuugcggcuagccggaggaagcuuuggagccgggugaguguggcguccagcgggcugcgagggacucgggggagggcgcaucggaaccucugaaacugaggacguucucuguagacucagucauugauucuuuuagcugacauguaccaagcgccuguucagugccaggcacuguucugaacuguuaagagcguuccucuguuccacacuccgauuccuaaaaggcuucccgcgcugcagggaacugaguuugcaggggggaaggcggaagccaacagccuagaagcaggagcauuccugcccuccgcacccugaugcucagugaugacuuucccuccaucugcauuuguaaagcacucuacuuguuucguucuuugagcuauaguguaggaaccacuacagggaaggcggagcagagguuauuaccccauuuuacggacguaaauugcgcccagggagggacgugucuuaggucgcuuuucgugacuaagcagucugggcuccuacccagaucuuuuuuucagaugagcuccuaacugcugggcugucugucauucaccuucuuuucagaagagaagucugguggcccccuuccuacuucucuuuucuaaccccggaauugaagagucuucugcugugacaguuggaaaaggcauucuuauccugaucuauuugugaaacugcaaugauuauauacgauucuaguugucuguaacacaugaauaauaguacccucgucucugcuguguuaggugggcuggaaaugccaaaggaguuuccaauaugacagaaugguuuaagucccuuugcaacaguuuuuaacuuuaauggagggcaauauguggacuuuaggagguuugugaaucugccgaaauugaaugcaaaauuuugcuugaauuauguuaguuccauaguauucaucaaaugauacuuaauaaauaaaaccacuguaccuuacaaauaaaugcaagggauuaagguagugggaaaguggauuuaccauuuugcauuuuuucacuuaaucuuccauuauccuaaaauagugccuggcacacgauggguacuuaauaaauauugguugaauaaacggaagauucuauuuucuccauuuuguggguaagcaaauugaggcccaauccacaauguucagucaguggcugggaagccugauuuauuguaauaaguacaccaaaagcaagcucucaguuacauauuaacauuauccaguuucacacaguguguuguaaggugaaguaguuaagagcacaguaauugcagucuggcuuuuccggguuugaguuaaggcugugccauccuguauaagauaggauaaguuaucaccuugaagugauaauaacaucuacuuuucuuuuuuuuauuuugagacagaguucugcucugucacccagacuagagugcaguguugcgaucucggcucacugcagccuccaccucccggguucaagugauuugccugccaccaugcccaccugauuuuuguauuuuuaguagagacgggguuucaccauguuggccaggcuggucccgaacuccugaccucaggugauccacccaccucagccucucaaaaugcugggauuacaggcgugagccacugcgcccagccuuuguauuucuguuuuauccuugugugcauuuuauaagcgucaugaagacauuuacaaccccuguaucacugucuuuuaauuucacuuuguuagauguuuuacaccuauuguucugccuuauuccuaguauuucuaaauguuacaguuucauuucuuaggaauugaccuuucuguuuuccuggauggaaagagauacggcauaguacaagauggacacagaugauacuaaauugccuguguguaaucuucguagaccaugacuucaaauaaaauguuuucuuagucuaaaauguaugggaguguagcaggggcagaaaauaagucugaucucauuugaagggagggacugacuaugucuuagaauccaucagauaaauaccaaauauuuaucaugguaacucagaguuuggacucuuccacagaagccauggcacacuaccccacaaggcugaagaccagaaaaacuuauucauggguuggcaggcccuuguuggaucgaaaacugcacuaccaaaccuauaggugagugaugggguccuuugguuguccuggaaauacagcuucucaagcuaaacagucaacuuguaucuagccuguucuaauuacuacagauugaccaugaaugaacaggagauuagaacugauuguaaggaggguuuuguuugaugcaagaagauggugggauaaauauagcaguuagugauggagcaaaauuauggcaggcucauaaaauuuuguauguaggauaaugucaugucuauuuaaggugaguucuauauaacuuuugaugaaaacgagaugauagauguuuuuacuaugucuuucccagcccuggagaucucugacaauuugacauuguuacugggcagcuugacagccuugggaaacauuuguugugggaagcauuuguuguucuuugucaauaacugagaggaauuaggguuccuaauaagaccuuuggauucauuacucagcuaaaacaauucauucaacccauuuugccuauucuuaaauauaacugggcgaauugguuucccaguaggagaguuggucagcagaaagaaaucaggauuggagagcccucuccuuugugcccaggggaucugaagagcuugacccacuuuaaguuauuuccuaaugugcuucucuguuacuuccuagagaaaugugugugaaaacagaagguuguuccaccgagauucacauccagauuggacaguuuguguugauugaaggggaugaugaugaaaacccguauguugcuaaauugcuugaguuguucgaagauggugaguuugggacuggaauaauaaaccauuccuugucaugaaugauugggagguggggagauuguggauucuuuuguucacagcagugugcagggcacauuagacugaggugggaucacguaagaacuagcugcgucuucuuccaucuaaaaaauuucuuuacucaccaaagcaguauugaguaaaacggaacuggaaggcucaauaauuuaacuuuuucauuauuuuggggaguaagcaaggcuauuaaggcagaauugggggggauggagagaauggaugaauuugggggaaagggagaaggaaaaaacagguaauuuguacuaucauagagauguguccuuuaguuuuggcaugaagguuaguaauauauuuugcaagugcuacuucguuacaagugaagagguaaguuggauuuggaagguguagcaauugggguuucagucagggaaaacaaaaacacuuaagauauuuuacccagaggaacuuguguguuaauguuggaaaggcuagaagaaaaggugacauuuaccagagaugaguaagugcaggaagccacggcugccccuaggcuggaggaacaaaagggaagguggcaucaaccagagccuacaagcccacaucgaaagccuuagcugauuugcugaccuucuaacccucugcaaaacaagaggagagcacagaaaugugggaguggggcacagcuccacaaggaggauuaggaagauagcaauuugaaacuaucuaaaacugccucguucaagagacagaagaagggcauggucauuagguaauccugugguagucuguaugcccaagagaaggaacugauagacugaguggauaaagauguuuuauauuacuauagucccccuuauccgugguuucaccuucugcgauuucaguuaccugacaacaaccauaguccaaaaauauuaaauggaaaauuacagaaaaaaacaagucauaagcuuuaaauugugugccauugugaguaauguggugaaaucucacgcugucccaccugaaaugugagucaucccuuuguccaguguauccgugcuguacaguauguguguguaggaaaaaucauagcauauacaggguuaguggcagcaucugcagguucaagcaucuacuggucuuggcgcguacccucagcagauaaggggagaguacugcacauagauaaggaggauuuuggacauacuuucucuuugacauacuuagaaguauggagaaaaaccucaucaaacuaauguccaguagaggcagcacaucagaaucaugggcuucgguguauagauucuagaauccucucuuggugcuccauuggaugacuuuagucuuucucugaagaaagcuaagcagggaagagaggaugaugaugaggcacuaaugaguguucuuucgguuggagcuauugcugguacggagugauacuaaucguaugcuguaauaauaaagcugaagauugcaagcauuugccagaagucaucucagugguugaugcuguaauucuugugugugugugugugugugugugugugugacagugacagaaucuugcugugucacccagacuggagugcaguggcacaaucucagcucaugcagccucaaccuccuggguucaagcaguucuccugccucagccucccaaguagcugggaugacaggcaccugccaccaugcccagcuaauuuucuuuuucuuucuuuuuuuuuuuuuuuuuuuugagacagagucucgcugugucgcccagucuggagugcaguggcgccaucucggcucacugcaagcucugccucccggguucaagccauucucuugccucagccucccgaguagcugagacuacaggcacccgccaccaugcccagcuaauuuuuuguauuuuuaguagagacgggguuucaccguguuagccaggauggucuugagcuccugaccucaugauccgcccgccucagccucccaaagugcugggauuacaggcgugagccgccgcaccuggacaauuuuuuguauuuuuagcagagaugaggucucaccauguugggcaggcuggucuccaacuccugaccucaagugauccgccugccuuggccucccagaguacugugauuacagacgugagccacugcacccagccugaugcuauaauucuugcuaggauuuuuguuuugcugcuguuugaugcugucuuuauagucacugauuuuuauuuguucguugccuguguuuagaguagcuccucucagaggccuuuuugucauuccuuugccggcugauagcaccauuaggaaauggagcaaucccagaagagcgggugugugggcuggaauuagauugcugcaguuggucaugugaccuuugacaaacucuuuaaggucccccgucacuugauuucuuugccugaaaagggggauagcuguaguaccuaccuuguaggguuauuagaaggauuaaggaucggccaggugugguggcucaugccuguaaucccagcacuuugguaggccgaggcaggcggaucacgaggucaggagauugagaccguccuggcuaacacggugaaaccccgucucuacuaaaaauacaaaaaaauaauuagcugggcgugauggcgggcgccuguaaucccagcuaauugggaggcugaggcaggagaauggugugaaccugggaggcggagcuugcagugagccaagaucaaaccacugcacuccaguccaggugacagagugagacuccgucucaaaaaaauaaaauaaaauaaaagauaacacauguugggccaggcaugguggcucaugccuguaaucccagcacuuugagaggccaaggcgggcggaucacuugaggucaagaguuugagaccagccuggccaacauggugaaacccuaucucuacuaaaaauauaaaaauuagccaggcgugguggcacaggccuguggucccagcuacucgggagguugagccaggagaaucuccugaaccagggaggcagagguugcagugagccgagaucacgccacugcacuccagccugggggacagagcaagacuccgucacaaaaaaaaaaaaaauuuuggcgggaggugguggcucaugccuguaauuccagcacuuugggaggccaagguaggcagaucacgugaggucacgaguuugagaccagccuggccaacguggugagaccucguuucuacugaaaauacaaaaauuagccagguaggauggcaggugccuguaaucucagcuacucaggaggcugaggcagcagaaucacuuuaacccaggaggcagagguugcagugagccaagauggggccacugcacuccagccugggugacagagacucugucucaaaaaacaaaaaacaaaaccacacaugucaaggguuaagcacagugucuggcacauaggaauugcucaguaaaguguccuugaguugucuuaaccuuucccuuuccaccaaauucuuucuagacucugauccuccuccuaagaaacgugcucgaguacagugguuuguccgauucugugaagucccugccuguaaacggcauuuguugggccggaagccuggugcacaggaaauauucugguaugauuacccggccugugacagcaacauuaaugcggagaccaucauuggccuuguucggguaggugaugccaccauccuugguucuaccuugaagcuuauuucugucugccuccugaacuucaugaccccagaaauauuaccggcucuaauaccccauagggaaugcauuauuuccugucaucuucugugcuugccugucuguuucaucucaacagauauuuauugagagcacguaucauguguuaggagccuccuacaagaggugacauuuggguugugaccugagggaugagcaggaauuagcagauguaucucagggggauguuauauuuagcuaugacuguggcaugcauaaagcauugugaggcugaauaugcuggcuuaaacgaggacugcaccuugaguaaaucaguacaaagagugcuaguugcuacagacaaauuuguaugacaggauuucuuaauaaaucaggugcuaaugagcggcugguuugcaggcugaaguaagucacugguuaugaguuuuuccugaagugacuucaggcuccccagcaugggauuagguugugaugugaggugugguuguaugcugauuaugugguucauugagcguuaggguagagacucucgucuggcaugauuaucuuaauuuaucuuugaguuaaaugagugaaggagagaaagcuaaaggagugugaggcagaugcaaaaguugaggcagcaggaugaguauacgcggagaggcacagggcuuggagcaucugggcaggagcacaguggugggaauagcaggacugugacaagaccucuucaaggaguauugcgcacucuguagguaaaaugaggccagaucuuagaaggcauugaaaaauuaguuuaaguaauuuggucuugcuacagugggagccauuauuggcuguugagcaggcgagcauguuuagauaaguuuguggggaaacuuggcauaggcgaacagaauggacuggaaaagaaagcaaugguaggguauaagaauaucagcuaggaggaaucugugaaaauaacccaggagugagaggaugcauauuugaacuagggugauaauaauaggaauugagagaugaacaauaaacauuuuuaaaaugaaaugaaaggaauaauuuauuucacugaugucuuuaaagugauuaaugauaaaaugaguaaauacucaguaaauauucauuauuauguguuuuucuagcaauaugcuaugccaugucuaugcgucuuuagauuggaaagguaacauuuuagguacagauguggacuucaauguuuuuaauuguagcucugauggaauacuccuuggcucucuuggggcucaucucuuccuacuuaucuauacuuccuaaauucaggugauaccuuuagccccaaaggaugugguaccgacgaaucugaaaaaugagaagacacucuuugugaaacuauccuggaaugagaagaaauucaggccacuuuccucagaacuauuugcggaguugaauaaaccacaagagagugcagccaagugccagaaacccgugagagccaagaguaagagugcagagagcccuucuuggaccccagcagaacauguggccaaaaggauugaaucaaggcacuccgccuccaaaucucgccaaacuccuacccauccucuuaccccaagagccagaaagaggcuggagcuuggcaguaaguuguggaauggaucaccgugggcaauacuggggcuaaaggguuaugugauaaaaaugauaauuuaugggaaaguauugaguuagugaucacagugcacuauagccuggaacucaagugaucaugcucaagcaauccuucugccucagccuccccaguagcugggacuacaaggguacaucacugcacuuggcuccauuuucuggguuuuuuuguuuuuguuuuuugagacagagucuugcugugucacccagguuggaaugcaauggcacaaucacgacuuauuguaggcuugaccucuugggcucaaaugauccuccuuccucagucucccaaguagcugggacuacaaguguguaccacuaugccuggcuaauuuuauuuuaauuuuuuguagcaagagggucuugccauguugcccaggcuggucucaaaguccugggcucaagugauccacccgccuuggccucccaaagugcugggauuacaggcaugagccaccaugcccaacuaucaaaguuuguguuuaauuuuaggacuucucccuuuuuuuauuuaauuuuuuaaauaugugaaacauuaauauaauucgagucaaaacuacuuaaauguacccagaaaagcacuacuccuuuccuuguccuccaacccugcuuacuccaccuucuauauguuaauuaauuguuucccuuucugguuuaucuuuccuauguuucguuuuggaaaaaucagcagauacauauacauauauguauaccuauaugcagacacacauauauuuuuauuuuucguuuucuuaccaaaaggguaguauacuggauauauucuuuuccaacuugcuuuuuccccuuacaauguaucugaaacucaccccacagccuuucugagagcucauccucaucuuguuguagucauucauccuuuuuugaauuuuuuguguaggugucaacuucaaguauaaguuacuuguauucuugauagcucuauaguacaguauguguuuuaggagcugaauauaaauguauaaaacauuuagaaaaugcagcacaaauauuaacuaaucuguaauaucaccuucagaaauuaaggggcugacugggcaugguggcucacaccuguagucccaacacuuuuggaggccgaggcggguggaucaacugaggucaggcauuugagaccaaccuggucaacauggugaaaccccgucucuacuaaaaaugcaaaaaauuagccagguguggcagcacauaccuguaaucccagcuacucgggaggcugaggcaggagaaucucuugaaccugggaggcacagguggcagugagcugagaucacgcuauugcacuccagucugagcaacagagcaagacucugucucagaaaaaaagaaagaaagaaacaagggaguuuuucuuuuuuuuuucuuuagguccucauauguccccucuucuuccucuuucaacucuguugaaauuuuaccuuucuuucaagguaugucucaaaagccaucuuuaugagcacucaggugcuucuggacacuuauuucacuuuauguaauauaauaggcagucauguguaucaucuguuagacuagaguguuuuuuguguuggaaccaggauugagccucauucagcuuuuguuuaaccucagccccuggcacacgccugccuuuuuaacugcucaguugguaucugcaaaugagcagcugggguccuuggugcugugguccucgugaugagggagcaauuccagacaguuuuguguauucacagaaccaguggauuguccccaggaaccccacuucucucuauuggcagauauaaucuggguuaagaaaaaucuuggccucauuguuacuugauagcaucucuaguauaaaucucuucaaaugucauugaguuaggguugaaggcaugcgaugucaccccugauugagacccacuguucugauagguuauuucagggaaaccuguuagagaugagaaaacacuccauuuaucugcaaaagcugacuuaaaaguugacuuaugguucuaacuaggaaaaucacuccuaaaauuuaggugagagaugaaaaauuauuagagcuaccugggcuggagaaagcaagccuggaaugauuaaaaauauagauaauuccuguuuuacauauaacucaguggcugaauuuggcugugaugagauuguggguuuguauauuguuagguaaaaaauuuacacauugugaugauuucucuuagacuuagguaacccucagaugucccagcagacuucaugugccuccuuggauucuccaggaagaauaaaacggaaaguggccuucucggagaucaccucaccuucuaagagaucucagccugauaaacuucaaaccuugucuccagcucugaaagccccagagaaaaccagagagacuggacucucuuauacugaggaugacaagaaggcuucaccugaacaucgcauaauccugagaacccgaauugcagcuucgaaaaccauagacauuagagaggagagaacacuuaccccuaucagugggggacagagaucuucaguggugccauccgugauucugaaaccagaaaacaucaaaaagaggugaccagggacauuacccacagagcaaauugaaauccuucacaucacgugaaguaugugagucauagucaaaaaaguuagaacaguaguugaaaaaccuaugucacagaaguauuggggagcuuucuuaaaauacagauuucuaggccucuucccacaccuagugagucagacuccaagcacuggcccuaggaaucuguauuuggaaaugcucuucagaugguuccaguauaccgagcuguuauuuggggaucauugcuauagaagauaacuucccaaaccugcauugcuauccaguuugggauuucauuaguuccuguggcuuuuugccacacuuuaacagucauuuuuuaaagcaguuuuucauuguuguuguuguuucauuuuauuucaauaguuuuuggggaacagguggucuucgguuacauggguaaguucuuaaguggugauuucugagguuuuggugcaccugucaccugaccaguguacauuguacccuauauguagucuuuuaucccucacccaccuuccacccuuccccgaguccccaaagucccuuauaucauucuuaugccuuugcauccucauagcuuagcucccacuuauaagugagaacauaugauauuugguuuuccauuuccaagucacuucacuuagaauaauggucucaucuccauccaaguugcuggaagugccauuauuucauuguuuuauggcugaguaguauuccaugguaaauauguaccacauuuucuuuauccacucauugguugauggguauuuaggcugguuccauauuuuugcaauugcaaauuguacugcuauaaacaugcgugugcaugugucuuuuuuuuaauauaaugacuucuuuuccuuuggguagauacccaggagugggauugcugaaucaaaugguggaucuacuuuuaguuauuuaaggagucuccacacuguuuucuauagugguuguacaaguuuacauucccaccagcaguguagaaguguucccuuuucuggcugggcgcgguggcucacuccuguaauccuagcacuuugggaggccgaggcgggcggaucacaaggucaggagaucaagaccauccuggcuaacacagugaaacccuaucucuacuaaaacauaaaaaauuagccgggcuugguggugggcgccuguggucccagcuacuugggaggcugaggcaggagaaugcugugaaccugggaggcggaguuugcagugagcggaggucgcgccacugcacuccagccugggcgacagcgagacuccaucucaaaaaaaaaaaagaaguguucccuuuucaccacauccacaccaacaucuauuauuuuuugauuuuuuaaauuauggccauucuaacaggaauaaggugguauuucauugugguuuuaauuugcauuucccugauaauuagugcuguugaauauuuuuucauauguuugcuggcuguuucuguaucuucuuuugugaauugucuauucauguccuuugccuacuuuuuuuuuuuaccuuuuguuuuuuuuuuugagcgggagucuugcucuguugcccaggcuagagugcaguggugcgaucuuggcucacuacaaccuuugccuccuggguucaagcaauucuccugccucaaccuccugaguagcugggacuauaggcacucaccaccacgcccgacuaauuuuuguauuuuaguagaggugggauuucaccauguuggcuaggcuagucucgaacuccugaucucaagugauccacccaucucagccucccagagugcugggauuauaggcgugagccaccgcacccagcucuuugcccacuuuuugaugggauuauuuguuuuuuucuugcugauuuguuugaguuccuuguagauucuggguauuaguccucuguuggaugcauaguuugcaaauauuuucucccacucuguggguugucugcugauuauuucuuuugcugugcagaagcuuuuuaguaucauuaggucccauuuauuuauuguuguuuuuguugcauuugcuuuugggguucuaagucaugaauucuuugccuaacaaugucuagaagacuuuuuccaauguuaucaucuagauuuuuuuuuuuuuuuuuuugagauggagucucacucugucugacgcccaggcuggagugcaguggcaugaucucagcucacugcaaccucugccucccggguucaagcaauucuucugccucagccuccugaguagcugggacuaccagcgcgagccacuacaccuggcuaauuuuuguauuuuuaguagagacgggguuucaccauauuggccaggcuggucucgaacuccugaccuugugauccaccugccucagccucccaaaguacugggauuacaggcgugagccacugcgccugcccguuaucuucuagauuuuuuaugguuucagguuuuagauuuaagucucugauccaucuugaguugauuuuuguauaagaugagagaugaggauccaguuucuuucuucuucuuuuuuuuuuuuuuuuucuuuuuuuggagacagaguuuugcuguuguuguccaggcuggagugcaauggcacgaucucggauuacugcaaccuccgccucccggguucaagcgauucuccugccucagccucccgaguagcugagauuacaggcaccugccaccauacccagcuaauuuuuuguauuuuuaguagagacaggguuucacuguguuggccaggcugaucucaaacuccugaccucaggugauccacccaccucggcuucccauuuuuguauuuuuaguagagacaggguuucaccauguuggccaggcugaucucaaacuccagaccuuaggugguccacccacgucggccucccaaagugcugggauuacaggcgugagccaccauggccggccccaguuucauucuucuacauguggcuugccaauuauuccagcacuauuuguugaacaggguguccuuuucccacuuuauguuuuuguuugcuuugucgaacaucagucggcuauaaguauuuggcuuuauuucuggguucuccguucuguuccauuggucuacgugccuauuuuuauaccaguacuaugcuguuuugguaacuauauccuugaaguuauaguuugaagucagguaaugugaugccuccagauuuuucuuuuugcuuaguauugcuuugucuaugcgggcuuucuuuuuugguccauaugaauuuuaguauuguuuuuucuaguucugugaagaaugaugauaguauuuugaugggaauugcacugaauauguugaaucuguagauugcuuuugcauuguggucauuuacacaauauugauucuacccauccaugagcaugggauguguuuccauuuguuugugucaucugugauuucuaucagcaauguaucagaucuaggaccuuuuuggaugagucuucaggguuuucuagguauaugaucauaucauuggugcacauuaacaguuugacaugcucuuuuuuaauucggaugcccuuuauuucuuucucuuuucugauugcucuggcuaggacucauuuuuuaacuggagacuauucucaaauacaaacuguacaaaaagauaagacauuuagaacaaacuuugcuguacaaauaaaaaugcaacaagccagaaguuacaauuuguaguauuugcuaccuagaaacuucagcaccuguuccauaauagguugcucaguaaaugcuuuauauugaauauauagcugcauuucugcuaaccuugagccuguguggauaauaaauucaugcaugcaucagaaacaaaaaaggacaagcaccucucccugggaguagcauauuuuggucucuaguuggggaguuggugagucuaauuuaaauaagguuaaggcagacuuugaacucuggguuugagucaagcuucaauuauaacuuuuuaguuauaauuuuuugccaacuuuuuagcagaaagaaaguuuuacucuuuucaaaguauauauaaaaagacugggagccaaucaggccacuugacuaucuucuagugccuuuuguacacucugguauccaaaacugcuucccgugaccucgcugugguuucuugcagggaugcaaaagaagcaaaagcccagaaugaagcgaccucuacuccccaucguauccgcagaaagaguucugucuugacuaugaaucggauuaggcagcagcuucgguaagacuacuccuuggcaggcagagaaacauugcugccaucucugauaucuauaaucuuaucuccuaaugccucuuauacuguuuauuugccaauccauugaaauugaccuuuuaccuagcaugucuggaauuauguuaaguuucaaauaauugucuuagucugaaggggcaagaaauacuuccugggcuuaggugacucccaucccuaaucaucauguccagcaagacuguuggugggauggggugccuaagagcaugaacuuggauucugacagaucuggauuugaaccugggcuuugucauuuaccaucuguguaaccuugggaaggcaaaauuaccuuucuaagccugaaauuccucaucuacaaaauauaauaauauacaugucauaaaguuguugagggguuuaaugagauaauauaaauaaugcuccuaacagagugucucgguagcaagcacccaugucaccuggucacaggagggacccugcaauacuuguaauccacacuaauguuauagaguucuucuuauuuagacuugaacacugaguaucaaaaaauaugucccuaccauucagguuucuagguaauaguaaaagugaccaagaagagaaagagauucugccagcagcagagauuucagacucuagcagugacgaagaagaggcuuccacaccgccccuuccaaggagagcacccagaacuguguccaggaaccugcgaucuuccuugaagucauccuuacauacccucacgaaggugccaaagaagaguguaagguucuucuagguuuacuucccauugaagcaucccucucuuaguuuaaaaguuacaaaugcugaagucacagauuaguaacagcuggaaucugaggacagaucuguuauauucaaugcuauucuuuguggaauauucauggagaaggggaccuaagugaacacuaggacugaaaaugaaucuaguagagagugauuuuugagguaagucccuuuuacgguacagaaucagauggccaagagcugaacuuccugagggaaguaaguacaagacccacuccucuuugcauuucccacggagcacuggcagaguggguaucgcauguacggccaccgagcugugguguuaguuuuguugucccacuugauacaccugagaaaccgggagugcuacuuacauauugguaacaaaucaugucacagcaagauggaaggaggagaucaaugaacaucuuuucugcuuccuguggaacuuuagcagaacacugaaaagguauucagaucaggaucuucucauguucgaaugugcuugagaaauguuugaauuaaaguuaaauugacagagcaucuuauucuuuggaacacaguugagaaaucuuaauuagaagacuuucuaaagcugauguccauuuuuccguaugaagaugugauuuggcuuggguugaaaucaaagaaaaaucucggcugggcaugguggcucaugcguguaaucccagcacuuuggaggccgagguggguggaucacuugaggucaggaauucaagaccagccuggccaacaauggugaaacccugucucugcuuaaaauacaaaaauuagccaggcaugguggcaggugccuguaaucccagcuacucuggaggcugaggcgggagaaucacuugaaccugcgaggcagagguuucagugagcugagaucgcaccauagcacucuagccugggcgacagagugagacucuaucucaagaaaaaagaaaagucucuagggaaaggaauccaguagaucaguaguccccagccccuuuggcaccagggacccccuucguggaagacaaacuuucuacggauggcaggggcuggggggaugguuucaggaugaaauuguucuacccuagaucaccaggcauuggauucucauaaggagugugcaaccuagaucccuugcacacacaguucgcaauaggauuugcacuccuaugagaaucuaaugccucugcuccucuagcagaaggcagagcucaggugguaaugcucaccccacccaccacucaccuccugcuguguccugguuccuaacaggccucugguuugauugugucuccuggcccccacccaaaaguagggauauaggguguaggguaccuucagcauaauaaaaaagggcagaagcccaucagguuucuugauaccuucucagcaaggccuugucaacacuuuucuguuuucuccaaaauuaauaaauguaaggccuuuuuguuuuuuuuugagacacgcucuugcucugucucuugcccaggcuggagugcaguggugcaaucucaacucacuguagccucaaccuccugggcucaagcgauccuuccaccucagccucccaaguagcugggacuacaggagugugccaucaugccuagcuaauuuagagggggcuuucaccucuguguugcccaggcuguccucaaacuccugaguuuaagcaguccucccuucuuggccuuucuaaguuuugggauuacaggcgugagucaccgcaccagccuguaaagccuuuuaaacaguuuaagugcuuucugccucgggaggaaauggagagauuguucucucucuagccaggcugaaaacagaggguggguggagugaaaugccccauagaagggaaugcuuuguagaaacgccaugaagaugagggaagcagcagcaggcuuguucuagcaagccaugagcaaggaagaagauagagggcuguuagacuacacuaagcggugaccuggggguuuggaguggaaaaaucugccaagguuucuccaggucccgcaccgugggccauggaaguccugggcugaugcuuggccauaucuucaaauaagcccagggaaagaucuaaugaaucaaaccuaguuuaugccuccucuucucuucuguauuugggcagaguaguuagggugucuuaaacauuucuugucuuucaagauaauauuuuacuuuuaaauaguauuucauccaaacuuaauucuuuccucagacugauauuguuauaaauccugauacuauacauacauuagaaaaaagaaaccauauuuggacgaugaacaaaguuuaugcaaugugaggugagagagggagagucaugguccuuuauccaggaaggaacuaagaggaauucaccaccucucuuccuuuuaucagaucagcacaaaucacauuugcugguguguccuggaugguguuuugcuuuuuccuugugaaauauguucuuuguuuucaauacagcucaagccuagaacgccacguugugccgcuccucagauccguagucgaagccuggcugcccaggagccagccagugugcuggaggaagcccgacugagguacugcugcuguugauuccccuucagagaggcaggaaccauggggccucugcuuucauucacauaaaauuagcagucacuggucuaccuaauaaagguagauacacugugugucuauacuuuuaccuaucuagguaaagugaguguauguuuagaaaaaagaaaccucucaggcagcaucuggguuagccaguguggacaggcccugggaggacuggccuucccgucuacugccaucauuuccgcagggauggaagaugauuagucaggacagugccucuuuguuuugaugcccuuuagaaccauauggagacuuucauauaagucuggauccugucagaaaucaagcaaaaucugaaucuccugugggaugagguccacccaugugauuuggguggagaaacggaggccaaggauuaugaggccaaauggagggauuugagaaugaagggauucucuagcauuugaaauugaguuuucagguagaaacauagacaagaaaccauaaucauuuuccauugauuaaugaguagaugguuggggaauguuccuaaagucuuccuuuucucccguuuaccaccaaugguaggcugcauguuucugcuguaccugagucucuucccugucgggaacaggaauuccaagacaucuacaauuuuguggaaagcaaacuccuugaccauaccggagggugagucaugugaggcaggcaggguaguuuggggaauaaggccccugcuaguggaaugccuuggguguuacaguucagccauacaggcuuucuccaguaucagcagacuagaccaaaucguugcugaagcccaaagcuucugaaacauuuguugccaaaguaauccuauaguaacagaaauuuugccuuucagaaagaaugaaacuggccuucauugaguaggcaguuugcauauagcauuaugcaaacuguggaaugaaugauucuauauaagcagguccuacucugaccagcuuccaaggauggucccuacugcccccaccuccacauuucaagggucucgguccuucccucaguauacauucccacacuccuaacugauuauaacguguaguggcuggcugagaccuaccccacggguuuuccucucuugcucuaggugcauguacaucuccggugucccugggacagggaagacugccacuguucaugaagugauacgcugccugcagcaggcagcccaagccaaugauguuccucccuuucaauacauugaggucaauggcaugaagcugacggagccccaccaagucuaugugcaaaucuugcagguaagcagagcuguuuaggcuuuuuggaaaaugcuguuucuucgugacacaugaaaaaggaaagaguuacuuaauuuugcguguauugcauguucaugauauaccaggcauuguccuuucuguagagguagcaagggcaaggaagacagaauucuuacccuaagagacuucaaagucuaggagcuggauaaugauuacaagccaggaagccaguacuuacccacauggugaaaacugugagcuuacagguagcaguguggcaacauggaaaagggguccguggcaggccagagguuaagccuugcucuuuguccaugggcuguuauuuuggagcagguaacauccaguuauagaauucuguaauagugauuuuaagggggcuucuggcccagccugugacucauuugcauuucaaacucauauaccuucuuuaucuucucuuucggugccuucucuuguccuuccaaguaaagguuaagacuagauugggaggcagaauauaggauaccgaaguccucagguuaaaugccucccuccauuugcagauuuaacuuuaagcccaagggaguaagacccuuacaguuccucacaacuguguuucuccuaaugcagaagcuaacaggccaaaaagcaacagccaaccaugcggcagaacugcuggcaaagcaauucugcacccgagggucaccucaggaaaccaccguccugcuuguggaugaggugaggugcccaugggcggacaggagaagaaacagggcuguaccucaggagcaagugcuggaugggagggaggaaaguccuggcucccuucuccauucauaugagcccauuuucuggugcugagaggcgugugucaauggauuguuuuggugcuaugacuugggaaacaugcagcuaaagcagugguuauaggucuucauuuugaagcaccagcucagucucugugauugacucugcaccucucuccuuugcccuggcagcucgaccuucuguggacucacaaacaagacauaauguacaaucucuuugacuggcccacucauaaggaggcccggcuugugguccuggcaauugccaacacaauggaccugccagagcgaaucaugaugaaccggguguccagccgacugguagguucuagggcaguucccaugcuguucuugcagaucuguaagcuuggccaagaaguucugcaaaaaugguccaggugugguggcucacgccuguaaaccccgcacuuugggaggccaaggcgggcggaucacuugaggucaggaguucaagaccagccuggccaacacagugaaaccccgucucuacuaaaaauacaaaaauuagccaggcuaauuuuuacuuaggaagcugaggcaggagaauugcuugaacuccggaggcagaguuugcauugaguugagaucgugccacugcacuccagucuggcaacgaagcaagaguccaucccaaaaaaaaaaaaguucugcaaaaaugaauacuaaaauaaauugggauguuaagaaaugugauuucugcaaugcuuguaguuucuauguuggaauauguaaccauugcaugauuuucugcaaacaucauaucuugguguucugcugcucguggacuuuuaaacugcaccaaaccauggagguuuaauuauuuaaaaaaaaaauguuuuaggcugggcacaguggcucacgccuguaaucccagcacuuugggaggccaaggcagguggaucaccugaggucaggaguucgagaccagccugaccaacauggagaaaccccaucucuacuaaacagacaaaaauuagccagguguggugacgcaugccuguaaucccagcuacucgggaggcugaggcaggagaaucucuugaacccgggaggcggagguugcggugagccaggaucacgccacugcacuccagccugggcaacaagugugaaacucugucucaaaaaaaaaaaaaaaaaaaaaaaaguuuuagcacuuauaaccugccaggcaguguuaggugcuuggaauaaugcaauaaaccaggcagaugcaaugucugcccucacaggccuugcaguucagcaggaagcgcaaugagaaaucaugaagagccugguaagugaagccaagugcagugacaauguauagcauagaucugaagauccucucacccacuucaauuaaagcaccucagcuuuuaucuacuuccaaaugauucugauagaaucaaagguccuuaggccgggcgugguggcucaugccuauaaucccaguuuaggccgggcgugguugcucacgccuguaaucccagcacuuugggaggccgaggcagguggaucccgaggucaggagaucgagaccauccuggcuaacacggugaaacucugucccuacuaaaaauacaaaaaaauuagcugggcgugguggugggcaccaguagucccagcuacuugggaggcugaggcaggagaaugacgugaacccaggaggcggagcuugcagugagccgagaucaugccacugcacgguagccugggcaacagagcaagacuccgucucaaagaaaaaaaaagaaucaaagguccuuaaaugaaaugaaaaaauaguucaaaaacuacugcccuacaggacaccacuggucauugucaguaaaggcagugguagucuagguaugaaauguguaauuuguuauaugggaccugggaauuggguuugggggcccaagggugacuuuccaccuggauaaucacugggcagucaaccaacuuauuccucugucauuuuggcuccccagggucuuaccaggaugugcuuccagcccuauacauauagccagcugcagcagauccuaaggucccggcucaagcaucuaaaggccuuugaagaugaugccauccagcugguagccaggaagguaagucaccagcugcacccauaaaucagucagcacaucuuugcugaguaccugcuggguaugaggcccuaugcuggugcucugagguuggagagaaauuuagaaagucguguaaaaauaucaaaaaagacaagauuaugagaaauuccuuagccuuguuauuuuaugauuagagggcccuaaauauuguggguuuauaugcaaacuaauaugaauucauucagggagcaagcaguuuugcaugaugaaagggacaauauagucagguagacaaaccugguuugaauucuggcuuuaacgcuuaguaggcaugcagaaaguuauaggaaaguuacuuaaaaauuuccugagccucaguuuucuucucugaagaagaaugagagcacuucccucauagggucauugugaaaauauaacaauaucaugucuauuacaugcccagcaaggcacacucuccaggcuagauaugagguauuagaugccccucuccuccaagucuaauaggagaaugcucccugagaguucaccacagacuagucuccccggcugcugaggaacaaaguggguuaaaugucugccucaagcagaaagaaagaaagaaaaaccguacauccacaaguauuucagcauguaaaauaauuauaaacuuauuucuaguuuccucuugccgacacacucuucacccugaauggcuguagcagcagcacaugacugugacuccugcuuggaacuagcuacuguauuagggacugggguaagaggugagccaauugugugccugucuccaggcuuugcuuuccaggagagagauccucaaaguuaucaucuaggcauuuuauggguagaguuuuucacuuuugcuauuaugcuaucuaucuagacuaucuaagaggcuuuuucuuuucuuugaaugauccuuuuuuuaugccacccuuuuuuuuuuuuuugaaacagcaucucacucggucgcccaggcuggagugcaguggcgugaucucagcucacugcaaccuccgccuucuagguucaagagauucuccugccucagccuccugaguagcugggauuacaggcgugugccaccaugcccagcuaauuuuuguauuuuaguagagaugggguuuugccauguuggccaggcuggucuugaacuccugaccucaggugauccacccaccuuggccucccaaagugcugggauuacaggagcaagccacugcgcucggccaaugccauccuauuuauuugaaauuguccuuucccguuuuccuccaagaugcuucugucaguugauuuuggucucuaucuugcaucguuagagacuuuccacaguugucuugguuguccucucagguguaaggguggagauuaaacagcuggcucugaacaugugaguggggcuuauucacuaugagauuugcugugggaugaucugagugggccaguaucacugucuuuccuccuuucccaugggaauagucagauuucucaguaugcuuccccuguccugucuggagggcaguguucugggaaugaggggcuggugucagguacagaagaggucuuccaguuuggcaugcauauaguaaucaucuauuuuugguaagggacaccucuucuacaauaaugccuagcauuccuaggaccagagacuuuuugcuaaacuuugcuugagaauaaauuuccuuuguuuuuuuuguuuuuuguuuugagacggagucucacucugucgccaggcuggagugcgauggugcaauuucggcuuaccgcaaccuccaccucccuuguucaagccauucuccugccucagccucccaaguagcugggacuauaggugcacaccaccacacccagcuaauuuuuguauuuuuaguagagacaggguuuaaccauguuggccaggcuggucucaaucucuugaccuccugauccacccaccucagccucccaaagugcugggauuacagccaauaaaacuuuuauuuauaaaaacagauggugagccacacuuuguuguuuccugaucuaaggcaucuuuaguuucuuaacguccucaacuuuuuuuaacuuucaaccacaaccaaauauucucuacuuuuggcugggugcgguggcucacgccuguaaucccagcacuuugggaggcugaggcagguggaucacaaggucaagagaucgagaccauccuggcuaacagggugaaacccugucucuacuaaaaauacaaaaaauuagccgggcgugguggcacgagccuguauucccagcuacuagggaggcugaggcaggagaaucgcuugaaccugggaggcugagguugcagugagccgagaucgcaccgcugcacuccagccugggagacagagcgagacuccgucucagaaaaaaaaaaaaaaaaaauacccuacuuuagcuaaacaaccccccuuuaccucuuuccagcaccacuaacuccugagcauuuugaggauuuuuaauguaacuuagauuuguucuuggauuccucaauauagguuuaggauuuggcuuucuccaguccacuacacuaaccgcuacucuuccaugucuuucuaacuugcagaauuauuauuauuauaauuuuuuuuuuugagacggagucucgcucugucgcccaggcuggagugcaguggcacaaucucggcucacugcaaccuccaccucuuggguucaugccauucuccugccucagccucccgaguagcugggacuacaggugcccgccaacaugcccagcuaauuuuuuguauuuucaguagauacgggguuucacuguguuagccaggauggucucaaucuccugaccucgugaucugcuugccuuggucucccaaagugcugggauuacaggcgugagccaccgcgccuggcacuaacuugcaaaauuauauuuuuaaaucuucuccugaugcuucccuuccuuuuagagucuugggguggguuguuguugucauuguuuuuugagacagucuugcucugugacccaggcuggagugcagcagcacaaucuuggcucacugcaaccuccgccucccagguucaagcaauucuccugccucagccuccugaguagcugggacuacaggcaggcacccgccaccaugcccagcuaaguuuuguauuuuuaguagaggcggaguuuuaccauguuguccaggcuggucuugaacuccugaccucaagugaucugccugccuuggccucccaaaguuaaaggauuacaggugugagccacugcaccuggccagaguuuugguguuuuguuuguuuuuuuuuuuugagagggagucucacucuguugcccaggcuggagugcaguggcacgaucucagcucacugcaaccucugccucguggguucaagcaauucuccugccucagucuccugaguagcaggacuacaggcaugugccaccacgcccagcuaauuuuuuguauuuuuaguagagacgggguuucaccauguuagccaggauggucucuaucuccugaccucgugaucugccugcugcagccuccuaaagugcugggauuacaggcgugagccaccgcgccccgccccagcccgguuuuuuuaacaaagauucagaagacauccaauuuggaugcugcucuuccucaaaucucuugcccauaguuucaaagcccucucuauuucuuuacauaugacgaagcgaaucuguuuuauauucuauauccuauaguuaugauaccugaagucuuuaggggucugauucugauaaccauugauucugcugguucccaugcauauguggcuugguuuucuuauuuuuuugucuugauuuuuauuuuauuuuacuauaugcauggaauucagcaugcuccuuuauuugagaguuaauuggggccuggguugaaguugaauucauuuagaauuuguuuuuuuuuuuuuuuuuuuuugcuucuaggggcacuaccaacuguuaccauuuuuaaaauaaaauucuccacuugagaauuguaggaaauacaacauaaauuugggcuccaaauccaagcaagggcuuaugguuguaaaaacucgagagugucuggguaggguggcucaugccuauaaucccagcacuuugggaggccaaggugagaggaucacuugagcccaggaguuugagaccagccugggcaacauauuaaaaccccgucucuacaaaaaauuuaaaaauuagcccaaugcgauggcaugugccuguagucccagcuacuugggaagcugaggugggaggauugcuugagccgaggagguggaggcugcagugagucaugaucaugccacugcacuccagccugggugacagagcaagacccucucucaaacaaaaaaaccaacaaaaagucggcugggcgcagugggucacaccuguaaucccagcacuuugggagggugaaaccccaucucuacuaaaaauacaaaaaauuagccaggugugguggcagaugccuuuaaucucagcuauucgggaggcugaggcaggagaaucgcuugaaccccacagguggagguugcaguaagcugagaucccaccacugcacuccagccugggcaucaagagugaaacucugucucaaaaauaaauaaauaaauaaaacccaaguuuuuugugugugcccacauccaccuagcaccaaggucaaguaggccguuuuuccugccauccguucugcgugaugggucucacucacccuguacugaggcugaaguggaggucaaguuucaggugccugcaggauguccuguuagguuccauguuggcugggccuuagcuucuucuugugucucccuugucccagcagcagcccgaagggaugcauaggguugccaagugucacugauacccuuggggucagacugguuuagguguuuccuuaccccccagaguuccccuuucacuuugucuugaggcccuugagucccugcuauucaccacacaaagugccucuucaccaggcuguacaggugguaaugggaggggaggagaacugacgaagcaggaagggcuacaggacacccuuaccaguucaauacuggggauuagaggaagggaaaaauguaagccgauagucauguuuguguccuggguuacuuggaaagugauuuuuuuuuuuagauggacucuagacuggagugcaguggcgugaucuuggcucacugcaaccuccaccucccagguucaagugacucuccugccucagccuccccaguagcugagauuacaggcaugugccaccaugcccggcugauuuuuguauuuuuaguagagauaggguuucaccauguuggucaggcuggucuuaaacuucugaccucaagugauccaccugccugggccucccaaagugcuaggauuacaggugugacccaccgcgccccagacccuggcuaauuuuuguguuuuuaguagagaugggguuucgccauguuggccaggcuggucucaaacuccugaccucaggugauccgccugccucggccucccaaaguucugggauuauaggugugagccaccgcguccagccccuuccuacauucuugauucugguccucuuagccauugaccaagccgaccccaaauucaccacgugcuguaaggggugccuggcuauggcuuuaucuccagauaggcuccaccucacccucuugucuuuggcuggcugcuucugggggcacacgucugucucuaugcaaggagugagaacucuguuugcagaugcuucaauagugaucuugaaccaagcgucucugauuuuagacuucauuuccugaauaguaaagcugagaauuucuguguuguccacuguggaguuaacuguaaaaccaagacagagguuuggacuagaggauuagagucccaugcacaauguaauaauucauuucuauucuuccuccagguucccugccagggcuaaguacuuaacuuuacgcuuauguccauugccagcacuaccaagaaucucuugguucuucugggcuaagguggccucaggaauaaaauauucccucuuguagguagcagcacugucuggagaugcacgacggugccuggacaucugcaggcgugccacagagaucugugaguucucccagcagaagccugacuccccuggccuggucaccauagcccacucaauggaagcuguggaugagauguuuucaucaucauacaucacggccaucaaguaagaugcuccacuuccugagccuuccuggaaggcuguagaaacauguuucccuuucuaagcuuuuacucauucaaccugcacuuauuaauaacacaguuauguuucauagggacauuaucuagucagggaaacagaaauauaacccuaggauaauagaauauuugccacuuauugagcuauauuauagguguuuagggcauaaaagugcuaugauaggaacaaaaaaaaaaggaagcagcugcuucucucacacugauugaugugcucagcucaugaaaugagggcacagguauuuaugagugaccaguguauuuccggauguaguugcuauguuuccucacuuccacagugacauuuucuguaucaguuugagaguuugggggucagggagauccuugccacauaauauaggagaaauuauuucccggguuuucucuuuucuaaagacacagaaaaguuuucuuuggcuuuccucugggcugggguuacagccacugacaaaaacucacauccccucguuuccuuuaagaaauuccucuguucuggaacagagcuuccugagagccauccucgcagaguuccgucgaucaggacuggaggaagccacguuucaacaggugaucuccuccucuuuucaaauccuucuagauuuuggacuuacgcuuuuaaaauacauggaaauuuccaugaaugugugacacucuauuuugugccaccuagaguaugugaaagaauaccagaccggcaccuauuuuaaugugacauuuuguagagcugcaugagaagagaccuuuagcgacugguuucugcauguuagauugaaggccugugugccagacacuguucaaagaaugaggaacaagacaaaguuacucccugauuacagcuuauguuguaguggagucaaggcuuucagaaugaggccauauuugagaacaaaucacagaucaauccaaucccugcaugggcauaguucaauuagaucaagugagagggaucaguagggcaugugcuuuguuaguuuacuuaagacucuaguaauuggcugccuuggaagaugaauuguuaaagguguuuaugaguguguaccugagaguguguauguuuguguauguauguuuuagacaucuuuauuuaacuaaaauaagucaggaaaacauuuuccuuucagcuacuuauuuauuggguugguuguaaauucuuguuuaaaauuuuagcuacucgucauguuuugcccauuacuguucuccuccuagagucugagauagcucuucugcagagagugacuuucauuuuaguuuguaaacauuuccugaacaucugcagugugccauuaacugugaugaauccuugaaccccaagcugauuugguuaacaucccuguuccugacaaacucccagucuuggggcugggacggggauagacucauagauauuuagaauggaaagugaccagaaaugcuccagauuuagcugacccaguagagaacguuaggguaggaaucuauguuuccagcuauccuccugccucccuuuauuucuuuauucaauuuucucucuaggccuuugugcuuuuccaagggucaugccuuggcauuugcucacuguaccugauaaggaaaguggccuuguagcaaaauuugacuugaauuuugacagucucaauuaugaaacucucagccccuggagacaagacuauuuguaucaccagugagaguuacuagucauuuuauauccauuaacucacaagggauguacaguguauuuuauagauaaaauugaagcucaaaagagugcaguaacuuggccaggucuacauauuuagguaaaugguagcaccaggauucgggccugcuguuuucugauuccaaggcuagcauuccauucugccucugcauuuuguguaccacuggggcaccaacugaugccuucuggaguguuugauauccugggggccaugugucugauuuucccaaaugaagaaagaaaggaacagaaaaagccccaggauuguauuuccucuuaaccuuugccuugcuauuugugucuagauauauagucaacauguggcacugugcagaauggagggacugccguaccccaccaugucagagaccauggccguguguucucaccugggcuccugucgccuccugcuuguggagcccagcaggaacgaucugcuccuucgggugcggcucaacgucagccaggaugaugugcuguaugcgcugaaagacgaguaaaggggcuucacaaguuaaaagacuggggucuugcuggguuuuguuuuuugagacagggucuugcucugucgcccaggcuggagugcaguggcacgaucauggcucacugcagccuugacuucucaggcuuaggugaccccccaaccucauccucccagguggcugaaacuacaggcacaugccaccaugcccagcugauuuuuuguagagacagggcuucaccauguugccaagcuagucuacaaagcaucugauuuuggaaguacauggaauuguuguaacaaaguauauugaauggaaauggcucucauguauuuuggaauuuuccauuaaauaauuugcuuuuuccuga

SEQ ID NO: 191392 - RNA, 172346 nt, Homo sapiens
auuauaaauaaucuuaauagcaguauucacguuugcauucucgcauccguggcauggaguccuacacacaauaggcgcccuaagaaagcguguuugacuugaucgcuggagcaucugccggcaccgcccaggacccgcccaggacccgccccgcccccugcggccccgccccccgcaugcugaaugccauauaggcgagugacgucaggccguuuguugucauuggcggcucccaagauggcguccaucauggaagggccgcugagcaaauggacuaacgugaugaagggcuggcaguaccguugguucgugcuggacuacaaugcaggacugcucuccuacuacacggugaguccuuggagggcacagcuccaggcgccucggggccgcguuuccuggguggaggugggggaccgggguuuuagguggcugaguugagguugcuagucugggggugccgccguacgcgaggguucccuuguuggggaggguuuuacgucucggauagccaaugagggugagggagagaggggcgcagccaauaaauagaaacuagcugucugauuuauggguugggggugagccaaguuucuuucuuaggguccgcuauuaagcgguagugggguccagcaugguugugagcggguaagggugaucguagucauggcuuaaaagguccagucuugcgguucaugcugucuucauauguugucauggacuuuacacugucccaccaaggcccuguagccggccgcaccccuuagcuucccuccagggauugaagagcucugcuuccucggaggaguggccagaggagccgggacagguccaaaagugaccagcccucgggcaacaccaggggguccgaaaucccuccagucgguucagguugugugucucauucaagggacgcaccccucuauuuagcgggaggcgagcucaaacgacgccuuaacuuuugagagccaaggauuuccuacacgcgagacucuugucagcgaagagagacaagugauagugcaguguccccuuacaguuacauucuggguucagggcuucacuguuguuaacaugaguugguggccguggaaaaguagaugaauugcugugaaucuuacgugguugugugugugugugugugugugugugugguuuuuuuuuugagacggagucucgcccuguugcccaggcuggcgugcaauggcaucaucucggcucacugcaacuucugccucucggguucaagcgauucuccugccucuggccucccuaguagcugggaucacaggcaugcgccaccacacccugcuaauucuuguauuuuuaguagagacgggguuucaccauguuggccaggcuggucuugaacuccugaccucaggugauccacccgccucggccucccaaaguacugggauuacagacgugagccaccgcguccggccuugaaucuuauguuuugacuauccccuccacccucaucgcauucgauauggagaguaggugguauuagggagauaacuuacuuagaaagguacuuucucugaaugguguauaguugacgauagccgauaugagggaagaaaauacauaagaggacaaaauagaaugcccagaaagcuuuagaaaauaauagaagacagaaagaaaaacaugauuauggaagaaggauuaagguugaugagagaaaggggacacugaauuuauuuguucauuuaaaaaauauuauugagcugcuaugugcguuuucaugccagcaagaauagacaguaaaaaagacauucacuguuccucuucucuggagcuuauauacuagcuuggugaguccuuuaauucauuucacuccuaauaacucugcaaggugguuauucauuaucuccauuuaauauccccaguuacaguuuugaaaucugaggcuccaggcuuuuaaagcaauuugcucaacaucacauagcacuaagugauggaaucaggaugccaaauuauugacuuuuucuacuaaacuucgcuuucacuacaggaaggagaaaaguguaaguugugaguuacuaaaggcaagcuugcaagaguaaaaguauuacuuucaucauccuucaacuaucagcuuucuuucucuacauaguuuuuaaagggaaaaagacuaaaccuuaaugagucuuaaacacauuguucaagauugucuuuaggugggcaugaaagagaggcaacugaauauuauguccugaaaacucuggaauuaugaaacccauggcuuagauaaaggaaaaguaauauuggguuuaaguagaugugauaaucagaaaaucccguaaacucuauucaagauagagugauuucagugagugacacuaugcaguuaaguuacuuuacaaaucccaaauuuguguggaucugaaucuaggaccauacuggagaggcccccagcugagguucuugggaaugccuagcccagaaagaaucuuccuuuuuccucuuuuucuucuuuucauguauccuuuuucugcuuuguugcccuuucaguuuuugaauacuuggacaaauaucucuuuucuugcuggcuaaauauaggguuuaaaaaaauacuuuuuucccccucaaugcuuauccuucuuuuugagacuagauucccuaaaauauuauccuugccagaggaaggaaguaucauauuucucacuaacagcuguuuagaagauuuuuuuucuuuucuaguuccuugauauugaaguauuugcuuacagagaaacaacagacaauuguuguaccaucuugugaaaauaaaaugauacccaaucucaaauuagaggaggucuagugaagaggggaaaaggauagauauuuacuuaaaagggaagguaggagacacauuggauauuggcaaugaauucuacacacaugacauuauuucaguccauucggauucugaaggauuugaagguacauauuaaugauuugcauguggcuaauaacuuggagcuacaucuuccaggaagaauaucugaauuaguuguguagccuuccaagcaaggcagugaauagcauaacuuuauuucuuguuuccaaaaucacuuggccuguagucugucucugugguuguuaauauauucuagggugguucugaaaacccugaacuaaacuagagugaccuugcuuuagaguuggcuuuacugagaauuguucuugagguaaucucaggauuggguuaggaucauugcgauaguugugaacugaauagauuuacacaagccucaccuuaguugaauuuuuauuagaugaaauggccagggagaacuaaggauauaaauuuaggaacacuaugugagcaaccaauuguuuauguggcuuaugaucacaaaagaagauauggaaggaaggaaauugggggaguuauagaucuaugaggaauuggaaguuuagaaagaggaguuugugccuuuuguuaauuuaugaaagguuacugaguaccuauugugugccuggcacuuuguuaggaagugggguuaaaguggcaaauaagauggaaauuguucauccucucaugguaccuauaauauguugggggacauaccagauaagagcugugauagaggaagcacagggggauacauaggugggcuacuugacucagucuugaaggguuaggaaagguuuccuuggagaagcagguuuguuuugacuugaaugaugaggagagauuagccguaugagcagagagggaaaagugcuugagacaaagggaauaaaaguuuuuuggaggagagaagaguaagcagcuugucaguucuggagguugggcugugagguagguaguagugagagaugaacuggggagcuaagcaggaggacagauaaugaaaggcuuucuuggcaaaccauguuaaggaauuugaacuuuauccccagggcaguggagagcuauuucaguguuguaagcacuuuuuauuauuauugaaaaaucuuuuauuauagaaauuuaaaaaaauaaaucuauuuuauuuauucauuuauuuugauaagacugguuaauuuuguauuuuugguagagacgggguuucaccauguugcugaggcuggccucgaacuucagggcucaagcauucacuugccucggccucccagaauguuaggauuacaggcgugagccccugugcccagccuauuauagaaaauuuuuaacauucauaaaacuaaagaggacgguaaaaugaauucauuucauccagcuuauacaaguaucaacauauggccagucuuguuuuauuaguacucccauuaacuccuuccuccucuauugaauuauuuuuagagcagaucccagauuauuauuucuugugaauauuucaguauguggccaggcaugguggcucacgccuguaaucccagcaccuugggaggccgaggcggggagaucaccugaggucaggaauucaagacuagccuggccaacacuaucucugcuaaaaauacaaaaauuugcccugcuguggccagcgccaguaaucccagcuacuugggaggccaagaauucagccucucccuucaaggagaaucacuugaaccaggaaguggaguuugcagugagccgagauggucccacugcacuccagccugggcgacaaagcaagacuccgucucaaaaaaaaaaaaaaaagaaaguuaaggucccucuauuuucaaaagaauguuaucaaaacacuuuuauuacagcuaaauaguaguauuuauuaauaucaaauauccagucuguucaauuuccuagaaugucgcaaacauuucuuccuuaccaguugguuugagucagaauuccaaacaagaucugcauauaaaauuauagagucucuuuuaaucucuaguucucccucucuuuuucuuggccauuuauuugucuaagacaccaggucauuuacucuguagaauuuucugcauuuuggauuuuguuggaagcaucauuuugguauguuuaaacagguuccuuuguccucuguauuuccuauauaaauugauaauuugagcugaaagcuuaaucaaauuuauuuuuuuucuuuugggcaagaauauagguggaaccuaucaaaucaagaggcauaugauguuagcuugucucucuaugauguuaaaauugaucaguagguucaggugaaauguguguuuuuuuuuuuauuuuaaagaauaugguugcggagaaguaaucaggagguugcuuuugaugggauuuagugauuggaugugagugaaaggggaagagucugaagacauccagguuuucagcuugagcugguugaaugauaaaaaggaagauaggaagaacagguugggggagagaagugguugcuuuggggcauguugaaauugacauaaagauguguuacagucuggagcuugggacaaaaaucugggcugcauauccucuuaucagucaguaaaacauaaaauaaaucugggcugcagauaaauauuaguuuuucauauauggagaguugagagagugaguagaauagagaucuuuggauaggacucuggaaaauaccacuggauuuaguuaucuauugcguuaugacagauuacuccaaaauguagcaauuuaaaacaacaguuuguuaccucauaguuuucgugggucagaacuuugaguucuggcucagggucucuuaugaaguuguagucaauauauuagccagugcugcagucaucugaaaggcuugacuggagcaggaagaucagcuuccacgaugacucacauggcuguugucagaaaguggcaguuccuugcuggcuguuggaagguggccucauuccucaccagguagccucuccauugagcugcuuaagugucaucaugacagagcagcuggcugugauccaagugagagcaaagaggaagccucaaucccuuuuaugaccuagucagagaccaccacuucugccuuauucuguucauuagagacaagccauuaaauuccacucaugcuccuggggaugggaauuucagacaugaggagggaaauuaggcuuuaucuuuugaaaagaauuuguggacaaauuuuaaaccaccacaaucacaauuuaagggauuggcagaggaaaaaagcuugcacaggagagugaaaagggaugccagagauguaagagaaaaacuagaagaauguggcagucauggauggcaagguggaaguaguaaauuggcuugaauacugcugaaaggauuaaauagaugagaucuaaagcauauccauuggauugaugaacaucauugauguucuuaggcagagcaguuuccauggagugguagguauggaaugcagguuggaguggcuugaagaguaaagaggaggcaggaaauauaugaagcgaauggagguuauucaagauguuucauuguagaaagggcaaagaggacauggaauguggaauggaggggaacaguuucuaaaauaggaauaugcuuaaaugguguagggaugggaagcaaggucaauguuaaaaaugaggauacagucaggacgcaaggaguauaguaaagauuuaggacaaugacagugggaacuggaaaaaggaauagcuaaggaauagcuaaauaugauuuguuuagucauuacccacaaauguuuaacccucuuucuugauuuguauugcuuuuggagagaggguuagaaacugaauuaguaaguuaccugggcuacucaagauauuccuuguaaaaggagucguuagagaaaucauauguucuuugcuguuacacacugucuggaagagacuuguaaugacuuugcauuuuaaaaccacugcuagucaaaacacauuuaaguguuauuuggcagucuuuagcaauguuuaguagaugauaaaaaaaucuaccaucuaauuauuagauuuuagauuuuugaauagcuuaaauguauauauuucucuugcaaacauguaaaaguagucucagauucuccuggaaagguaucagcaccacucccaucaaacauuuaaaagcaaauuuauucuuuucuaaguaaaccauucuugaauauaucaaauaugauuuuuauugagcuuauauaugguacuuuuuuuuuuuugucggagucucgcucugucacccagguuggagugcaguggcacgaucuccacucacuaccaccuccaccuccuggguagaagcaauucuccugucucagccacccgaguagcugggauuaaggcacccaccaccaggccuggcuaauuuuuguauuuuuaguagagacgagguuucaccauguugaccaggcugaucuugaacuccugaccucagaucauccaccugccucagccucccaaagugcugagauuacaggugugagccaccuugccuggcuauaugguacauuuuaguaguccaaaucuaauagaguagcuuuagaauuauaaaaggaacaaaagaaaaauuguaucuaaaucuaaaugggcugggugcaguggcucaugccuguaaucccccagcacuuugggagucgaggcaggugggucacuugaggucaggaguucaagacaagccugaccaacaugguaaaaccccgucuguacuaaaaauacaaaaauuagccgggcauggugguacaccucuguaaucccagcuacuugggaggcugaggcaggagaaucgcuugaacccggaaggcaaaacccgugagcugagaucacgccacugcacucuagccugggugacagagugagacucugucucaaaaaauaaauaaauaaauaaauaaaaauaaaaauaaauccaaacacccugaaaagacauaaagaaacucucuaagauagugaguaguaucagugggaagaauuauuuggaaauuuuuuaucuuuuacuuuccuugaauacuuuagacagucuugauuuuucccuuuucuaaaacuccugagccuagcucauauacuucuuuugggcauuaaucaucuuacaucugcuacaauuaacuaaauguaucucuaguacauucuuuaucuguacagcaagcuuguaaacuccaugauggcaguacugaacaucauaauaaucuucaagccugacaaugaggcauauuauucuccuugugaauagaauaugaauggcccuucuaauucgaauuauaggugagugaggcagaaggcuguuuggaauucuuguuuacacagccuuguaaguuuuacagaauauacuaauagcaaauauguauguuuccacaguuuauguaaaaccugauuggguuuauauuaacaacagagguuuuuuguuuagucauccagagccuguggaacugugugccaucuuugcuuccuguguuguagcagacaagcagucaauucuugcuucuguugcaagcaguuuucuugauggugauaauuuguagaaagauguagaguuguucuuaaauaugccacuccaaaaguggcaauuguaugauuagauuuucuuuuuuuaaaauguaauuuaauuuauuuuaaacuaaucuagaccaugccaguuggaaggauuagauuuucaaauagguaaucccgaucaaaacuagaacaguguacaagugauuuagauuaaggauugaauuucuuuuacuguuuauagagaaauacagacaaagaaauggccaccccaaucaauuguuuccuucucauuuauuuaauuguaaaggauuaucuucuucuucuuuuuuuuuuuuuaaugggguacugcucugucauccaggcuggagugcaguggcaugauuuuggcucaccgcaacguccagcaccaagacucaaaauccucccaccucaccucagccuccugaguagcugggaccauaggcaugcgccaccacacuggcuaacuuuuuguauuuuugguagagaugggguuucaccauguuggccaggcuggucucaaacuccugagcuuaagcaauccacccuccucggccucccaaagugcugugauuauaauugugagccacugcauucagcccaggauuauuuuaaaaauggaauuuacuugcagaaguuaaguuuacauguuacaugggaugauauaaauggaauuauauucaaggaaaguauuuccagguauucauaauuaauuuuuuucuauucacaugacaauguuaaaauuauuguaaaaguugauugucuauuucuuggaguuuuguuccauugaggccccaugauaagauugucuacuuauuucuuguauuuuaucuuaguauuguuauggcacagcugggugaaaauacacuggauaaaaaugugaucugucguucuggcagcuaucuuuugucucucaauccucuucuuuccuccaucacucauaggagaugccaugcuuaccagagacaauaguccauuuggugggaacacucucaacuccuuguucucccaccuauuuugauauaucuauuuuccucuuuauacuugcuuuuaccuuucccuaucauagaagagguaauccuguguucuggauuccauuugcucacaaacuuuucggggaucucagucuauagauuuucuccucuaucugcuuucucuccucucucuauuuaacuucuuccucacuacagauuuuucuuauuuaagaauauuauuauuauuauuaugcaguauaacaaacaguuguaaucauuuuauacagacauuuuuagauagccuguugcuuuuuauucuuuuuuuucccccuuacaaccagaucucacucugucacccaggcuggaguacagugugcuaucacagcucacugcagccucgaccucccaggcuuaagcaauccuccugccucagucuucugaguaguugggauugcaggcaugugccaccacacgagcuaauuuuuguuuugcuuuuuuuuuuugguagaguuagggucccacuguguugcccaggcuagucuugaacuccuggacucaagugauacucccgcuuuggccuuccaaagugcugggauuacaagugugagccaugacaccuggccaucuuuaauuuugaugauguccaguuuauuuguucuucugcugcugcuuaugcuuuuggugucguaucugagaaaucauugcuuaaucuaaagucacaaaguuucauaucuauguuuacuucuaagaguuguuuauuuuagcuauaauggguaggucugauccauuuuuguuguuggucaugguuuuuuuguuuguuuauuuugagacaaggucuuucucuguuguccauccuggagugcaguggcacaaucauagcuuauagcagccucaaacucccaggccaagugauccuaccaccucagccuccugaguagcugggacuacaggcuugugccaccaugugggcuacuuuuuuuauuuguagaggauggggucuugccauguugcucacacuguucuccagcuccugggcugaaaugauccuucugucucagccucccaaaguacugggauuauaugugugagccacugcaccuggcuaguuuuuuuuuuuaauauggaaugagguaaggguccaccuuuauucuuuugcauguggauauccaguuguccgagcaucaucuguuggaaagacuucuuucuccauugaauuguuuuggcauucuuguuggcaguuaacuaaccauaaaugugaagauuuguauuuagacugucaguucuauuccauugacuuauuugucuguacuuacgccuguacuauacugucucaauuacuguagcuuuguaguaaguucugaaauugggaaauguaaaucuucuaacuuucuuuguucuuuuucaagauaguuuuggcuauucuggauccuuugaauuuacauaugaauuuuaggauggacugacuuuuucauuaauguauuaacauguucaucucuccuacuuugaaaaaugucucuccuaauucuguuuuuuuuuugaaaauaucauccuaaccugucuuccucaauauacauuuguguauugaaaugccugucucuguuaguccaucuugcauuuacucgacagcacucuuuuuuaccuccacauuucacugaaaauuccagcagagguccccagugauagcuuuguugcuaaacccaaugggugcuuuuuucgcucuuaaucuuagcacugucuccauagcauuugaugacacugguuacucuuuuacagcuuuaaaaauuguuuuacuguucuugaagagaugacauuguacucuuaauuauuuuucuaccacuguacuaaugaaggccuacucucaauuuuuuuuuuuuuuuggaaaggacuauugcaguauuacucuaaauuuuuaaaagaagagucaaacuauagugaaaggucuauacaguagaaggaagaaaagucacaccugaaauccuacuuaucuguguuuuggagaauagcuuuccuaacaacucuuuaugcacaaauacacaucuguguacuuuauauaaauggaaucauuuuauacaugauauucuacaaccuaaaagcauuuuaagauuuuucuguguaaguuauuguaccauuuuguauuguauuucuucaagaggcaaaugaacaaaagauaacauuuuuucuucaucuuuauuuaauaagaucucagucaucuggcuuugggaaguuaaaauuccuacgcuggccuggugcaguggcucgugccuguaauuucaauacguugggaggcugaggugggagaauugcuugaacccgggaggugaagguugcagggagcugagauugcgccacugcaccccagccugggcgacagagcaagacuccaucucaaaaaaauaaaaaagaaaagagaaaaagaaaaauaucuaaauuuuuuauuaugacuuuacuaugacuuugugaucugcuucaauuuaucuuucuuuuuuucuuuuuuuuuuuuuuuuugagauggagccuugcucuguugcccaggcuggagugcaguggcgugaucucggcccacugcagccucugccugcuggguuccagcaauucuccugccucaggcuccuggguagcugggauuacaggugcgugccaccauguccagcuaauuuuuguauuuuuaguacagacgugguuucaccauguuggccaggcuggucuccugaccucaagugauccacccuccucggccucccaaagugcugggauuacaggccugagcuaccaugcccggccuuagcuuaacacucucuauucacuugagcuuuucuucuguuccuuugaaguucuucaaacuuguucuugccucagggccucugaauguuuucugucuuggacaggucuagcaugguugauuacuucuuauacagguuuucauucauaugucacugcucagagaagccuuucuauaacaaaccaucuaaaguaggccucucacccucaguugcuaucauaaucaucucguuugauuuuucauggcauauauuguuauugcuuuauuuuguuucucuugcuuauugucuguuucugucuuguaugaauagaauguaaguuccauuagaacagagacuuuauuuaucuucaucauuuuaucuccagcaucuagagcagugccuggcacuuaguggcuuuucaguaaauauagucaugggucgcuuaacaauggggcaggaguguggggagauaucuucugagaaauuuguuaggugauuuuaucauuguguggaugucauaaagugggcuuacacaaacuuagaucauauaguuuacuacauaccuaguccaugugguaggcugccacccuguacagugugaaacuguaugggcaggccaaagggaaaacuucuuggccuuuggagguucgcugaaaugcaacugacaaaaggcagauucauaggagaaaaggcauacaaauucacuaauguggcucggugcaguggcucaugccuguaaucccagugcuuugagaggcugagguggguggaucaccugagaucaggaguuugagaccagccuggccaacguggugaaacccugucucuacuaaaaauacaaaaauuagcugggugugguggugugcgccuguagucccagcuacuugggaggcugaggcaggagaauugcuugaaacugggaguuggagauugcagugagucaagacugugccacugcacuccagccugggcgacagagccauauuccaucucaaaaaaaaaaaauuauuaaugugcaugggggagggggaguuauggagugauuaccccaacccccuaauggaguacaguaauuuauauacccuuuuucacaggggacggaggagauggggaguguagacaauucuuuuaaaggguacuaaaugauuacuggggggaaugaaugaaucaaggagacagaaaaguccauccagguguaguugcauuucucagucuucuuuucugugauagauaaugagauuucagaaaggggauagaagacaauugugguuuuuuugguaagaugcuuuuuuggucagauaaggaaaugccagagagucucucccggcgcugggucagggagaaacaagacaagguuagagggaccuugauccuaaguuuuauuucuaaggccuuucaauuuucaaaagcaccaugcccaagugccauauuuucuggguuagucguuuucugcacuacaacauuacuguacugaauacuguaggcaauuguaauauaaugguaaauauuuguguaucuaaauguaucuaagcauagaaaagauacaauaaaaauagguauaaaagauaaaaaaugguacaccuguauagggcacuuaccaugaaugaagcuugcaggacuggaaguuguucugaugagucaaagagugaguggugagugaaugugaaggccggggacauuaccauacacuaccauagacuuuauaaacacuguacauuuagguaacgcuaaacuuacaaaaaaaauuucuuucuucaauaaauuaaccuuagcuuacuguagugcuuuacuugauaaacuuuuaauuuuuuuaaaacaccuuuaauuuuuguuuuaacuuuuugacuccuucguauugacacuuggguuuaaaacacaagcacauuguacagcuguacaaaaguauuuucuuucuuuauaugcuuauucuauaagcucuuuucuauuuauaaguuuucuuauuuuauguuuuuuauuuuaagcuuuuucuuguuaaaaauacaacugcccaauggguucuuucugcccacugcgcaaagaaaaucaguuuguggagaccauggcauuacaguaaagaaaguuugacacgaggcuggccucacucugagguuagggauuuuucaaagauaguuuggugugcuggggccuacaguauggggagugcugauugguuggguuggagcuguccucuugugcugaguugcuucuaggugaggccacaggagcagcuggcauguccaugugggagccaucaguugucagacaugcaaaaaacuugaaaagauaucucaaaaaggccaaucuggcugggcaugguggugcaugccuguaaucucagcgcuuugggaaguagcagcaggaggaucauugagcccaggaguuugagaccauccugggcaacauagugagaccccaucucuacaaaaaacuaaaaaaauuagccaagcaugguggaguguaccuguggccccagcuacuuggaggcugaggcaggaagaucgcuugagcccaacaggucgaggguacagugagcuaugaucaugccacugcauuccagccuaggcaacagagcaagacccugucucaaaaagaaaaaaaaaagaccaaccuuagguucuucaauagugauguuaucugcagaaguaauugugacguccagaauaauggcugacaaucauuuaugucuaugccuuagcaggauucaggcuccucuaaucuccuagccugguggucucucucauuagauuuacaaaggcaguugaguuuuggggaaggauuauuaucauuuaaacuauaaaugucucccaaaguuagcuuggcuuaagccuagaaauaauugcagcuugaaagcuaaaggcaagggggcauuggcuagaucaggucuccccaacugccauaauuuucucacugauagaauuuuugcaaagguggcuucaaaaaguaagauacaaaaacauuagcagaggucuacauaggcucaguaucaucaguaucacugucuuccaccuguacaucuugucccacuggaaggucuuuagggcaauaacucacauggagcugucaucuccuaugauaacaaugcuuucuucuggaaucccuacugaaggaccuaccugaggcuguuuuacaguuaacuuuuaaauauaucuauauauacacguauauauaaauagaaggcauauacucuaaaauaacaauaaaauacaguauaguaaauauauaagguaauguacuuauuaucaaguauuauguacuguacauaauuguaugugcuauauuuuauacgucuggcagcacaguagguuuguuuauaacagcauugccacaaacaugaguacagcaucauuaggcaauaagaaauuuucagcuccauuauaaucuuacaaacaguucugugaaguaauugguauuauuuccuuugaacagugaagacauugaaauuuaagaggaucccauaguaguuucuaugugggugaucaaggucuaacuucaaauagaauguucuuucugggauacacuagauuaauagugauuagaaugaugauaaaccuguuaucacuaguuugcuggcagaugauaaauaauuuacaucauuaucacaauuaaauaaacuuucugcagaggccuuuguaaauuacagugaucuauuauaaugcuagguuaagcaaagacucuuccucuuaccucaauggaaagccugcgauggggggagaaguggcggggaccagauacuaaagucucagaauuugugagugauggguuuuuuauguuuacauggcauaaguauagaaaggcaguggcaaauuaucaaagaagauagggucuaccuuggaauuuuaucaccugaaagaggaguaaguuuaaauuucugacaggcaacauccucugugacuaguuaaaaugaaagucauuuuaacucuucugccuucauuucuuuuuggaaacccauguauuuugaaguaaaguuagacuugauuaaaaaaaaaugagaguuuuuaaauugccuuuuaaaaaauacuuuucucuuuuuuuugagaccgagucuuacucuguccuccaggcuggaucuuggcucacugcaaccuccaccuccuggguucaagcaauucuccugccucagccucccagguagcuggaauuacagguguucgccaccacgccuggcuaauuuuuuuauauuuuuaguagagacgugguuucgccauguuggccaggcuggucuugaacuccugaccucaggcgauccacccgccuuggccucccaaagugcugggauuacaggugucagccaucucaccuggccacuuuuaucuuuauuauaaaaguaaaauaaggccaggugagguagcuaacaccuguaaaccuagcacuuuggaggccaagacgggaggauugcuugagcccagguguucaagaccagccugggcaauguagggagaccccugucucuacaaaaaaauaaaaaauaaaaauuauccagguguggugaugcaugccugugguuccagcuacuggguggggaugggggaaugggugcgagguagaaggaucaaugagccugggaaguagaggcugcagugagcuguguuccugccaguccacuccagcccgggcaacagagcaagacccugucucaaaaaauaaaguaaauaaaauaaaauaaaauaaaauaaaauaaaaugaaaacagggucuugcacucugucacgggggcuagagugcaggggcaugaucaugguucacugcagccacaaccuccugggcucaagcagucuucuuacuuaagccuucagaguaccugggaccacaggugugaaccaccacaccagcuaauuuuaaaaaaaccauuuuguagaaauggggccucacuauguugcccagguuggucucaaacuucagggcucaagugaucuuuccaccucagccucccaaagugcugggauuacagguguaagccgccuuaccuggcuuggaaauaauuauuaacaguuuuucauugcaaacauuuuuccugagccccaaccuccagauuugaacaaggagcuuuuggagcauagccccauucuaaauuggagucuauaggaugagacuuggaauuaggacuaagcaucugaaauuucaugggucuagcuguuguucuugcuaaccacauuuuuguguguugcacaaauuuuucuaucuucuauacauuuuuguaguguucuucuuguucccuuuuuauaaucuuguuauucugggcccucuauuagucuuugcuaaauagggaaaaagguccuugggcaauuuuugguagaggagugaacuugaauguuaauaauggauugucauuucacaguuuggugggagaaguacugaugguggaggagcauaaaacagaguuuaacacucccucauuauuuccuuuaaucaacucugugaauaaacacaagucaauauuuaguauuuugggugguaugugaaaaacaaaacaaaaauagaaaaucugugucgagguuguagggaaguugaaacuuucccucugaagguuugaauccaagucggcugaaaugaguugacagucgccagauuaacaggagaaaagguauacaaauuuauucacgugcauaagcaugggagccauacaaaauaugagacucaaagaaaggccaacugaaguuuuauaccaugcagaaaggaauagaggguuaaggguauccugggguuguggggaagggguugcugcaguguaugagagugagaggaggaaacaugguguauuagucuguucucacgccgcugacagagccauaccugagacuggguaaucuauaaagaaaaagagguuuaauggacucucaguuccacauggcugggguggccucacaaucgugguagaaggcgaaaagcaugucuuacgcuggggcaggcaaagagagaauaagaaccaagggaagagggaaaccgcugaaaaccaucauaucucaugagacuuuuucacuaccacaagaaacaguaugggggaaacuggcccuaugauucaauuaucucucaccaggucccuccuacaacaugugggaauuacgggagcuacaauucaagaugagauuuggguggagacacaggcaaacauaucccauggccagcaagggcugggccgucuuguuaugcaggagaaaucucucaguagaucauuuuaccugugggaaaaguuucucugucagacuucgaaaagugugucaagagcagagugugaugggucauaccuauagucccagccacuggagaggcugaguuaggaagaucccuugagcccagaaguuugaguucagccugggcaacauagauagaccccaucuguauuaaaaaaaaaaaugucagaacuuuggucuccuuuuccugugagguaaucuuccuagauuagauaaggcagauaaggaggucucagaaaaagguguuugcaccucgcuguuacuccacuaauguagauuaccucugcagauacaagucuccccuaccaaaguacagcuuuucagaguuauucucgugucugcagccccucugagaauagcuaucucaaaauaugccaaagaaguauauuuuggggugguauauuuugauuuccuucaaggugcagcauauauuacuaacaugcuaucaguaguuugcagaacuugggcuacuauuuaguuuuuaauauuuaacuuuauaagggaugcaaaaacccuaagucaucauggcugugcuuaauugagcuccgugaaagugguucucuccacucaccuguuguccugaaauucugacuugaagauaaaauuauccuuuuuuaaaaacagugaaaaaccugagacucgacaauguuauaggccacuagaucaaaguccauauguccacaauccucugccugcaauuuugaaaucucuacagcccugaauuaaaaagauuuuucccccuaaauuuaugauacgcucauuuggaaguaaagccuaucuugaacugauguguggcuauuuauaaucuuuaucaugcuuaguguaaauauuuguuuguuguacuauagauauauuaauaugcuugguuguggaauuaauauccuuggcuacccuagaccucacugcaggugacacaauuuauguacuguauguauguauauguguguguguguguguguguguguauccuuucuaaaaucaauccuuccuuccuuccucucucucucuuguuuuuuuuuuuuuuuuuuuuuuuuuugagacagggucuugcuucguuauccaggcuggaguuuaguggcaugaucauaguucacuguagccucaaacuccuaggcucaaguaauccuuccaccucagccuccccaguaacuaggaauauaggcauuugccaccucuccuggaugccacuucauucuuuuuuuuuuuuucccuuugagacaaagucuggcccuauuacccaggcuggagugcaauggcaugauucagcucacugcauccucugacuccuaggcugaaaccauccucccaccucagccucccaaguagcugggacuacaggugcacacugccacaccaggcucauuuuuguauuuuuuguagagaugggguuucaccauguuguccagguuggucuugaacuugugagcccaaguaauccuccuggcucggccucccaaaaugcugggauugcagguaugacccaccacacccaacccaaauugucuuaccuuucuaaaauugugaaggcugggcacaguggcucaugccugucaucuuagcauuuugggaggccaaggugagaggaucacuugaggccaggaguucaaggccagccugggcaacagaguaacacuccaucucuacuuuaaaaauaaauaaauaaauaaauaaauaaaauugucauuuccaaaacacaucugauccaaaggucuugggauaagggauguggacauguauuuguaaucuagugaccuaggaauuuacaugcuagagaugguucagaagucagcauuaccgcccucugaggcacugcugagaggcuuuacagggugacauacuccucugaauucagaaagaucacugauuuuacacccagccuuugugguugagaaaaaccuuuaaggaagacuuaaauuaaccagguuuauagugacugugguacaaauguaccuuuggauccauaccuagguucaaauccuguuucucucacuugcuaucugugagucuguggacaaguuacuccaaccuuucugucacugauuccucaguuauaaaaugaguauaacaugccaggcauguuggcucacgccuguaauccaccacuuugggaggcugagguggguggaucacaugaggucaggaguucaagaacagccugacuaacauggugaaucaccgucucuacuaaaaauacaaaauuagccgggcuugguggcgcaugccuuuaaucccagcuacucaggaggcugaggcaggagaaucagaggcuacagugagccgagaucacaccacugcacuccagccugggcaacaagagugaaacucugucucaaaaaaauaaauaaauaaaacuaaauaaaauggguaugauaaaagaaccaauaucauaagaucauugugagaauuaaauaaaauaguauuuaaagcacuagcacagugucuggcacauaagugcucaguaaaugauaacaaaaagcuaaaguuuauggagguguuugacauaguaauauucacuaaauguacacaguggucaccauuauaugaaucaguauuccaauuuauuaauucacaacaagaaauauaacuuaagaagacucuacauuuaggcuaucuaacugauacauuuauucucugaaugcaaacucuuugggaugccaaauuauaagcagcaucagaccaaaguuauauguuauagguauuuaguggcauuagauauugacaucaagaugcaguaucuccauguuagagacauaccuauuaccagaauguaacagguuuaaucuuugggucaaaaaaacuucuauccuugccuucugauauuaguucuggccuucuuucucuaguucuaaaauacuuaguauaaugaucuccaggcuguuccaucucuuaaagaugaucuuguauauaucucuguuuugauauaugucucuuuucuuuaagggaaggcagccuuguucccaggaucuuggagagacccccaaaaucaccauuaccuuguuuacugauauauuuuuguauauugaaucaauagacauuaaaucugaugcucaaaaugagaccaucuguaacugacagggaaaggagggaaggaugagauaguuaucuaugauaacuugaaggaugagugauggggaaaauuucuccauuauugugagucugugacuacucaagaguuuuuguugguguagcuuucuggaagcauaaugacauuuggggcuauugagugucccaaggcaguaacuggggaagggucucuaguacauuaaaugcuaucaggauggcuuuaggaguccgugcucucuuaaauagaaaggagacuacauucugggugugguggcucacaccuguaaucccaguacugcuugaggccaggaauuugagaccagccugagcaacauagugagacucuaccuguauaaaaaaaauuuuuuuuaaagaaaagaaaggcggggcacgguggcucauaccuguaauccuaucacuuugagaggcugaggcaggcagaucccuugaguucaggaguuagugaccagccugggcaacauggugaaacccugucacuacaaaaaauacaaaaauauuagcugggugugguggugugccccuguagugagcuaugauugcaccacugcacuccagccuaggugacagaguaagacucugucucauaaaaauaaaaauaaaaaucugaacagaugcaguggcucacaccuguaaucuuagcacuuugggaggccaaguccagaggauugcuugaggucaggaguucaagaccagacuggccaacauagcaagaaugccuuaaaaaaaaaacuacaggagugagugagaguugcugcuaucauuuccuauuuuguaacuguuguaauuaguguaucuucguagaauuuugucaaguacuauuuauuaauuuacuuuuauugacguauaauuuucuuccaguaaaaaacacauauuuuaaguguauaauuaguugagucuuugcauuuauuuacagccuugucacuaauaucccaaucaaaauaugaagcauuguuaucuuccugcaaaauucccuccugucccuuuccugucugucccaugcccuagaaccagcgucuugugauuccugucuucauggguuaguuugccugucaaguuuuccuccugugugccaguaguagauggucgaagguacaacacuggcuaugugugcaaccucauaugcacuuggaaaugaacuaacaugucucucaauguggaaacaguguuuacauuuaugcguaaaggagaggaacuguugugacauuuguccacguucauuguccccaggucuucuaccaucaacauguuaaauguucuuugcaaaguacaguguagcaaggguagcauauugaguuggggugguggggacaaggaugagucagaaacuaccuuugggagaagugaugagacaugcacauacguuauuaucauguaagauagaaauaauaagugccuuaagaaaaguaauauggcaugcuguauauuaauaaguucagaaggagaccucacuuuuagcugugagagauucauagcaagucagugaguuuauugcuugaucuucaacacaguguacuuuaagcaaaguaaaauuaacauucaaauaaauuuaaguguccucauguaacagauucggggaggcauuccuaguuguuuuuuuuuuuuuuuuuuuuuuuuuugagauagggucucgcucugugguccaggcuggagugcaguggcgcaaucaggggucauugcagccuugaccuccugggcucaggcaauccuccugccucagcccuccaguagcugggacuauaggcacacaccaccaugucuggcuaauuuuuauuuuuuuuuaauuuuaguaaagaggaagucucacuauguugcccaggcuggucucaaauuccugagcucaagcaauccucccacuucagccucccaaagugcugggauuauggcaugagccaccauacuuggccauucuuugcuuuauaaaaggauuguagaauuaauguaaauggcaaggaaaucuuccuuacugaauuuuaaauauguuugcacaaaacuuuuucagacacauuuacuuuguaaacucauauuuauauuuccaauuaaacagguuuuuauugauugcaguauauacuggcaccaagcuagauuuuaugaguuaauuuuuaaacuuaauaagauguuuuuaguacuuaguaugugcuaggaauaaacugaacuaaucuucuaaaagcuugcaguccuguuggagauacaauuaaguaguuacaaucaagauauaaucaaguaguuacuuuugugcuuuugauuuagugcuuuuuauuagauauuauuaaucucuaauuguuuuauuguaauaauuuaaaauacaguuguaaaaauuugauugaagaggacugaaaguuuacagaaccggggaaaagguuuccccuguguuacuugggaguguugaauagcuugaauugggacugaaugggcauauuuugagugaauuauguuuguuggaugaguaagauaacugggaaaguggucugggaccauucauugagcagacauuuaucuauuaauaauaccuuccaggucccaggcauuaauuagguucugaaagauagggugggaauaauaguaauguaaagauaauuuuuuuuuuuuuuugaaacaggcucucacucugaugcccagacuggagugcagugcauuguaaccucuaacuccugggcuaacaggauccuuccaccgcagcccccugaguaccuaggauuacaggugugugccaccacaccuggcuaauuaaaaaaaauuuuuuuuuuuagagauggguucucacuauguugcccaggcuggucuccaacuccuggccugaagugaucccccugccucagccuccaaaaugcugaaauuacaggugugagccacugugcguugccauauuaaagcagauuuaagacugacauuuagcuaaauaguucuuaguauguucuuaaaauuacuuuuuccuaaggauuuaagaaauggaccaagcaggcagaccgcugugugauuugagauuauuaugagcuauucucuugagaaugcaggucaucucauuguuggucauuaccuugcucugacuggggccucuuuuauaagggaauuaaucccauucaugagggcucugcccuugugaccuaaucacuucccaaaggcgcaccuccuaauaccaucaucuuagggguugggauuucaacauaugaacuuuguggggauguaaacauucaguccauuacaguauguauuccuauaaauacauguuucucacauuaaguaagccauagaaggauauuuucuagaauaguuugugaaauuaauuuuggcaagauaaguucuacuuucugauagacuuaugugacucuuucagaaauuucuuacccugggaaaauaaaaauuguuucugauuuuauuaauuuacugauuuccagaagguucuuuauucuauagccagcaaaaagcugcuuuugguugcuuaaccccauccuagauuacuucuagcagggccuuacaaauguguugauuauaucaccaacuauuuugauaauguaacaguuggagguuaggaucuguuucucagcuuccugggagcaccgggucaaugccgagauaaauaucuguuuagaucuacagaauaaauugauuuucacacugacaguauaucgaagagaaucuagauauccuaagguguuugcugccuagaucuaggcacacaguauugauuagaauguuuggaaucagcauuccuuagauguuucuuuacagaaaaaguacugacuuuuaaaaaagguaagugucaagugguuauaaagaugguagcuagcguaaaggccaaauguuuuuuuuuccuuugaggcagguuuaacagacuuaguaacacacuaaaaucugugaaguuuaauuugucuuugggcagccgauuuuaauuuucugaccaacauaaucagaauaagaauagaagcuucaaauuacuggcuguugaggcauaguacauaaaauugaggguuacguuaaugaaaauuuaaauggcuagcuguacuuacgugucuccguccuaucauuuauucaauauuuuuugaguuuccucuguguaauaggucaauauucuccuagaauuuaaggcuaauagggaugaugaaauuaaguaauuucagaauuguuuaauuacagauuuauaaaguacuuggcaggcucuuaauuauuuaucuuuguuaauuuuaucaugaaugcacacaagguauucuggaucagagacauuucauaauaauaaauguauuggccugcuuuugcccuaguccuuaccccuaggaugaugcuauaaaagccaggucaauuguccugcgugaguagccagacacucuguaggugggggacaaggaaaaauuauuuuucucuccuaugaaggggaaauaggcaacugucccccuccccucaugaaauggucacuuaggaaagguaauaagccuaaauccuaacuccaacccuuuggcauaucuggaguuuuaucucuuuuuacauacaaauaucuagggagauagcuguaccccuuuucuuagcaccuuggaagcuuggccuagggaacugcuccaggcuguaaccuuucaaacuucucugggaaaugagagaggguuuuauuauccuuccagaccaguugaaaacaaaagaucuaauccuuauggcaugcagaaauguugccaggacccuagagcuuuuuagaagaacauugagaaauccauggacauuuuaugucuuagucuguuuucuguugcuauaacagaauaccacagacuagauaauuuauaaaggaaagaaguuuauuuuggcucaugguuuuagcagcuggaagagcauagugucuucuugcugcuucauaacaugguggagggcaucacauggugagagagguagagcaagagaggugagggaaauugcuuuuacgacaaagucacuccaucaauaaagagcacacuccugugauagugacauuaauccaucaaggaggacagaguccucauuaaucuauucaugaggacggagggauuagguuucuaacacaugaacuuuugggggauacacucaagcccauaggauuuuauuuucccacaguauuaugggaaaaaaaggguuuuauuauauccuuguuagaagugaaggguuggcuaucugcucuagagguucagguaaagcuucccuccucagggaacugaggguaaguaggaauuagccaguaaaaagagugaggguagaugaguaaaggcacuucaggcaaugagaacaauccauguaaaaguccuuaggcaagaaagugauuggcugguucagggaacugaaagaugaguguggguggggcccagggaugaugggguauuuugagguaggcuggagccaggccaagcagggucucuagagagagcaaauugauaaaugugcauuuuauuuuaagugcaauguagagccaugaaguacuuuuuuuugcuugcuugcuuguuuuguuuuuuaaucgaagaaguaaccugaucagauucauguuuugaaaagacuccuggcuccuguguggagaaaggauuggaggagaggaagaagagauagagaagaauuagaaggugauacaggcuggguacgguggcucacuccuguagucucagcacuuugggaggcugagguggguagaucgcuugagcccaggcguuugaggcagcuugggcaacaaggcgaaaccccuucucuacaaggaaaaaaaaaauuagcugggugugguggcacaugccuguagucccagcuacucuggaggcugaggugggaggaucacuugagccuaggaggcagagguuacagugagccaaaauugugccacugcacuccagccugggcaacagagugagaccuugucuaaaaaaaaaaaaaaaaaaaaaaaaaaaagcaggugauacaauauugggauguauuguagagggcuggauuggggugguugaugguagagaugagguuaaaugaaagguuuugagaguuuguuuuucuuuuucccuuaugaccucaugaaagaagauuugagagcuuuuaugagacagaaaugaggggacuuugauugauuggauggaagagagacaggaucacgaguuaguuuuauacauauugaguuuuguuuuguuuuguuuuugagacggagucuugcgcuguugcccaggcuggaguguaguggcgcaaucucggcucacugcaaccucugucucccagguucaagcaauucuagcugccucagccucccuaguagcugggauuacaggcgugugccaccacacccggcuaauuuuuguacuuuuaguagagacaggguuucaccauguuggccaggcuggucuugaacucccgaccucaugugaucuguccgccucagccucccaaagugcugggauuauagaggugagccaccgcgcccagcccauguugaguuuuaaaugccuuugagaaagccagguggagaugugcugagggagagaguggagaaaaugugaaauagcccuugccgagaaugggagagcaagucuacugaugaaucauuuccugcucuucccucugccugggacuuugcccgcagauucuucacuuuacucgguccucuaauucaaaucucaguucuuguaucaacuccuugaagagcuuuuucaagcuacuuaaguuaaaauagaaccuccuuucccaacaauaacuuucugaucaucacugcucuaauuuaaaugugucccccagcauucauguguuggaaacuuaacugcaacacugcaacaguguugggaagugggggcuaauggaaaguguuuaggcaguccccuuguaaacagaucaacgccaucacaaaaagggcucgcucacuuguacucuuugccuuuccacccucugcucugcgauaaauagggcucucaccagaugcuggugcuuggaucuuggaauucccagccccuuaaaacuugagaaaauaaauuucuguuauaaauuaugcagucucugguauucuguuauaguagcacaagaugcacuaagacaaucaccuuccuuuauuuucuuaacacuuaucaccagcugaaacuaucuucuuaacuugauuuucuuaggcaaaauaucuacucacauccuuugcccauuuuuaaauuggguugucuuuuuauuguugaguugugcgaguucuguauauauucucgauacuauaccccuacccagauauauaugauuugcaaauauuuucucucauucuuugguuugucuuuucacuuucuugguaguguuuuuuguuuguuugguugguuuuuuuuuuaagacagggucucauucuguugcccaggcuauggugcaguggcaugauuauagcucaucauaaccucaaacuccugggcucaagggauccuccugccuuagugugauaguguucuuuaaggacaaauguuuuuaauuuugaugaugcccaguuuauuaauauuucuuuuauugcuugugcuuuugguaucauguaaccauugcugauuccaaggucacaaagauuuauaccuacguuuuuaccuaagaacuuaauaguuuuacccuuuaaauuuaggucuuggauccauuuugaguuaacuuuuuuuuauggcauaggguagguauccagcuucauucuuuuacauaugguuuaaucaucauuuguuggaaagacuauucccuauuggauagucuuggcacucuuguaaaaaaaaaucacuugauuauguauguauggguuuauuucuauacuugcaauucuauuccauugauccuaugcauauccuaaugucaguaccacacugucuauuauuacugugguuuuguguugcauuuuggaauugagaagugugaguccuccaauguuguucuuuuuuugaaguuuguucuggcuauucugggucccuugcaaaaccacugaauuuuagcaucagcuuaucaauuucuacaacagaaaaggggaguuaggauuuugauagguauuauauugaaucuguaaaucaauuuagggaguacugccaucuuaacaacauuaagucuuucaaucuaagagcaugagguaucuuucuauuuauuuaggucuucuuuaauuuccuuguguuguuuuguaguuuucaguguacaagucuuaugcuucuuuuauuaaauuuauuaauaaguauuuuaccuuuugaugcuauuauaaauggaauuguuuucuuaguuauaucuccaaauuuuuuaaaucugaaaguauagaaauacaauuaauuuuuguuauugaauuucuguuugaaacuuuggugagcucauuuauuagcucuaauaguuuguuuuugguguggauuccuuaggauuuucuuuguuguuguuguuuuuuguuuuugagacggaguuuugcuccauugcccaggcuggagugcaguggcacaaucucggcucacuacaaccuccuggguucaagcgauucucuagccucagccuccugaguagcugggacuacaggcgcccaccacucccagcuaauuuuuguauuuuuaguagacaugggguuucaccauguuggccaggcuggucuugaacuucugaccucaagugauccaccuguugcagccucccaaagugcugggauuacaggugugauccauugcacccagcccccuaggauuuucuauauggaagguuaugucuucuucaaacagaaauacuuuaaacucuuccuuucuaaucuagaugccuuuauuuccuuuucuugccugauuucucuggcuaguaccuccaguacaguguugagcaggaguagcaagauaagacauuuuugucuuguucuuagguauaaagcuuuuaaucuuucaucauuacauaugcgguuaccuugggcuuuucauagaugccccuuauuaacucaaagaaguucccuucuguuucuaguuuguugagugguuuuuaucaugaaaugguguuagauuuuuuuaaaaguacguuuucugugucuuuugagaugaucaugugauuuuuguucuuuauuuuauuaauaugguauauuauauugauuguuucuuauacguugacucaaccuuguauucuugggauaaaucccacuuggucauaguauauaauccuuuuuauaucuugcuggauuuuguucgcuaguauuuuguugagaauuuguccaucuauauuagaaacagauacuguuuuuuacguacgauuuuuuuucugguuuugguauuagaauaauacuagcuuuauagaaaaaauuggaaaguguucgcucuucuauauuuuggaagaguuugugaagguaugucguuaauucuuuaaacauuuuauagaacucaccaucugggccugcgcuuuucuuugugagaaguuuuuugauuacuaauucagucuuuuuacuuauuuuacgucuauucagauuuucuauuuuuucuuuagucaguuuuggcaguuuauaucuuucuuggaauuuauugguuucaucuaauuuguuguuccuuguauuuccuuagaauuuuuuuguuuuuguaagauugguaauaauguuuuuuuucuuucauuccugauuuuaguacuuugaauccccuuuuuuuuccuuggucagucuagcuaaugauuuaucaauuuuguugauuuuuuaaagaaccaacuuuuggcuaggcacaguggcucgcaccuguagucccagcacuuugggaggcugaggcagguggauugcuugagcucaggaguagcccgagaaccccuucugaguagaacauaucaguucgauauucccacuucauggggguaauccuguuuugucauccagcugaaaagacaguagcauucauuucagagugguccuuuuuuaagguaccgggccuuguagcuggaggcagagagagugacaguuacugggcuguagaccacauaucuauuugugccaauuugcuugaaaaaggacauuuguuagcagguuucagaacauugguaagauaacacucaguaggaagauugcuggcguuaugucagcuaccuuucuuucauuaccagaagcuacuaggauucaucagaaauaaccuaauauuuggugaauggcauuggcuuagacagauuugcuucagaccaggagguagcugaagaucacuggcagcugggacuuuccuccuuaucucugugcuucucuugcuguguaggcuugcuuucuucgcauagaaggcacaggaccaguggccucuguaccucacagcuucaagagcagauaggagggagcucuucccuuugccccgguugaaaaacuuccugggagaugacucuguccugcccugugggguaguggguccugugauuggucagcuuccuuuaucagaaaaggcugugucuggugaaagcagucacaccagcuucccuauagccccgcauuaaagcugaguggagagagggagggagagggcccugugcuauugugaaagaggauaauuugaugcuauuacagcucagauaaggucugggagaaugauuugccggacaggcaucuccaacugugcaacucagccacauuuuacauauguaacacuggguaacuuacuugauaucccuagugucauuuucauuuuuaauauaggaauaauucuuaccaugcaaaggcuuguaagguuuacuguauauaaagugccuguuacauaaggggcagcaaugagugaggaucugcugcuucugcuauuguuauuauuaauguugcuauuaucccuuucuccaaguccucuuauuuaacgguguuauuuuucuaaaacacaccuuuaagaaugcuauugcccucuuuguaaaccuuuaguagcuccccauuaacuauugaauaaaguuaaauuuccuuaacuacuccauguuuuuuuucagacccuucaggaucuggucccuguaaucuucuuuucagccucauuuuaaaaaauguuuaauuuuaauuuuuuugaaacagucacacuguuucccaggauggagugcagcagugccaucucugcucacugcaaccuccgccucccagguucaagggauucuccuacuucagccucccaaguagcugggauuacaggugugcaccaccaugcccagcuaauuuuuguauuuuuaguagagauaggguuucaccacguuagccaggcuggccuugaacuccuggccucacucaagugaucugcccaccucagucucccaaaguguugggauuacaagcgugagccacuguuccuggccuucagucuuaucuguaaguuccugucugcacccugugcucuugucuguacaucuacucuccuaugaauaggaaaguaaaguuuucuacaucugugccuucgcugauguuguuuccuugucuuggaauggccuuucccccacuaccuucccuuucuuuuuaucagauuucuuuuuucuuucuuucuuuuuuaaagccccagguugaaacuugaaaccugaucauuucaguuuugcuuccuucccugaucuuuuuccuugacugggaggagccuucuggaguccacagcacuuauuuuugcucuauuacgauuguuuacauguuagucuuuuuuuuuuuuuuuuuuuuuuacauuuugcaagaaucuaagccaguuguuuuguagaaugucacacauucuggauuugcgugauuauuuccugguuguauuuguuuuaauuauuuucaguuaucucucuuaguuuuuucuuuuuuguuguuguugaaaaaaggguuuugcucugucacccaggcuagagugcagggguguggucauggcucacugcagccuugaccuccuuggcucaagcaguccucccaccucucagccuccugagagcugggacuauagguguguaccaccacaccuagcuaauauuuuguauuuuuuguagagauagaguuucgccauguugcccaggccgaccucaaacuccugggcccaagugacccucuugccuuggacucccaaagugcuggauuaggaaauuaggaaacgacuaggauuauaauuggcccucuuaauguuguuuaauuuguaacccuaauaguuguauuaccacugggaccugucuugccuuuuuucuguuuacuguaauuuuauuuaaaaaauuguguuauaguagaagaggaucaaggaugaauauauucuuaccuuguuuggguuaauuuugcauucuaaccucaucagggauuuucaaaucuaauuauuauuuuuguguauuuccuuuacacuugaagggaagauaaguauaggguacaguaaaagggcgacuaaaugcuuaaggaauguuuucaucaacuguuuucuuucacuguguuauuaguaaagaacucuuuucaacucugcuugguauugagaaauuuuuuuccuaaaauauaugauuccugauauuuauaguuagaacaaaaagaauacucuguuuaguaucucgguaaucacuucugaacaugaauucuuacggcucaagacuuuggauguagggcaucuauaguuucaugugggauaaucaucuuuaaaacauaaucauucaauauuggcuuguuuugcugcuuucucacacagguggaguacaggaaaauaccaguuguucaaguauuaaguauuuguucaacuuccauuauuugagauguuacuuuguuguauugcacaugacuaauuuacucuuaggaauauuuacugaauguaaacauagcacuuuugcauaacauaggcuuugcuuggcucaguuuaguaagagacacagaaaggcuaaguuacauuucaucaguaaauguuuuuugagcaccugauguguaccagacacuguucugaggcauaagucagauacaauuccuacccccuaagguauguguagucuugugggugaaguaaaccagcaauuauaacacagggugaugcaugccacaacaggggaacacacagaagacucugggagcccaggguggaaaucuaaaucagacagagcuaaggugcuuggaaugacaacgaggcagaacauuugggucaagaaaauuccaaacugagggacauuggaugagaagucacagaagcaaaaaauguuacccauuuggggaauugcagagguaaagcuaaagcaauacuucuugagguauggucuucuguuugccuuugucauaauuaucugggggcagcugggugcggugacucacgccuguaaucacagcacuuugggaggccgagguggguggaucaccugaggucaggaguucgagaccagccuggccaacauggugaaaccccgucucuaucaaaaacacaaaaauuagccgagcaugguggcgggugccuguaaucccagcuacucuggaggcugaggcaggagaaucgcuugaacccaggaggcggagguugcagugagccaagauugagacauugcacuccagccugggcgacaaagcgggacuccaucucaaaacaaaacaaaaaaaaauaauuaucugggagugauucuuaaaccuccaggugauucuuagccuucuaggugguucucugacucucuaaaguaugagaaacauucguacuuaagggaaugaagaaggaaugaaaauaaugauguaauauauguuacauuaaagguauguguaaaguucuaugauuagguuaauuuauauagacuguaugacauuuucauuuaaaaucuguuuauuuuccuauccauaaguaauuucuuuuuggaagagaaauuggcagaagggauggguauuacuguaaaucuuguccuuuuauccccagaugauucuaaaaacaauuuaccagucuguuaauguuuuauucauugaaugcuuuguuuuucuuuuaguccaaggacaaaaugaugagaggcucucgcagaggauguguuagacucagagugaguauuuauucauuuuuaugaaaaucaauuuugacagaagaaaauuguauucugauagaauuauggaagucuaaauuuaguuuagcuuccuuacauaauuguuggggcagguaucuaagucucagagagaaaaugugauuucuccaaguaacuguuagucaguaucagaaccaggacuagaacucaguuauuuuggcccaugauucaauguuguauuuaugacuuaaugcauguucugauuuucuuaaaccucuacuuuacagacaagagacaagggcuggaaauuaagugaguuaugguguuggugguauaucaacaguagaaaaaauggaaaaaucccaacuguuagcugccgcugcuuuguuuuuccuguucagcacuauuuaaucaugguauauauagcagugcuguccaguagaaauacaauguuagccacaucuauaauuuaagauuuucuaguaagccacauuucaaaaguaaaaagaaacaggcaaaauuaauauuuuaucuaggucaguauaucugaaauauuguuauuuuaacaugugauuaauaaaaaaaaauuaagauauuuuacaaucuuucuuuccauacuaacuauucaaaauccaguguguuuuuuacacaaaggguacaucucaauuaggacuagcuguacuucagagaaggggaucaauagccacaugugacuaguggcugccuuauggugcagaccuauagcuucaugcugcuuucaguuuccaccauuguucaaauagguaaaggcaagaaagaaugcauggcuagggaugcaguuucuaguaucccauuguauaugaagaaaaguggccucuaucauaacuagguuaaucagcuucuaggaaccuuuucuucaggacccuguugacuucuuucuuccaccuuuuuuucugcauccuuacuuuugaagaugugaauauauuugguaaacauauuauugcccuuguuaacaguccuugauagaacugggaaauaccgcugagaaagacaccaaauuauaauagaaaaauccuggcacugagauaggaguagguaugggagauuugcaggauggaaaugagacaggcuuguuucaaucagaugguauauaugugauagcacaaagauuuuuaaaaauucaacuucuaguuuuuguuuuuuuuuuucuaaaauuuuccuuugguuucucuuuugucuguuugguguaauuacuuuucuaagcacuugcuguugaccucagucaccagucagucugguauuaacugcucuuuuggcuugagauaaguucaguagugagacuuuagcagaacugucuugacagagcacugcaguugaauuccauuuggauuuaggccacugucucauuguuacaguuaauccacugguuuugucugucuuuauuuuuuuguuuuugcuuuuaaauguagcuuaauuaauuauuaacccuucuaacuaccaccuuaagaaauagaauuuugucagcuauaccugaagccucuccacgugccccaauuaaauaaauuacaucccuuauaugucuccuaaaguaaucacuucuuacauuugguuauaacuuuuuuacccaaauguguaucccuaaguccuauaguuuucuuaccuauuuguuuaacuugaugucuuuuguuuacaauuugucuguugaagaaucuggaccggcugggugcuggagcucacgccuuuaaucccaacacugggagaccgagcgaggcagaggaucauuugagcccaguaguucgagaccagccugggaaacauagugagauccccaucucuacaaaaaauuuaaaaaauuagcuggauguggugacacaugccuauagucccagcuacuugagagacugaggcaggaggaucacuugagcccaggaagucaaggcuguagugagccauaauugugccacugccuuccagccugggugacagagugagacccugagacccuaucugaaaaaaaagaaaaaaaaaaaaggaauccagacccuuugaccuauaagaauuuuccauaguauagauuuuacugauugcacgguggugcaguucacuacauuccucuguccauuguuuuugcugcaaauuggcagcuggauccagagacuggaucagacuuagguuugaucccuuuggcaagacuguagguggugguguguucuuuuagcaggaagaacauagugucuaguuuuugcccuuuguugauauuagcagcuauugauguucaguaccuacacccauuaacucacugaggguugcaaaauaaugacaggcuaucauuuuguuuuaauuuuuaucagaaauaauuuuauaaggagacauuucaucuauuauuugguuacccaguggugcaguuaaaauaggcaagaugacugcuugauuauuuccuauuauuuaccaaauuuuaaagguaaugaauuggcuucaaaaacaaccacuuauauauguguuuauauguauauuuccaaaagaauuggaaacagggacugaaacagaugcuuauauauccauguucauaggauauauaacauggauauauagcauuauuugcaauauucauagcauuauuugcaauauucacaguagccaagagguggaaaggauccaaguggccauccacugaugaauggauaaaaaaugugguauauaaauacagucuauuauuauuauuauuauuauucagucuuauaaaggaaggagauucugacacaugcugcaacauagaugaaccuugaggacacuagacuaagugaaauaagccaguuacaaaaagacaaaaaggguaugauuccacuuaugugggauuccuagaguagccaaaaucagagacagaaaguagaauggugguuuccagggguugggaguacgggagauggggacuuaguguuuaaugaguauggaguuuucaguuuggaaagaugaaaaagcucuggagauggauggugaugauggugaucaucacaucaugaacaaugugaauguccuuuaugccacugaacuauacacuuagaaaugguugaaauaauaaauuucauguuaguauguuuuaccauacacacaaaaacacccauauauuucacaguuuuauaggucagacaucucuguuggguuuugugcuuaaggucucguaugacugaaaucaaggaguuggcuggacugggcccuuaucuggaggcucugaagaagaguccucuuccaggcucauucagggcauuugcagaauucaauuccuugugauuguagaacugaagcccuguuuguuuuuuguuuuuuguuguuguuggcugucaguuguguucugcuuucagcuucuagaggcugcacguauucuuggucacguggccuagaccccuccaucuucaugucagcgaugugcauugaauccuucuggugcucugaaucuuucugacuucccauucggcuaucagcugcagaaaaugcucugcuuuuaaaagaccucaugugaugacaucggauuagguccaccaaauaaucucccuuuugccauguaauguaacauaauuacuccugcgauaucauauucaugguuuucauccauacucaaaggggaggagauuauacaggggcaagggucugugagagucauucuuaaaauucugccuacuacacagcaugacagagaagaaccaaauauaccuguguuugauucccauuuuuacccauuccuuuguugaguggaaaagggaagcuaucauaagcuuccugagcuuuaguuuccucuucuuuaagguggagauaauacucuucuugcagaauuuugugacgauuagguccuggcacauagauggaacuuaauaauuagaaacauguauguguguguuugucccucugugugcacacacgugcauuuuacuaggcuuuguaguauuuuccaaaaauuaaacugccgaggcuuuuagucaagaaauaucuugaggguuuguuuacaauacaguuaccaaguccaccuucuagauaggcugcuuuaguguaguguucuggaaccuuuauuuuuaaacagauuauccagguaauuauguuguguaaccaagagggaccacugguguagaaacaaucagagagaccuggggcugaauuuuacucagcucuucccuuacugacucugacauugggcacauuucuuaacuuuuaugaggauaccgugauauaacugguacgguuguaaugaggcuuagcaauuauguauguauaggaaacaguaacugcuauggaugacaacgaugaugaugaugaugaauaugguagugauacugcaucuagauuccaaaugagcuuaaugagcuaucauugacugcacuacugaucuugcccuugccccauccaucccauccuauauuugaaucacacuauguuucuuccuuuucccucacugugcuucuucauuccucauugcuucugacuuuuucuuuuucuuauaucauggaaguucugcacccccuaucugaugagcucaucgcuuaagagacuuuucaaauguuaccucaucugugaagccuuucuaauccgcauacuucuaacagguuuaauucuccccuauccucuacauuuuuuuuuccuucuucccccacuccugcuucuccucccccuccucgcucuccccccaacuuuugacaggaucuugcucuuuacccaggcuggagugcaauggugcgauuauagcucacuacauccccaaauuccuggccucaagcaauccuccugccucaaccugcugaguagcuaggacuacaggugugcaccaccacaccuggcuaauuaaaauuuuuuuuuuuuuuagagacgaggucucacuguguugcccaggcagucuugcuaacucagucuccuaacucccgaccucaggcaguccuccuaacccagucucccaaagcauuggaaauuacaggcaccagcgaccaugccuggccuauuuuuuuacauuuguaauuuagagccaugaaauuacuuguuacauuguauuacauguuaauuuuucuguugucuccacuuggauaauaaguuccuauucagugucacaguugccuggcacauaauaaauacucaaaaaugcuuauuguuaauuuuauguauuuaugaaaauaaucaguaaauguugggaaauuugccuuuacuaugguuugcauacaaaagaacugugggaguuauuuaucuuaaacauaaugugagccagugguaugauguauuuucuaaaaagaacaaagcaaaacacccacaugaacauaggguacauaaaaggagaauggagaaagggaccauagaggaaacccagaucaggugcugugcuggaugauuuucauacacauuccuaucauaacccugucagguaaaugcucauauuucauuuugcagaugaggagacugagacacaaacuacucuuaguaacuuaucaaggucacauaggaauggugaaucugagauuggacuugggucuuauuucaaagcccuguucaauucuuaauguuacuaggcucccauuccucuggacuagaagagugaauucagauacuguaagucauuauaagguagugucaaaccaguggaggaaagcagaaaagugaaaaaccuucuuuguguugguuaugaagugugugccacuagacggugcccuuuccuugaugaagaaauaaaauguugcuugaguccuguggucugauccucucccauacuagucaaaaacaaaacauuggcauuuucagauaauaucuggaaaauggagacaugacaacauuaaagaggcaguguggcccgggcuugguggcucaugccuguaaucccagcacuuugggaggcugauucaggaggaucacuugaguccaggaguuugagaccagccugggcaacauaaugagaccucuucucuacaaacaaacaaaaaaaaugaacaaaauuggcugggugugguggcuuacaccucuaucccagcuacuugggaggcugaggugggaggaucacuugagugcaggaggucgaggcugcagugagcugagaucauacuacugcacuccagccuggguaacagagcaagacccugucucaaagaaaaaaaaaaaaaaaguaggguguaguggcaaaaacaaauacagggcauguauguaaugaaauucagacuuggauucugccacauucuggcguugugacuugaggcaacuuuucagcucugagcccuauuucccauaucucuggaauagacaucaugccauuuacucauaguguugugaguaccagauuaguuaauacauuuugaaaaguacucaaacacgguguuuggagcuuaauaggaucuaaaugaaugguaguuuuuuuuuuguaauucauaauuucuauuaauacagaugaaucucagauucugaagaauucuaaagggccuuaggaaucaccaaagaaaaaugaauuauauuaaacaaaguuuuaaugguaaauuuauuauacaucuuugaaaacuauuaaucuacaugugauuuagagugacccucuuuuacuccauccagugaaacuaaguauuccauuuaccuguugugcuagguaucagaauugaaugugauuuccugagagaugcauuaucuauucucuuuucuuuuagucuaccacaagagaggucgguggugcaccaugacagaauauuaauauuuucaguaaugacuucuguuagugcccuauuucauugauaccaucacuuuuuuuuuucacaaugcaauaagguguuauuuuuagguuaauguauaaccuuaagaaugucuuccuuuuucccuuggaucuguauccuguaagaacuuuuaucaauugucuuguuauuucacagugaaaagucacucuauucauuguggcuuuucucguuaauucaguagccuuuuuguaagcucuuucucuucucuaugaauuuaauauugaaaauauccucccuugggcaagauguaaacaucuauuuaaucucugugauugguacauagaugucauuagugcucuauuuuaugaauguuuauacuauuucauaauuacaaauuaaaaauuaaaugaaaaagaaagugauggaagaauauauuccaggcaagugcuaaccauaagaaagcugggaaacagaauuaauaucagacauagaauacuaagaaaagaaauuaaauuguuauggaaaaagagaauaccaaagacgcaguaucacauagauaacauucuuugacaacaauggaaaaaauuagaaaucccuugaugaaacaguagccacccaccucacacacauacuucugaauaauucauugguggaaguagaaaugauaauagaaauugugaaauauuuaagucugaacgauaaugagaaaaccacauguuaaaacugcaucuauggaagucugauuuauaaucuuaaaugaauauauuacaagacagauugagaauuaaugaucuaaacauuaaaauuuuaaaauuagguaaagaaaagaaauagcaaaggaaauagaaagaagaaaauaacaaaaagaauacacuaaugaaaugggaaauaaacaguagagagcauaaaccaacugaacugugauucugugaaaaaaguaauaaaauaaacccugguuagauugggaggaaaaaaacgaaggcacaaauaaauaauauuaagaaugaaaaaaagaaaaguacguaauaguagagaugaaaaauugucaggaagcuacuacaaauacauuuugccaauaaauuugaaagcuuauaugaaaauggauaauuucucaaaaaagcauaaaucaacaaaauuaggcugucaaagaacuugacaaggugauucuaaaagucauuuaaaauuugggaaaggggagagauauuuuuaaagaauaaggaguugguggacuugccacuccagauauuaaguuuuuaacugaaacuaugguaauuaaaaugguauggugguguuauaagagacagaaauagauuagcggaauggaagagaaagcugaaaaacagaaccauuuggauuugggucuuggagaaagcuggaaauuugguauaugauagagcguuacaaaucagacauuaucacuuaguaaaugaaacuggaucaauuggguguccauaugaaaaaaagaagauuacucuuuaccccaugugauacacaaaaacaaauuucagauguauaagagguauaaaaugaaauuuuaaacuuagaaaaaaagcauaggugauaucuuuaugaugucaagauagagcagaaagcauaaaccacaauggcaaauauuuguggauuugacaacauucaaaauuuaaaaccuuugaacaaaaaaagauaccacagucaaagggaaaagacaacucauggauagaagagaaaauacuuaaaauacaucaguuggcaaaggauuaauauucuguguauauauaaauaacuccugcauauuaauaaagaagacaaaaagaaaauccccccaaaugcauacaaaucuguaaaaaagacaaaagaauucucaaaauguagaaaaguuacauacuuucaauucauguaagggggaauaagaagguaaaauauugaaugcaaaagcaaagcaaauuguuuaccacucucuuacuggcaucuaggccagugccuagaaauucaauaaauacuuguugaaucaaugaaugaaugaugcuaaaguagguccuccaugcagcgucuucuuuagugagcagguugaacugcaagccauucugcucccuucuauauuauugauucugucacuccucucuagacuguauguuccuccagggcauagacauguuuuguaucccuuggcuguuacuguucuuggcccagaauagguauuuaauaaguuuguugaaguaauuagugaauauuguuuacugucaccauguccuguuaagaacaggcuuuggaucaggguuugcaagaccuaguauucuucucccuuuuaguuguuggacuuuuggcaaacuuaaaaaaaauuuuuuuuaaaccugagucucaguuucuuaaucucuaaagaagaguagugaccuguucugccuaaaucucagggaccacauuuaaaugcacuaugugaauguaaauagacuuccaaugucauuuaagcagugaugaaaaguaugugguuguagaguuauaaugggaguagcuaugcuguguauucuuagcacugucuacauuccuuuuaggagccugugagcaaucuaugucucagaggagucaucauucuuuuuuauuaucuuuggaaccaguucaccagccuacuuuucgcaaagggagauuggccccaaaauagccagaauuuuguuucucuuuuuuuaccccaagccgugagagcaaaacuaucugucugucuuuggcaucagaaugaugauucaugucugaaguaugucuguguguauagaaaaaaaacgaaaagagagaaagucaggaaauucauccagugggacaagacuguguagcucuaguuucuuuuuggugccuugauagugugacccuggagcaacaggcaccuuggugaccucaaguacugauagaacuuuaagaagcugaccaucugaaaccuucagaaaaaaaucaugagaggucacugaaagauguauauguuuauuauguuggcacaaugggggucauaaaaguggaguugaaagaaaaacauugauauuuuuguggguuaguauaacaaauaacuuuucuuaacaacagaacaccauuucauauauagauuaucaaagggaguuuugcuuuaccagauauaaucaaaaaaauacucuaaacccagauaaagggagaggaaggaugucucaggcagagggaacaugugcaaaaaauggugguaggagagaaauuggggcaauugguaaaccuuaagcuauuuaaguguagaauagagagguaggcauggagcaaaucacuaagggccuuguaggcuaggcuguggcggagagugaccacaucccuuaaaccagaacugcuugagaaugaaagggggaucuauucauuauugagccaggacaacaggaauaauccaggauuguuccuggcaaaccaggucguauggucaccuugugugaaggugaagaagaaccauuggugugguaacauauccuccaaggaauggaagguuaaaauaaauuauaaacuagaggauuggacagcugaauaaucuugacuaaaagggaaugagagaggcuggccaauugcuugguuaggacauggaauugaaaagggcuguuguuaaagaguauaaagacuugagucuugaguauguguaaaugcaguugggaaaaagagagagagagacagagaagagaaauagagaccaggaagagagagacagaaauugaaaauuggcagggauauggagcaugaguguggaaggacuggguuuucgauagaagaauggaugccuuuuccauuaugauaaguggaaaggaagcaugcuggguuuagaugcaagugagucuucaggugggagggcacaucaggaagguuuagaauuucuacccgauggcugcuuuuguuguugggaguccuagccaaugaauaaagcaauaaaagacauauaagguguaaggcuuggaguagaaguaauaagacuauuauucacagcaacuuaaucgagcauauggaaaauccaaaagaaucuauagauauaacuauuagaauugagaauugaaucuagcaagauaagcagauacaaagucauuauauaaaaaucaacgaauuuuuuuuuuuuuuuuuuuugagacagagucucgcucugucgcccaggguggagugcaguggcgugaucucggcucacuguaagcuccaccucccagguucacgccauucuccugccucagccuccugaguagcuaggacuacaggcgcccaccaccaggccuggcuaauuuuuuguauuuuuaguagagaugggguuucaccguguuagccaggauggucuugaucaccugaccucaugaucugcccgccuuggccucccaaaguacugggauuacaggcaugagccaccgcaccuggccaaucagugauauuucuguauacuaacaacuggcaaucagaacaugaauuuuuuuaaauggagaacauuuauaauagcaucaaaaagcaucaaauuuuuaggaauaaauauuaacaaaagaugagugagaccucuacucaggaaaugauaaaacauuauugaaauuuaaaaagaccuaaauaaaugacagucuauuuauuuagacuggcaaaucccaguuuauuucuagucauuugagucauuaugcuggcaaguguguguguguguguguguguguguguguaaaacguguguagcugacuaaaaauuuaugaagagucaagaguauccauuccugauuccugccuucucagccaacauacagaacccaguagaaauggugauuugcuuuccucugccccuuuggggauggcuggcuaugacuauguucaagauguuuauuuauuaaaaaacuuuuuuuaaauuggaggauuuacuccaccugauauccaaauguaaagccuuccagaagauaauguaggagaauauuuucauggccuugggacugggaaagacuucuuaaaggagacauagaaagcagaacuauaaaauguaaagucaauacacuguccuacauuaaaguuaagaauucuucaucaaaagauaucauuaugugagugcaaaagcaggcaacagaguagaaguagauacuugcuuaauuuauaaccauugaagggcucauacccaugauauagaaagaacuccuacaagucauuagaaaaagauaguccagucuugucaauggagaagaaacuuaaacuauuucacaaaagaggaucuucaaauggucagaaaccaugaaaacauacuuaaccuugucaguuauuagggaaguggaaguuaaaaccaugaugagaugucacuacuuaccugccaagaauaacuaaggugaaaaacuguuagugaaguuauuggaacaguugaaacugucguauaccacugaugggaguauagcugacacaaccacuuuugaggacgauuugauaguaucuccuaaaccugauauaugcauauccugugaccuagcaaauuuacuuuccuagauuuguauuuaauauaaauacauguauaacaaaagauaugaauaagaauauucauaggagcuuuauucuaauaacguaaaacugaaaacaacauaaauguccaugcacaauggaauugauaauugugggucuauacagaggaaugauauauauagcaauaaaagugaacaaacuacugcuucaugcaacaauauggaugaaucuuacaaacauggugcaugaaagaagccagacacaaaggaaaauaaguggugugaguccauuuguauacaauucaaagacagggccaggcaugaugacuccugccuguaaucccagcacuuugagaggcugggauggguggaucacuugaggccaggaguuugagaccagcuuggccaacauggugaacccugucucuacaaaaaauauaaaaauuagccgggcguguggugaugcaugccuguaaucccaguuacucaagaggcugaggcacaaauaucacuugagccucagaagcagagguugcagugagcugagaucaugccacugcaguccaaccuuggcaacagaguaagacucuguuucaaaaauaaauaaauaaauaaauaaguucaaagacagacuaaacuaauuguuauauuagaacuaaggauaguauuuaucuuuggaauggaggguuggguuaaugauuaggaaguguuacaaggggagcuuuucuguucauugagcuguacacuugugauuuguauauauguuacauuucaauguaguguuauuuucagaugagauaguauauguaaaaugcuuagcauaaugccucacucaugaaaaugaguucaguucaauagcuggcagcauuaacuauuuacugugguuuagugcucugugaugauaagauucacggcaguguuauccaacagaccuuucugcagugauuaaaauguucuguauuugugcuguucaguuucauagucauuagccacaaguggcuguugaacauuugaaguaugacuagugugacuaagggacuuacuuuauuuauuuauuuaguuuuugagacagaguuucgcucuuguuucccaggcuggagugcaauggggcagucuugguucacggcaaccuccagcucccggcuucaagugauucuccugccucagccucccgaguagcugggauuacaggcuugcaccaccaugccuggcuaauuuuguauuuuuaguagagacgggguuucuccauguuggucagacuggucuugaacucccgaccucaggugaucugccagccuuggccucccaaaguggugggauuacaggcaugagccacugcgcccggccugagggacuuauuuuaaauuuuuacuuaacuuuaauuagaacuuaaauacccaauauguggcuaauggcuauuguauuggacaguguggauguaggguuuuugucauaggaaaugaaggacugaaggagaauagcaauguaguucauuugaguaauucaacaaaucaagacacugagagaccagagcaucagaucaauugugcauauauacacugaagaaugcucaggaucaugacaagaccugauuggaguaggagacuguuagcuagguucgagucuucaaagaagccuucgauuagagaggggaaagugcaaagguccagaaaguaauguuuuuuuccauauagacuaucuaaaguacgcagcgagaaauguuucugcagcagcaacaggugcuccagagaaauguuuuguguauauauauauauuuuuuuagagucucgcucugucacccaggcuggagugcaguggugcgaucuuggcucacagcaaucucugccuugaagugauucuccugccucggccuccugaguagcugggauuacaggcaugcgccaccaugccuggcuaauuuuuguauuuuuaguagagacaggguuucaacauguugaccaggcuggucucaaaccccugaccucaggugauccgcccgccucggccucccaaagggcuaggauuacaggugugagccgccgcacccggccuccggagaaguucuguacaacaaaacuaaaguaguaauguggucauuggagaucugugagagagaaguuuggugccgugagaggaaggaagccagcuugcaagaguggauggaagguuaagguacagccaauuuucaaaaagcuccucucugaaagcaaugugaggagaugugguagcuagagggagaugugggauuuugcuuuuguuuaacaaauggugagaaauagagcuugaagaaugaccuuaaaaagugaaauugcuugguguuuuuaaaaauuuaaaauauuaaaauaauuauuuuaaaaauuuaagauccucagucauacuagucauauuucaaauguucaguagccacuuguugcuagugacuauuaaacugaacaguacaaauacagaacauuuuaaucacugcagaaaguucuguuggauaacacugccgucaaucuugucaucacagagcacuaaaccacagugacuaguuaaugcugccagcuauugcacugaacucauuuucaugagugagguauguggaagaaauguggaagcugaauucauauggggugucugugagguggggcagaaggaagcugggugacgauaguggaaauguugguugggccagauuuugaacagccuugaaugacauuaugaaguaaugcugacuuuaucuguuaguucauagagagccaaggaagguuuuaaacaugugagucucuaauaagagucugugcuucagaaauauuacuccggcaauagcaaggacugugaacuaacuguaaaguguccagacugaaggcaggcagauuguuaccaaacaagaaacgaugaaagccugaauuacagaaguagcagagaggauggagacaaguuggugaacuuaauaguugagagguagaaugagcacagccugugguaauggaacaagggguaguuguacagaccuggagguuucuaccagaguugacuaggugacuuguugagcuuacauuuggguucuuaauuaaggaacucaagagaaagagcaggcauuugagaguggagugaguugcaauagcuuuguugagauauaauacauauacuaugcaauuuaucaacuuggaguauccaauuuauguuuuuaguauauucacagaguuguucaaccaucaucauagucaauuuuagaauguuuucaucaccuuguaaagaaaucuaguauacccauuagcagccauuccccauuucaccccaacccucccagcacuagacaaccacuaaucuacugucagucuaugaauuuaccuauucuggacauuuuuuguaaguagaaucauguaacaugugauccuuagugacuagcuucuuucacuuagcauacuguuuucaagguucauccagagagagauaacuuuucgcccuguauuauagucaccucuuugcauguuuuaucuccuguacuggauauaagugccuugaaggcagggcauauauuccagagcuguauauugcauauauuuugguauuuaguuauggcucaggaaauauuugauacaucacaaguuagaagguuaacucaguuaaucacaaauuacauuaaccagaaugagcuguuucugcacgugcuuacccacugaagugugucuguauuugcugucguggaauagcuagguuccaugccaauggugaucugguacugguucugcuguuaaggcuuugugugaccuugggcaagucauuauacucucuggagacacuuucccuauuugaaaauggagauaaaauuuccuaccccaucugacacugaggaauaaguaaaguaauucaaguagguggaauuuggauagaguugggguucauccagauagccucuggggaagaaaugaauaaauguuugauccuauucccuaauauuccugguauaggaguagucccccuauguagccuuuuuucaugggauuagguauuuuguccccuugagucauuucaacucccuugucaaggucucugguuuuaucaagggcacacggcuucucuuaucaccugaggcauuugaccuauucuguguucuguagucuuucucucuggaauacuuaagauacuuuuuucuuaaggacauugaacaauagauucccuauuuugcuuaguuuccugucucuuaucuuaauuccuguugucuucacagaaugcauguaguugaauauuaagaaaagggggccaggugugguggcgcacuccuguaaucccagcacuuugggagacugaggcaggcagaucacuugaggucagaaguucgagaccagccuggccaacaaggugaaacccugucuguacuaaaaauacaaaaguuagccgggugugguggcacacgcuuguaaucccagcuacuugggaggcugaggcaggagaaucacuugaaccugggagguggagguugcagugagccgagaucgugccacugcacuccagccugggugacagccuaggcaacagggugagacucugucucaaaaaauaguaauaaaaaaguauuuuuuaaaaggguuaaaaccuacccaguccgccuucccaaaacaacuuguaaauucaguuccccauugugugugccugcccaccccccaguuuggagaguuguuugugcucuuauuuagaaacauauacuaaguauguacuuaagugccauguaucaaauaaaauaguccuugauuucuaagauuucauagugguucuguaggaagaugcugacauaugaacagauaaucacaguauacugugaaaagugcucuuggagggcaauguacaagugguuauggaagcacuuggaagaagggguugggacaguguuuugaagcaaaugucaccuggcauuucuacacuaacaaguauauacuaucacagaagcagccugcugaagagcaccugccuucuuucagccuuacaacaaccuggugagguguagguuuuugacucccauuuuagagagcauucugaaguucagaaaggcucaguggcuggcucuuaaaacacagauccuagauucagcuucuguguuugucccuuccgccucccagcacaucuaugcccuuaaggaaggcauagaauguaccuguacaugguacuagaguguccugccagcuccucuccuuuaguucuuucuccuuaagcaaaacuagagucucaguuuccucuuuucugugucuagccugcuuccagugucguuggugcauugaguauuccagggcuauagcaguagugaauauugcugaugucauuguuugccuuauugggauuuugcucuuuguuucacagggagcugugauugguauagacgaugaggacgacagcaccuucacaauaacuguugaucagaaaaccuuccauuuccagggugagcugaaagaagagauucuuucucuucauagucccaucugcuucuuuucuucucuuuuggguuguuugcuggaugacuugaaugguuuugcaacugauccugcaugaacgagugcauaggaacauucuggaugaagugguacugcagguuaggcagggauuuguaucugcaauggauguagaucgauuugaaacgacuguggaucuggcugcaguuggagaugaaaauuuuaaaggauaaaaaucagugaagggagagaguaaugggcugcugcugcugcuggcuuguguuuacagaagguugcugaucuucuuuaucaaggaguaugguucugcuucugcaugaagagucuaaagacugauugugaagguugcaguguuugucuguguaaaacucaaaauauaaauuaaauugaagcuuaguggcaaccuuuggcuuaaagguuuugcucugcuucaagaacuacaaguuugcauucauuucaucuguauuucuguguuuuguuugccagccaucauuucucugcuauuauccuuuuuauaguuaaaugccaucugccacugcuauguuucggcauugcaugcuaugguucaccgguagaaaggguaagguacuguaugaucauucucauuucauuuugcuuugaaaacucuaaaccagcaaauaaaagucaauuuuaaugaucuuguccuaaguaccucuugucuauuaggagugacuguuaguuuuaguauuaaugguuuuguuauuuugccuuuccagaguaaucucucuuuuauguuucgagcaguucaagaaacuuagaaaugaaaagauuuggagagguuagcacuuucucucaacuacaaguaacagugcacuguuagagaugcuagguaugccaagauaaauaaauauuaaauacauuuauugcuuaaaaauguuuugguuaugaagucuaacagaggccagauauguuauaugagguguuuaggcagcuguugucuuuuugugcuaggauagugaauugcaguuauuuuucuucauugucuucuuucagaaauugacagauaguaaugaaagaugcagguuauauucaacaaaccuaaaccaguguacucaauagugauaucucuaaugcuuucuuccacauaaccuuaaaauauuuacuguguuugaugauauaauuuauucagagcugcuuuaauaacgaugcuguccugaaauuuucuacuauauuuaacuucauaaaacauuuuaaauccuauuaugaaagcccagaguuuuuauuuuuaaguuaaauauguaaugcugccuauaaaucagcagguaauuccuacacucuggaacucuuuacuugaaugaaguugaauauuuuaaugcauuucaagaaagagcugcugggugcagguaaggcugcaguauggaauucucuucucugcaguuacuaagaaggagacaccuccuuuggacccucagaagcuguaccucuaccuucugauuuacuuuuaaauuauuuauguccccuuuggcacucucauacuuauuuggcuuauaaaacaagaaauauuccucaggaaggauuuaaaugauaagaguuaugcacauuuuaaaaauggauucauaguucugaaacugucagaauaauuaguuuauuuucuauuguaguaguuaugggaguuuuagcaugagaucuggauuuugcaaagaacuugguaagacuguauuuuuuuuucguuaaugagagcuauuucacauucauagguccuugaucauaaaaucccugcaaauuugauacaaaguuaucagugucugagagaucuuaaauucuugauuagaauugaaagcaaauuuuagcuauauaugugaacauaucuuuaaaugugcugaaguuuuuauugaauacaccaguuuuuuuuuaagcaaaugaaauaucaguugaugcauuauaaaacaaauucuacugucaacuauuaaagggaaagcuagaguuuguucagauacauucauuuauucauucaacaucuauuuuagacauuauucuggggauacagugguauacaaaacagauaaaauuccuugccccuugagucauccauuccaggaaaggagaaagguaaucaacacgaucaacaugauaaguuaguaaaauauaaguaaaugagagugauaaguccuggggagaaaaaaauaaaauacgaaaggagaaaaugaaauagaggugagguugcagggagaggggaaguguugaaauuuuaaauaggguagcuagggaaagacucacugagauggugccuuuuuagugaagagcugaagaaagucagggaacaaaguauauggcuauguuggugggggagguggggugaauacaucauuucuuugccuggaaugacguacccacccugccuuccuccccaacacagucauauacuuuguuuuguuuuucuuuuuguaguuuauacucauauauuugaagaacagcuagaggucagcucuggcuggagugcagauaaccauggguggagaguaauggagaaugaaaucugagaggacacaggaaguccaaccauaugaggccuuuauaagggcauugaauuugacugagauaaaaggccauuagaagguuuugagcagaggagugacauggugugauuuauguuuuaacaggaugacucuggccacuguguugggaguaaaauucagaggggcaaggacagaaguagggaaacuauuucugcaguaagaggcuguuguaaaccagaagagaggugguaguggcucccacaugguagcaguggagauggggagauagugagaaguggucgaauugugugcauguuuaaucaccuuuauugagguguaauuaacauacaauaaaauguacacaauauacaguuaggcauuuuaaucaguuuauuuacucaugacuaccaccacaaucaagauauagauuccaucacuccaaaagauuccuuuaugcuccugucagucaguccccagccccagcccccggccccaggcaacuacuuuucugcuuucuaucauuguagaauagauguuuuguuaggagaauuucacauaaauggaaucauaccauauguacucucuuuucuggcuuuauuuuagcucagcauaauguuuuuaagauucaucuauguuguuguauauauuaauaguuccuuuuauauugcuaaguaauacuucauuguaugacaguauauuuauucugaagguugagcuguaacauaugacagaaagacaagucuagguugaguaacaagaauggaguugccauuaacugaaguggaagauugcaggaggaacuaguuuugggagggugagggaaaugugggcaucagagcuuagcuuuggacauguuuacuaaacaaguuuuaaauguccaccaaauaggcaaauggagaugucaaguaggcaguuggaguucaguggaaaaguuuggucugcagaaauagaguugggagucauuggcacauagaugguauugaaagccacaagaauuugggaauaaauguugagagaaaagagguccaacuacagagcccuggggcacucaaacauuuauugagagggcgcaagaugagguaaaaccagcaaaagagauugagaagaagcaaccaaaaaggaggaggaaaaccaaaugaaugugguacuuuggaagccacaagaaaagguguuucuaggaggagagaaggaucagcaacuaugucaaaugcuacugacagaucaaauaagaugaggauugagaaaugauuacaggauuuaauacugagaaguuuauugguaaccuugagaagagugauuuuaagauaggaguggagacagugcauucaaguuuugauguaaagggaagaugagaaauauagcaguaaccggaaggggaaaugggagcaagggagcuuuuguuuuguuuuuguaggauaagagaaauaauagcauuucuauguuguuggcagugauucaguaaacagggaagaauugaugaugcaagagagaaaggagagaguugcuggaucaguguccuggagaaagcaagagagaaugggaucuaacacacaggugggagcagugucuuuggcuuggagcaugggcaguuuauucauaguguuauaacauagcugugguuguugaugagaccuuaaauagauuaaagcagugauaauagggaggaaaauggacuagauuugagauuuuaaaaaaucuauaggaacuggggcacagugguaugcaccuguaguccuagcuauucaggaggcugaggccagaggaccacuugagcccaggaguuuaagacuguaguguucuaugaucacaccuggugcauagccacugcacuccagccugggcaauauagugaugcccugucucuaaaaaaguuuuuuuuuuuuuuuuaaucuguaggaacugguaauugcucagaaaugggaggugagagaauuuggguacuaagggugaugcucuuggcuuggcuuacuguuggauguugucaacuccuuccuuccuuccuuccuuccucucccucucucuuucuuuccuuuguuuucuucuucuucuuuuuuuuuuuuuuucagggccuugcucugucacccaggcuggaguguaguggcaugaucauggcucacugcagccucgacuugcuggacucaagugauccucccaccuuagccucccagguagcuggaacuacuaaaaaaauuagccugcaccaccauggcugacuaauuuuuuuuuuaauaaaaaauuuuuauuguaauaguuauuuuuugaguuaaaauuuauauguguguauguuuaaucaacuuuauugagguauaacucacuauguugccagggcuggucuugaauuccugggcccaagcaauccuccugccuuagccucccaaauuacugggauuucagguguuagccauugugccucacugucagcaucugaaauagagaauauaggagagcagagguaguggugagggaccucuuauguuuaaggugucugugggacacauagaugaugguaauuggaucugagucugggcuggaaauggagauuugugaucgucagcauacugcugguagguagaacuagaaguugaaaauaugaaugccuaacggcuaggcagauaaguacagucaagugcugcauaaggacauuuaggucaacgauggaccacauauaugauggugguucuauaagauuauaauaccauauuuuuacuguacuuuuucuauguuuagauacacaaauacuuaccauuguguuguaguugcccucaguauugaguccaguaacauacucuauagcagggcaucaaaucuuuugccuucccugggccacauuggaagaagaauugucuugggucacacauaaaauacacuaacgauagcugaugagcuaaaaaagaaaauuacaaaaaaaccucauaauguuuuaagaaaguuuauguauuuguauugggcugcauucaaagccauccugugcuacaugcagccugugggcagcagauuggacaagcuugcagguuuauagccuaggaaugauagccaaacccuauagccuagguguguaguaggcuuuaccaucuagguucauguacugauguuggcacagugaugaaauugccuaaugaugcauuucucacgacacaucucucagaacagauuccagucauuaagcagugcauaacuguaaaugagugaagaguauggcuguguaaagacuagcaaguuggagaggucacacccuguguaaagggauagcugccacuuaguuccagacaguuguaggcuuggaauguuugcccauuguugucagaucauccuuuuuuuuccaagagaagccagaaauuaauuaauuaauuaauuuauuuauuuauuuauuuuuugugaaugggguugagugugugugugugugugugaacucuccaguuuuaggaacaauuuuuuauguagaccgaauaaaaugcaucuaugggcuagauaaaaccuuuggauuuuuagucuuugauuaaagccaugguagucuugaguguuauccuucuggaagaucagagugagaagagagcugaugauuaaaccuuggaucauacuaggguggaacugcuaacaggcucagaggaaugaucagagaguuuaggaugaaagcuguuagcuucaaccacaugaaauuacuguuuuuaauaggugaaaaguaguugcacauuagcuguucauauggcucaaucuaauagaagacuaguucuuacuaauaauucgaaaaaaacuaauuauuugaauuuuaccuucaaauaaaauuuuaucuguuuaaugauuuaauaucauucauaauguuacugacaauauauugggauaauaauaauaaugguuaacauuuauugaauguuuauuuuaugaguuuuaacugaauagugccuaccauaaaauaaacauuuuaacucaugcaguuuucacaaccuuaugaaguagguacuguuauacuauuaguguuuuuauuuuauugauuagaaaacugggagccacagacacauagcuaauauaagacagaacugaaauuugaacacaaacaauuguacccuagagccauuuuccucuucauuguuauaaaauauauuguagagauuugucaacuaguuuauaauuaacauuuaucagaaaaggaauuaagaggccgggcacuuugggagaccgaggugguggguggaucacuucagaccaggaguuugagaccagccuggccaauauggugaaaccccgucucuacuacaaauacaaaaaauuagccagggaugguggugcgugcuguagucgcagcuacucaggaggcuaaggcuggagaauugcuugaacucgggagucggaaguuguagugagccgagaucccaccauugcacccccgccuggacaacacagugagaugccuucucaaaaaaaaacggaauuaauauaaaauaagaaacuuuaaauuacagugcaguuuaaugcaauuaaaaaauuugacgcuaauuagccgggagugguggugaugugccuguaaucccagcuacuugggaggcugaggugggaggaugacuugaacucaggaggcaaagauuucagugagccgagaucgcgccacugcacuccagccuggccgacagagcaagacuccaucuaaaaaaaaaaaaaaaaaaaaaauugacaaugacugcaaaaaugauaauuauguaaagugacacauuuguuaauuggcuaguucaaaccauuccacaauguauguauacuucaaaauauguuguacaugauaaauacaauuuuaaaaaaugacaaaaaaacccaauugggcauuguuaauguucuacauguuccauuacuucguagaaauauuaguggcgguguugguguuugugguagugguaaaaacuacuauugcuacuaccaaauaucuguuaugaaccaggcacuguauaacaggcacuguacauuacuuacauaauuccuaaauuccacagccugugagauagcuuuaugucuaguuuuagaguuagaguaacugaguuucagagaagcuaaguggcagagccaagauucgugcacauguuggucuacaucagggauucuuaaagugugguucucgaauagagggucagcaucaccugggaacuuguuagaaaugcagauucuugcgcucugccccucacuugcugaaucagaaacuuugggaaugggcccgcucuagugauucugaugcacucuuaaguuugagaaccacaggucuggauccaaugguuaaacauguuauuccaauuuacucucauaacaaccacuuacacauaagaaggaauuguccucaauuuguagauaaagagaagugagacacagaguuaagugacuugcccuugauuuuggauugucuguauguccuaaccuauauauuaggcaugucuugccuuaagcaaaucugaugugugaaaaaucaaauaaaauuuuaaagauaaaaauuaaggguauguaugugauuaguuuuccauaaaauaauccuucauuuucaaaggacuuuacggaaaacuuuuuuuuuuuuuugagacggagucucgcccaggcuugucgcccaggcuggagugcaguggcacaacaacagcucacuguaaccuccgccuaccggguucaagcaguucccugccucagccucccaaguagcugggauuagaggcauccaccaccacucucggcuaauuuuuguauuuuugguagagacgggguuucaccauauuguccaggcuggucuugaacucuggaccuugugauccacccgccucggccucccaaagugcugggauuacagaugugagccacugugccuggcuacagagaacauuuuuuaagcaguguguucucaaaaauaauuucagcugggcacagcggcucacacccguaaucccagcucuuugggaggcugaggugggaggauggcuugaggccaagacuuagagaccagccuaggcaauauagugagguccugucucuacaaaaaaaaaaaaugaaaaaacuccccugagcaugguggcgugugugccuguagucccagcuacucugaaagcugaggcagaugagucccuugaguuugggaguuuaaggcugcagugagcuaggaucacaccacugcacuucagccugggugacacagugagacccugccucaaaaaaauaaaaauacguuuuaguaugaaauugguuuacaaauuuauuugaauauacuuucaaagcaauacaaguugccuaagacaaaagacauaauuuuuaagcauuaaaaaauguaauguaagucuuaguagaaguuaucuaugguugguuucaccucaguucauuagagcuugcuuauuuauuaaaaugcaguggccgggugcaguggcucaugccuguaauuucagcacuuugggaggccaaggcgggcggaucaucugaggucaggaguuugagaccagccuggccaacauggggaaaccccgucucuacuaaaaaugcaaaaauaggccgggcauggugacgcaugccuguaaucccagcuacucgguaggcugaggcgggagaaucguuugaaccugggaggcagagguugcagugagccgagaucaugccacugcacuccagccugggcgacagagcaagacucugucuccaaaaauaaauaaauaaauaaaugcagaauuacuacaaauaaaccaguuguugauguuauggugaaggaaaguguuuaauucagagaaguuauauugaucaaguauauuauggcaacaucagugcuacugcauuaacaucaaucaauuuagcaaggcauaucugcaucauuaaucauuuaguaaauuauaagacuaaaccaugguugcaggcuuaaagaucuucugcuaucucaacacuaucacuaguaaacagaggccauuaucaguaggacuguugacuuuaaaaaauuucccucuguuguuucauauuuuugauuuucaugugauaauuauucuccaaaaugaaaccaaauaauaagauauuuccacacuuuauguaagggaaauaaaucaguuauaacuaauuuucuaauuagauuuuaucauuucaauagguguuaguagggaaaucuacugaauucguguauugggaguuuguuguauuauugaggagggucggacuucacugauguacuuuucuucuucuuuauuugcuuucuguacaagauccucccuaaauauuugaaauuauaaucuuuccagguuuaacuaauuagggacuguuuggcuuaauagcuagcaagguuagagaggauaguuuuauuuuuuguuaauaauuuuauuccaacauccuguuuuccauaauuucuaaguaguaaaauuaauacuugcucacuuuagaaauuugggaaaaguauaaaguaguauaaagaugauacuaauaaucauucauaauccuaccacuugaagauaauuguuaguaacaugguuguguauuuccuucugauccuucaguuguuuacaguaauccccucuuaccugagguuucacuuuacacaguuucaguuaccuguggucagcuguggucugaacauauucaauagaaaacuccagaaauaaacaauugauaaguuuuaaauugcacacucuucugcuccaucccacuugggugugaaucauccuuuugucccauguaucuauggugaugaugguaccugcccauuagucacuuacuaaguaggcuucuggguaucagauuuacuguugcaguguacugcaauguuuguguucaaguagcccuuauuuuauuuaauaauggugccagagcucuagaguagugaugcuggcauauuguuauaauuguucuauuuuauuauuaguuguuaaucuuacugugccuuauuuauaaguuaaacuuuauuauaggcaaguauguaauaggaaaaaauauauaguauauauaggguucaauacuauccacaguuucaggcauccacagggggucuuccuaugauaaagggggacuauucuguauguguaugaaugugugcguguuauaaaauugagucauucugccagccuggccaacauggcgaaacccccucuccacuaaaaauacaaaaauuagccaugugucguggcuugcgacuguaguaccaccuccucgggaggcugaggcugguagaaccacuugaacccgggaggcagagguugcagugagccaagaucuugucacugcacuccagccugggcaacagagugagagaccaucuuaaaaaaaaaaaauuuugagucauucuguauaaauagguuauccagauuuucaguucuaaguauuaugucaugauccuuuccccaugacacugaauguucuaagaaaacaugauuuuuggcuaggggugauagcucacgccuguaaucccagcacuuugcaaggccaaggcgggguagaucacuugaucccaggaguuugagaccagccuagccaacauggugaaacccugucucuacuaaaaaaaaagaaaaaaaaauuuagcugacguggugguacgugccuguagucccagcuacuagggagguugaggugggagaaucacuugaacucggggggcggagguugcagugagcugagauugcacugcugcacuccagccugggugacagagugagacccugucucaaaaaaaacaaaaaaaaaccaugauuuguaaaaguugcauaauauuucauuuuauaaauaauauauuuagccacucaucuguauuguacacauuuuucuccauuuucuccauuugguuaaucuuuaaccaaaucucugguuaacuaaggauacuuagauucauaaaagaauuugucagaacuaaaagcauaaauauuuuuaauauuucugaaacagucuugcccaauugcguuuacucuucuguuuucaucacaccccucaucagcacuuaguauuauaauuuuaaaggcaugccaacucaaugucacugcaaaaauauauuuugauguguuuguuuacuuguuuacuccuuugaccauuuuuuuguuguuguucaucuuuuuuuauauccuccuuuuuugaaaguaaaaggaaacagacuuauucauuaacgcuauuuauuauuucagaaauugcugauauauuuaauaauguuuuuucaguuuggaauacauugcuugguagguauuagugugaggaguagauuaagauauauagacaaaagcauuucccuaccuuuguauauaauguaccugaaaaaaaugcauggaaguaggcugugugaguugaacaaagacuugcaugguauaggaggguauauucuuaccacauacuauaaaguccuuaaugacauuuugccuuuuagagaaaauauuuauucauaagauuuauuuacacauuuuauuccuuuccuucaaaaaugaacauauaggcaacggaccagagucugaugggccaaauucuauggauugucccauugauaaauauuuacuguuuucagcauucuuaaugauuucucgguuguauuauguuuauuaaacuuauguuuauuauuauucccauugccauuuuaauuuuucuguuuuucuacuaauuaaaguaaugauaguacagccauuuauggaaaacaggaugcagguuucucaaaaaacuaaaaauugaacugccauaugauccagcaauuccacuacugaguauaagguugccccucaguaucuguggggaauugguuccaggacccccacuccccacccccaguaccaaaaucgcagaugcccacaccccuuauauaaaauggcacaguauuugcauaaaccugugccuauucuccuauauacuuuaaaccaucaauagauuucuagauuacuuaaaguaccuaauagagcacaaaugcuguguaaauaguuaucauacuauacuuuuaaaauuuguauuauuuuggcugggcguggugacucacgccuguaaucccagcacuuugggaggcugaugugggcagaucaccugaggucaggaguucgaaaccagccugggcaacauggcaaaacccugucucuaccaaaaauacaaaaauuagccaggcaugguggugggcaucuguaauuccagcuacucgggaggcugaagcaggagaauuuugcuugaacccgggaggcagagguugcagugagccaagaucacgccacugcauuccagccugggcgacagagcaagacuccgucucaaaaaaaaaauuacauuauuuuuacuguuguauuauuauuuuuaauuguuucuuuuuaaaaauauuuuuaaucuuuaauugguugaauccacggaugcagaaccugcagauacagagggccaacauacauccaaaggaaaugaaaucaguauguugaggagauauguaacgcacuccccgcauucacucauucacuguagcauuauucacaguugccaagauauggagucacccuaauuguccaucaguagaugaacagauaaagaaaauguguggccgggugcggugucucacaccuguaaucccagcacuuugggaggccgaggcaggcagaucacgaggucaggaguuugagaccagccagaccaacauggugaaaccccaucucuacuaaaaauacaaaaauuagccaggccugguggcgcgcgccuauaaucccagcuacucaggaggcugaggcaggagaucgcucgaacccaggagggggaaguuguagugagccgagaucacaccauugcacuccagccugggcaacagagcgagacuccaucucaaaaaaagaaaaagaaaagaaaauguguauauauacacaauggaauacucuucaacuuuauuuuccuuucuaauuuuuuuuuuuuuuuuggcuaggagcaguguguugagaccaguuuuuuguuuguuuguuuuuuugagacagagucuugcuccuguugcccaugcuagagugcaauggcaugaucuugguucacugcagccuccgccucccagguucaagcaauucuccuaccuuagccucccgaguagcuaggauuacaggugucugccaccaugccuggcuuauuuuuguauuuuuaguagagaugggguuuugccacguuggccaggcuggucuugaacuccugaccucaugauccgcccgccucugccucccaaagugcugggacuacaggcgugaaccaccaugcccaguugagaccagguuuuucuuuuuuuugagauggaguuucgcucuuguugcccaggcuggagugcaauggugcgaucucggcucaccgcaaccuccaucucccgaguucaagcgauucuccugccucggccuccagaguagcugcgauuacagacaugcaccacuaugcccagcuaacuuuguauuuuugguagagacaagguuucuccuuguuggucaggcuggucucgaacugcugaccuuaggugauccacccaccucagccucccaaagugcuggcauuacaggcaugagccacugugcccagccgagaccaaguuuucaaaaagaaggaaaucuucgcugggcuugguggcucaugccuguaauuccaguaccuugggaagcugaggugggcagaucaccugaguccagcaguucgagaccagccuggccaacaugacaaaacccugucucuaccaaaaauacaaaacuuagccaggcauugugacacaugccuguaaucgcagcuacucaggaggcugaggcaggagaaucccuugaaccugggagguggagguugcagugagccaagaucgcgccccugcucuccaaccugggcgacagagcaagacucugucucaaaaaaaaaaggaaauuuuguuauuugugauaaaauggaugaaccugaaggacauuauucauuuaaauguauaaacuuuaaaaauugaacuuauaguagcagagaguagaauggugguuaccaggagcuggaggcagugaauguuggggagauguuggucaaaggguacaaaguuucaguuagacaggaggaaucaguucaagaagucuuauuuauuuauuuauuuuuugagacagggucuugcugugucaccgaggcuagagagcaguggcacaaucauaccucacuguaacccccaacaccuggccucaagugaucuuuccaccucagaguccugaguagcuaggacugcaggcacucacucccaugcccaacuaauuuauuuauuuuuuauuugguagagacagggucucacuauguugccuaggcuggucucgaacuccuggccucaagugauucuccuacuuuggccucccaaagugcugggaauacagguccgagccaugaagagaucuguuauaccacauggugacaauaauuaauaacaauguacuguauucuugcaaauugcuaagaaaguagauuuuaaguguucucaucaugaaaaaauaaguaugugagguaauauuuguguuaacuggcuugauggagccauuccacaauguacauauuucaagauaacauguuauacaugauaaauauauaaaauuuguauuugucaauuaagaaaaaaaguuuauuuauuuauuuguuuuugagguggagucuugcucugucgcccaggcuggagugcaguggcaugaucuuggcucacugcaaccucugccuuccggguucaagugauucuccugccuuagccuccccaguagcugggauuacaggugcucaccagcacaccuggcuaauuuuucuuuaauuuuuaguagagacaggguuuuaccauguugaccaggcuggucucgaacuccugaccucaaaugaucugcccaccucggccucccaaaguguugggauuauaggcgugagccaccgcgccuggccaagaaaacaguuuuuaaaaaagaauguuugaauaggauacaaaauauauucaaauaguugccugaacacugcucuucuucuuuuuuuuuuuuuuuugcaagagaaucuagcucugucacccaggcuggaaugcaguggcaggaucauagcucacuguggccuugaacuccuggcucaaguuauccuccuacuucagcccuacagcccuucccuaggcaguccuucgcuucuagaaaauaccaguacucaauuuauucccuucuuuucauacauucauuuuuuucuaaagaaauauuugaguguuuauuguaucccaggcauuaaguuaguuucugaguauaaagggugagcaaagcaacaugccuaauaccaagguuuuugcauuuugaaaaccauccuagaagaggcuuccugguugcacacaauuucaggcaguucucagacccagguuaaauaucucuaaguuaaagcuauaguaauucugguaaugcguagacugcacucacucacccuuguuuuuacuuuuagacugccaacugguaaauucuccaagaaaaugcuuacuucuaccaugauaaucuuuuuuuuuuuugagauggcaucucacucugucacucaggcuggaguauaguggcaugaucuuggcucacugcaaccuccaccuccaggguucaagcgauucuccugccuuagccucccaaguagcugggauuauaggcgcgccaccacaccgucuaauuuuuuuguagagacgagguuuugccauguuggccaggcuggucucgaacuccugaccucaaguuaucugcccgccuuggccucccaaagugccgggauuacaggcgugauucacugcacccggccccuacuaugauuaucuuugucuuuugaaccuccuccauuaaccucuuacaaaagaccucuacaaggcauucauucuuaggaucauggugcuuucauuaauguauuccacauguaacacugauacagcguauagauuaaaguuaaauuuuaucauuagauuuucuuaauauuaaauuugggaccauaagagaguuugaauacccaggaaaaaagaaaucgaguucaaauaaauauaagaaagucucuaucuuugccaggggaccucugcuuuagguaacugcccagugggaggaaucaggggaucaaauaaaagaaaauugaacugguccuugaauauggaugauuuaaaucaaguggagaugggugucagugggaauuuuucuuggaggggaugauuguaaauuuuuucuggagaagauuauuaugauauagaagugagccucuggugcauaaaaauggggugcagaggaugcaaaugcuuacuucggguucaguuaacgugcagggaguauaauucuccuagguaccucacacauacuuaaaaaguagguauuuuuauucucauuuuauagauaaggaaacugaggcuuguguaaguuuuuauuccaugucacacauguaggaaguggcagagccuggauucaaaccuaugcucuuuucaucacauggugcugcuuguucaugccuuuccuuccuuguuacucuuggcuauacucaugucugucucuuuuaccauggcuuaaccucuuugcagcucuagcuucacugcuguucucucuccuaaacagcauagcauccuuccuacacugacuguauuagcaauguuuucaugcugucaggugguuuugguugucacguuucuccugugcuuaguguauauccauguugaugcuugucacugggcagggacccagcugaggcaaaggaacuggggcauugguuggaaaagaugggcuugagucauggcaugaggcauaagaugaucaagucuguuaccaggugugugggagguuuggaaaccuggccagagaaaggccuagggaugcuccccguauggauuuaagggucagggagucaaacauuaaccuguacccaauuuaauuuuaauccuguucuaacacacaguucucuuacugugucaacugagggaguauucccagauuguugaaggaaacaaaccaauauguuuucucauauuuacuccuucuuugcagaaguccugcuuuccaaagaagacugaauguagagcaugagguuaccaguaaaauaaggaugccaaugcugacucuauaaguguugugagauuagagaaaugcauauaaauacucaacauggugccuggcaaauagcagggcucgaaacaccuuagcugcugcuguuacucuguaugaauuuacuugugauaaugcugcugcuguuucugggauuccccauuucuccuuuuucuagucuaggguuuggcuuagugauaacccaaaauugaaaaucccacacacugaggauggcacaagggauacagaacugauggagugcuauucagggggucucaguuugauaggaggaaugacugaugagcauagcagcugguacagcaggaacuguaccaaaggcuuaaguacaucuucucauuuaauucuuuuaacaacccaaaagauaacuauaaggaaacuuaagcacaggaugcaaaauaacuuaugcauaguauguaauuuggaacaaauaauuacaguacaacauaagugccauagagaccuauggaaauguugaagagaaaacuaguagaggcaaggaaaagcuucacagaagagauaauguuugauguggguuuugaaggaugaaauagagguggagauuggcaaggcuggaaguggaaagaaggaucacuuagcaaccugcagagaaaggggcagcacauucuaagcaaagggaaccguguaugcacaagcuuggaaguguggaaaaggaugaccuguuugagaaauguaagaaguguccuauauuuuagaauacacgggaggugaggagaaggaggcuugaguugagcuggaacuagauagaucaucaaagaucucauacaccagaaugauagguuaaaacaccuuuucuguaaauuaggaaagggcaauuuuagucagggaagccuccucgucacauuuguggcucagagggaacacuaggaaccagagugaagagaagugagauuggagacaaggagccuaguguggagcuuacugcagaggcucuggugagagauggugaagguuugaaccaaggcaguaacggugguugcuuuuacuuacacaggguacauccugauugucaauggauggacuaugaauggaacaugacuauucgaaguauaaaaauugacgcuugaccauguucucucugugggaguuuuuagguagcuuacaaaacuuuugaggaauuuacauuuucaacuaaugagauaaaucaggguaaugccauaaaugcaaugugcaguugaauuuuagcaauguggacagguugguucaugguagagagaagugaaucugagccauagccuaucugaaaagaaauaccuuuucuagcuuuauauauagaaacuagaacuaaguuuaacauuguugucuaauauauauuuuuuggcaugucaucaagaauuucuugggccaggcaugguagccuaugccuguaaucucaauacuaugggaguuugagucaggaggauugcucaagcccaggaguucaagaccagccuaagcaaagaggcgagauccuuuugaaauuaccagggcaugguguuaugcaucuauaauccuagcuacuugggaggcugaggugggaggaucacuugaaucuaggaguucgaggcugcugugagcuaugauugugucagugcacaccagccugggcaacagagcaagauccugucucuaaaaaauaaaaauaaacuaaaaaaauuuuuuaaaagaauuuuaaaaaaguuuuuacauuuuguacuuaaugaauuugauuuaagcauagugauuugguauaaaucauuguaaguccuaaauguagggagggcugaaucagugacauuuuacuauauauagauuguguuuuaugagauggaguuaaagcuuguggaguguacuuggauuaugucugaguuuauauugcagccuuggucuaggacuauaugcucucugaaagaaaggugaagauauuauauuaacagcuuaugcuaaauauagagaagggaggaaguagcuuacugcuaguucuuugcccugagcagaaguccuuggaaagcuacugagggcaaagagugaagccuucagaaagguuguuuaccaggaauauuauaagauuauaaugcagaaauaccuucacucuaccuuauacccugaagaaauauuugcauauucuuuuuaagucuaaagggcuuccuuaccugcaauguguaaggaauaacaucuguuuucagaaaauucucuaaacauuuuauuuauaguaacauaaaucagucaugguaauuucuuauaaugugguucuguuacucuguuaggccacaucuguuuuggcuuugcuugccuuggaagccaacaaaagaauucaguagcaaauucuuuuuuccuauagauuuauauuuuuggccuugcuuuaguuucuuuccugaauuuucuaacaggcauuuuuuuuucuuucuuuccuuucauugacuuacucaaaaguugaaugauguguaauauucuuccuuucugaaacucuuagccuugguaaucaaugggcagguauuuuugaaguucuauauuuucccucaugaauugagauuuagcuuuagcuucuucuaauuaccuccugucauucuucuuucucuuuucuuccccagaauauguuaaagauauauuuuacauuuuggcuuucccuggagaaggaagguuaauauucaauaaaaccucuuuuaauaagauucuugcagaggucaaguuuaccaaauuucaggauuaguugagucugagacucuuccagccccaaauaaaauuuugguaaccuaccaccuccuaaucugauuuucuuccuguuuucucuauguuauaaaacagcacuucauuuacccaauuagccaaauuugaagccuucuguuucccuaagucuacauucccuacauuccucucuguaucugaugaguuaccauguccauuggauuccaucuuuucuuuaucuccugucaaugacaugacccagguucauucuuucuauagcuuuuuaagcuuccuguucucccuuuuucuggauucuuuucugccaaagcaaccuccuuauugacauuugagugaauucucuaaaaccauccuauuucuaacauuuuuguaguccuuucgguauuauauuaauguaucuuaaagauuaaaaacucaaauccugauuuuucuagauuucaaaauuaagaaauaaugaccuaagauuaggccuucucugaagccuagaguuaaaauaggaaauauuuacuguaggagcuacauuuuuuaggauauauuuacagauaaauuuggugaggcuuuccauugacuaguaauaauuuaacuaagaagcaugugauuuuagaaugaacugaaaagaacccauuaaucuacauuugguuuucauugucugcuuugagugaaucacugauaccugguugcccacuacagugcugacuuuguuccagagacucacagcauugccucauauugucgaaguggaaguugugggggaggaacacuuguguaaauauuugccugcauuuuaucugacaguuuuggagacuucagcuaaaacuauucauaaauuguugaaagauccaauuguggcagcuuuaaaaggaucauuaagcaaaaauaaagauuucuuaggaaaucuaauuuuagucucuaaauauaauaauggaacccugcacugaauaauaaauuaguggaucaucauuccucauucagcaaauauuuauugagcaccuauauggguggcauuauucuaggggcuugggauacaucaauauauaaaacagauaaagaucccugccuuuguagagcuuauauuucagaagcaggagggagaaauaaacaugaauaaguauacaaucauguguugcuuaaugauggugaucgguucugggaaaugcgucauuagacaguuucaucauugugccaacaucacaguguguacuuacacaaaccuagaugggauagccuaauguacaccuaagcuacaugagauagccuauuguuccuaggcuacaagccuguagaguauuacugaaguaaauacuguagauaguuguaacacaaugauaaguaucuguguauuuaaacauagaaaagauacaguaaaaauauagcauaaaagauaaaaaaugguaugccuguauagggcacuuaccaugaacggagcuugcaggauuggaaguugcucugggugagucaguaagugaguggugagugaaugugaaggccuuggacauuacuguguaccacuguagauuuuauaaacacuguacacuuagguuacacuagauuuauuuaaaaauuuuuucuuucuucaauaauaaacuaaccuuagcuugcuguaacuuuuuuuuuuuuuuuuuuuuuuuugagauggagucucacucugucgcccaggcuggagugugguggcaugaucucggcucacugcaaccucugacuccuggguucaagcgauucuccugccucagccucuugaguaacugggauuacaggcgagcgccaccaugcccggcuaguuuuuguauuuuuaguagacacgggguuucacuagccuaauguacaccuaaggcuggucucgaacgccugaccuugugauccaccugccucggccucccaaagugcugggauuacaggcuugagccaccgcacccagccauuagcuugcuguaacuuuuuuuacuggauaagcuuuuuaauuuuuuuaacuucaugucucuuuuguaauaauacuuagcuuaaaacacaaacauauuguauaguuauaaaaauauuuucuuuauauccuuauucucuaagcuuuuuucuauuuaagauuuuuuuuuauguuuuaaaguuuguuuuuuuuuaaaugaagauacaaacacacacaugauccuaggccuacacagggucaggaacuuuaauaucacugucuucugccuccacaucuugucccgcuggaagguuuucaggggcaauaacaggcauagagcuaucaucuccuaugauaacaauaccuucuucuggaauaccuccugaaggaccugccugaggcuguuuuacagcuuuaaaaaauaaauaaauagaaggcauacacucuaaaauaaagauaaaaaggcugagugcaguggcucacacuuacaaucccagcacuuugggaggccaggcaggaggauugcuugaguccacgaguuugagaucagccugggcaacauagcgagacccugugucuacaaauaauuuuuaaauauuagccaggcgugguagcaugcaccuuguauucucagcuacuaagaaggcugaggugagagaaucgcuugagccugggaggucagggcugcugcagugagcucugauugugccacugcacucuaaccugggcaacagaguaagaccucgucugaaauaaauaaguauaaaguaaaauaauguuaaaaaguauaguauaguaaauacauaaaccagucacauugucauuuauuaucauuaucaagcauuauaaccauacaugucuguacaugccauacuuuuuuaugacuggcagagcaguagauuuguuuacaccagcauugccacaaacgcccugcaaaguuaggacagcaucaggguggcuaugucacuaggugauaggaauuacaaucuuacaggaccacugucauauaugcaaucccucccucccuccuuuucuuccuuuuccuuucucucucuccuuccuuccuuccuuccuugcccucccucccucccuuccuuucuuucuucuuuuuuuuuuuuuuuccagguucuugcuaugucacucaggcuggaguacaguggcaugaucauggcucacugcagccuugaucuccugggcuuagcaauccuccuaccuuacccucccaaagugaugggauuacaggagugagccacugcaccccgccugcagucugucuuugacuaaaugucauugcaguccaugacuguauauguuagaagggauaaguacaauagagaaaagaaaaagauagugcaggauaaugggaauugagaaugcucgguuagggggccagguuuuagucuaugcuguuuagaagaguucauugagaagauagcaucugaaaaggugacaaauuaucacuuguccuauaauuaugacuaccaauuaguugcuaagaaaaugucaggcucugaaaauuaagaaaauauggaucagccugagugugauggcucaccccuguaauuccaacacuuugagagguaggaggauagguugagcccaggaugucaagaccagccuggguaacauaccgagacccuguuucuacaaaaaauaaaaaaaauuagccuggcauggcacuuagcuguggucucagccacuuaggaggcugaagcaggagggucgcuugagcccaggaggucaaggcugcugcgagccauguuaguaucacugcauuccagccugggcaacagaaucuuuuuuaagacugucuuuaaaaaaaaaaaaagagagagagagagaaaagaaaagaagaaaauauagaucagauuuuaucccaaaccucagggauagcugagcgagggaagggaaaaaaauguaaacaaauuagagcauuauaguguuguagaugcuuugacagaagcauauaggaggcguaguaaggcacacagaucuuucuaaugugaucucaccucuguucuuaauaugauagcaguuuauuuaaauaaugacucagacuucguggauaucaaagcauaggcuuagauuacuuuaaucucagucaugugaauuggucauucucucuccucaccucuuuuuaccuuuuuaaaaaauaccaucuuagguugaauuaaugugagcugauuuuaauucuaaaaaauauauauaccaucugacuacucagcaugucccaacuuguuccaaacuauagucaguugcauuuugaaccaucugauuaucuaaguggaauauuuguauucagcauccaugcugcuauucguaguguaacuacccacagauacauaaugagcaagacacuaaaaugugcaaggcauuuuggaaaaugccagagauacagccaugaauaaggcugucaagcuucugcuuucuaggagcuuacauucuguuggaggaagcaaucaaguaagauaucacauguauuauauaccagcaguucccagacuuuuuggucugaggauccuuguacacuuuuuaauguuauuuaaggacuuuaaacagcuuuucuuuauguggguuauauuuauuaauuugccaguuuagaaauuaaaacugagggauuuugaaaacauguacuuauuuauuuaaaaauagccacaagaaacccauuauacuaacauuaaugagaaaauaauaauuuucccaaacaaauagugagaagaauggcaucauguuagauuuuugcaauucucuuuaacgucugacuuaauagaagacagcuggauucucauaucugcuuaugcauucaaucuauuaugaugaguuguucggauugaaguauaugaaaauguagccucaacagauacgugguuagaaaagggaggaauauuuuaauagccuuuuuagauaacugcgaauauucuuugauacucaccaaaauuuaagugauaguuacuuaaaguuuaguugcaaugugaaaucugaaauuguauuaaugacguuauaugaaaauauuuuuauuacauuaaaauccauugguuuguguggcacuuugaauagaucuuuuaugcuuuguaugaguuuguaacaucaugcguugguuauuugaaaaucaaaucgguuuacugaauuauauggaucuuccaaauauugacacauuucauuuuaugacauaaaaaaauuacauuuguugauauugcuccaaacuaaucagaaaaggcuuuaaguuuucagaaucugucaaggucgugguggcuggugaauacauguuuuccaaaauucuaauguuugccuacaagcuugaauuuuauaauuggcaauaaauguugucaauuuuuccugaaaugacaaacucacuucauucauuuucggggaaauguuugccaaacacccgagagugaauaauuuaguuugucauuuguucuuuguaguaaaaaugauauucuguuaacaaagugcccauuaguucccaacucagacauuugcacaaaugcuuuuccuugagauaaccguuauacuuuaguguguagcagaaguacuuuauaugugcuucccauuugucacagagacuauguauuaaauauuuacucgagggucaaaauuugaugauguuuacugcuuuucuucaagggcauucuuaaaagaaauaguaauguuuuauuuuucccugcaagcauguagugguaaagaauuuagugacuaccaguucugauuggugccauugccuugauuugugcucgugugccagcaguuuuaccaccauuguucuuacagcaucauugcaaacaugacaaacgcagauuauguuucaguauuaguacgaaaauaguuuugcacugaggaccccaaucucguuggauucccaguguuauuacauaccuuauuuccccugauuuucacaguggaaccaugagguaguuggugauauuaaccccuuuuggacccaaguuuccugaccagaguuucugucguucauucuuucuguuugcuauaauaucuccaaacuguggaaaaguuuauauuguuauuccuuaagaagaacuuuguucagcgaaaacagaaugggauggggugaguuuauuuaacggaacuaggggugucugaagccuagagauuccauucucauugcugcuuuuuaggugcuaugucguugugaaauacuaaacuuuucuguuuccuuauucuagaaaauaaggauaauaauaauaccuaucucauguaguuguugugaaaauuuaguuaauacauguuauaugcuuagaaccgugcugacacaaauuaaaugcucaauagguuuagcuuuuauuauuuacaguuagagauggggcucaggcauuccagcugagggaacaacuugagcaaaagcagagaaucgugucaugugaacaguacauacaaucuaacagaauguagugguucauggaagaguaugugggaaaguaaaaccgggaagguagauuuggacgcugauuauugcuggacuagagcucuaaacuguugauccaauuugugucccuaaugccuaagacaaugacugguacaugguguauguauuuauauauugccugagcauuggaauauuugaauaaauuuaaggaaggagagagcagcugcucucaccaugagcaacauagguggagaaagugacauuguagcguagcccagaagagugaauagaauucuaguaagcaaagauauuagaggugugagacaaagcagcaaauuuaagaaaaugagaauguuugauguuugcuuguucuacuugccagaauuucacaaaaucccuugccaacaaaauuucacaaaggcccugacucagugacugagcacaguccucuaaaaacaacaacaacaacaacaacaaaaagcccuaaagacaauaaauaagauagaacacaguuucccacaucuccagcuuaaaucacugcauuuuuagaaaaggcaaguucagugauucuagucguugccucuuucugcacguaagauaauguccaacaagauuagugauuaugccuccguaauauauaaccagauaugcccuuacacccaaacuuuaaugagauuuugcucuacuauaacuuacaagcacauacaaaacugccaccaccaauuuauaaacugugucuaaaacccuacuuugaaacagucuaacaaaaauucucuaaaagacucuccuagguaacaguccucaguaagacuucuaaauaaaacuaacuuuaauucuuuaaaagcuccccugucccguuuuuuuuuauuuuuuauuuuuaucuuuuuugcuuaguugacagaggcugauagaaugggugaagauaguugggauauaggcucaugccuauaaucccagcugcuugggaggcuuaggcaggaggaucccuugaggccaagaguucaagaccagcugagcaacauagcaagacccagccccacacccaucucuaaaagaauaaaaaauuagcugggcguaguggcuugugccugugguccuaacuacuugggagauugaagcaggaggaucgccugagcugaggaauuugagguuguaauaagcuaugaucaugccacugcucuccagccugggcaacagagugagaccguauuucucaaaaaaagaaaaaaaaaagaaagaaaaaagaaaaaagcgugaagauaauaccucaccaaacgauauacuacccacccaaguuauuguacuuuucaggagacuuaauuacuugagaucaugaauuguuuuauccuugcucauauaccaaacauaguaccccgugcauauuggggcucaguagcuaccugagcagugucucagcaguuaaucuuguaaaugugguuuuuguguaauguuuuuauuucacaauaacuuucagagaaaaggaggccuuccugauuauagggguuacuuuuuuuuuuuuuuuuuuuuuuuacuuaaauugcagaacaggcaaauaaccacuuuauuuuguauacaggcaguaauauauucacaguuguuugugucuuaaaggagaagauaugacuuuaggaggacagauuccuaagcaguggaucaggaaugguaagguauaggaguuuuagaaaguuguccuaaaagcuacuucuuguaguuuagguugugugaguuacgcuggaagagugaaaucuuuugaauaacuucauauucuuauucaaauguguauaauauagaaaaugugauuagauacguaauaaaugagcaaagaugauaaaauccugaaaauguauucuacauacuagauaaauacuguuuuccucugugcaccuuauauuguuuccauauaaaccaggcauuauugagaauuaggaguuaccaguaaucuccucucuacuaauuuucucuggcaaauuguucucuggauuaguagaacuaguuuucucuguuggauugauagaacaugugauaauaauaacauauugguauuuucauguaugucaggcaucgugguaaauauuguacagauuaucucauuuaaaucucacaaccuuauaaggccgagguacuguuaccauccccauagguaauauuaucauccuuagauuauagaugagaaaaguaaagcuuagagaauuuaaguaucuugcccaaggucagaaugaauaaggucaaagcuagguaucagacgaggauuuggacccaagagucagcccucuuggccuuuacacugugcagcuuaagagauacuaaaaagcaacagcuuugugggacauugggguggcuuagaguaguguuuucugaacuggauugcaguccauuaauggauuauaaaggucuauuuagugggcccaaaucagcauuuuaaaaaaaugaauuacaacagacagaaaaauaucaauguguauggcauauaauaagagcaagcacucuuuuaugaaacgaauguuccaguuuauauguauauguguauguacacauauguacacauaugugugcauauguauguaugaacuggcugaaguuaucaaauguacuucuuauugugggucgcagucaaacaaaauuuggagcccacuggcuuagaggauggaaagcaagcuggaaaauauaaugaauagcagugguagcugcuagagaagaaagucuagagauaagcugaauguacaaauaacauuauuuaaaaaagggaagaggaguuaacuuuauauauuugauaaaauacuguaguacucaaaguuguuuuaacuagcucauuaaguuagacccuuugcaggauucacucagaauuaguauagcuuuaauuuuacuucuagagaguuggcucugcaggugguuuugaauuguguauaucauuacuguauuuuuauuucucauaugaacaauuuguugugauugaauaauaaccagacaucucuggugcuucauagacacaaagcccuuuuuucuauuagauccauuagaguagagguuuguuuacugacaugcuaggagaaugggagaagguagauuagauuggucagaauaauauugacucuugaauuuucagcuggaagggagaauucaguucaacuuccaauuuuaaggugcaaaaugaauauucauuuuuuugagacuaucauaaaacagcacaaaaauacauauucagacaaugcaaguggcuuauuaaagucaacacuagaaagaaguagcaaagcuacauguauacauuaguccugcuccugcuccuguauaguaauuuucccucuuuuuuuguauaguauacuaauuugcccucguuugcuuagucugucuuuuuuaccuggaaugucuucccugucagugccccucuccuucuccacauacccccacuuuuuucuuucucucucucucccucucacccagacacacacauauacacucacauaccuuugccucuaauuucuacucaguuuuaaaacucagcuuuaauuuccuugccucagaagcuuucccugaguucgccuuuacaaacacaaaugucuuuauuuauuuugaugcucaaauuguccucaauuugaccagaggaauccuauuuaagcugaccucuguguccuuuuaacaugccccugucauucuuuaaguauuuccuuacuuucuggcacaaaaagacauuccaggcucauuuuauaccuucucuguccuaguucuggaaucaaccauuuuuccagggagugcugauuucuaaugauauuuagaaaucaacacccagugcuagguguaguuacugcuuauaaaguguuauggcucccaggcccucuagagagcuaagaaacauaugaauguuauguacauagagcuaagaaacaugaauguuacauacauaggggugugcuugugucuacacauguguacauccauguucauauuuauuuccauauguauuuaucuacauguauaucgaaaaccaugaugaggucaugcugauaccuccaguuacagucuaucacaacagaaauaauucuguuuuuucccuuaccauauuuaacuccguuuuccaaaagugagaaaaacuuuaucuuuguuguauuuacuuauuugaucaauccuucuguauguaauuauuuuccaaucauccauguccuuuuguaaaugucaccaucacuccauucagccuuggaaaccuugugccaugcggagccuguucacugcaauguggacaccuuccuucuuuuucuuggguucugacuccucauauuggacuuucccauuguauagcuucccucuuccucuugcuuugggcucucaugcccugugcuagguugugccuuuacaugaugcaugcccucuucacccuacucaggcucuaauguccugagccagaucucccacccauuugguacaguacuuuuaacuaaacuacagagcucauuugaauuuucccucuaaugcuccuuuucuguuccaggauucaauccaggaugccacauugcuuuuaguuguaauaguucuuuauuuguuuuuuaucuuucaugaccuugacauuuuuuaugaguauuggucaguuauuuuguagaaugucucucauuuuggauuuaucugauauguucucaugauucgauugcaauuauguauuuuuggcaagaauaccacaaacaugaugcuguuguuuccuugucucaguggauuguauucagagguauaggaugucaauuaaucuuauuaacuggugauguuaaccuugaucacuugauuaagauaguguaccagauuuuuccauuguaaaauuauuauuuauucauuugggggagauacuuuauucucuugugggagauacuuugaaucuaugccaauuuccuguuucuucucacuuuugcccauugauuuuagccauuaguggaucuugccugauguaauuauugcugugguguuggucuaauggugauuuuuaacuuuugucaguccuucuacacuuauucauuguaauuuuuuuuuuuugagauggagucucccuguugucaccuggacuggagugcaauggcacaaucucggcucacugcaaccucugccuccccaguuccagcaauucuucugccucagccucccaaguagcugagauuacaggcacccaccaccacgccugacuaauuuuuguauuuuuaguagagacgagguuucaccauauuggccaggcuggucucaaacuccugaccucaggugauccacccgccucggccacccaaagugaugggauuacaggcgugagccaccgcgcccggcccauuguaauucuucuaaaggaagagaugucucaucuccccuacuuauuuacuuauucaauuauuuuauauuaauauuggacuuguggauauuuauuauauucuauggguuauaguccaguacucugugaauuuauuuaccuaaaaucaugaguucauacugaaaccuccgauuguaguucaacaucacaagguuuauucuaaccuucucccuuucuguauuucuaauuuuuuucugauaguaagaaaccugguucucauuaucuauaacauacucacuugucuguaguuacagaauugcuaacauguacuccuaugaaaaucaaauuuacuaacuagaguauuguauuuguauaugguucuuuuuuuuuggccuauccuuucacuauauagucaaaauacugguuuuuuuuguuuuuuuuuuauacuuuuaaguuuuaggguacaugugcacaacgugcagguuuguuacauauguauacaugugccauguugguguacugcacccauuaacucaucauuuaacauuagguauauauccuaaugcuaucccuccccgcucugcccaccccacaacaggccccagugugugauguuccccuuccuguguccauguguucucguuguucaauucccaccuaugagugagaacaugcgguguuucguuuuuuguccuugcgauaguuugcugagaaugaugguuuccagcuugauccaugucccuacaaaggacaugaacucaucauuuuuuauggcugcauaguauuccaugguguauaugugccacauuuucuuaauccagucuaucguuguuggacauuuggguugguuccaagucuuugcuauugugaauagugccacaguaaacauacgugugcaugugucuuuauagcagcaugauuuauaauccuuaggguauauacccaguaaugggauugcugggucaaaugguauuucuaguucuagaucccugaggaauugccacacugacuuccacaaugguugaacuaguuuacagucccaccaacaguguaaaaguguuucuauuucuccacauccucuccagcaccuguuguuuccugacuuuuuaaugaucgccauucuaacuggugugagaugguaucucauugugguuuugauuugcauuucucugauggccagugaugaugagcauuuuuucacgugucuguuggcugcauaaaugucuucuuuugagaagugucuguucauauccuuugcccacuuguugaugggguuguuuuuuucuuguaaauuuguuugaguucauuguagauucuggauauuagcccuuugucagaugaguagauugcaaaauuuuucucccauucuguagguugccuguucagucugaugguaguuucuuuugcugugcugaagcucuuuaauuuaauuagaucccauuugucaauuuuggcuuuuguugccauugcuuuugguguuuuagacaugaaguccuugccaugccuauguccugaaugguauugccuagguuuucuucugugguuuuuaugguuuuaggucuaacauuuaagucuuuaauccaucuugaauuaauuuuuguauaagguguaaggaagggauccaguuucagcuuucuacauauggcuagcuaguuuucccagcaccauuuauuaaauagggaaugcuuuccccauuucuuguuuuugucagcuuugucaaagaucaguuaguuguagauguguggcauuauuucugagggcucuguucuguuccauuggucuaucucuguuuugguaccaguaccaugcuguuuugguuacuguagccauguaguauaguuugaagucagguagcuugaugccucuagguuuguucuuuuugcuuaggauugacuuggcaaugugggcucuuuuuugguuccauaugaacuuuaaaguaguuuuuuccaauucugugaagaaagucauugguagcuugauggagauggcauugaaucuauaaauuaccuugggcaguguggccauuuucacgauauugauucuuccuacccaugagcauggaauguucuuccauuucuuuguauccucuuuuauuucauugagcagugguuuguaguucuccuugaagagguccuucaugucccuuguaaguuggauuccuagguauuuuauucucuuugaagcaguugugaaugggaguucacacaugauuuggcucuuuguuugucuguuauugguguauaagaaugcuugugauuuuugcacauugauuuuguauucugagacuuugcugaaguugcuuaucagcuuaaggagauuuugggcugagacaauggggucuucuagauacacaaucauguaucaagucaagggacaauuugacuucuucucuuccuaauugaagaccuuuauuuccuucuccugccugauugcccuggccagaacuuccaacacuauguugaauaggaguggugagagagggcaucccugucuugugccaguuuucaaagggaaugcuuccaguuuuugcccauucaguaugauauuggcuguggguuugucauagaucuuacuauuuugagauacuucccaucaacaccuaauuuauugagaguuuuuagcaugaaggguuguugaauuuugucaaaggccuuuucugcaucuauugagauaaucaugugguuuuugucguugguucuguuuauaugcuggauuacguuuauugauuugcauauguugaaccagccuugcaucccagggaugaagcccacuugaucaugguagauaagcuuucugaugugcugcuggauucaguuugccaguauuuuauugaggauuuuugcauggauguucaucagggauauuggucuaaaauucucucuuuuuguugugucucugccaggcuuugguaucaggaugaugcuggccucauaaaaugaguuagggaggauucccucuuuuucuauugauuggaauaguuucagaaggaaugguaccagcuccuccuuguaccucugguagaauucggcugugaauccaucugguccugggcuuuuuuugguugguaagcuauuaauuauugccucaauuucagagccuguuauuggucggucuauucagagauucaacuucuuccugguuuaguccugggaggguguaugugucgaggaauuuauccauuucuucuagauuuucuaguuuauuugcguagagguguuuauaguauucucugaugguaguuuguauuucugugggaucgguggugauuuuucaaaguuacuucauguuuuaguuaguuugggcugcuauaacaaauuaccauagauuacguagcuuaaacagcaaacauuuauuuccucacaguucuggaggcuggaaguuuagaucaggaugccagcauggucagguucuggugaaagcuuucuuccagguugcacagucaacuucuuguccuuauauccucauguguuggaaggagagugagacagcucugaggugccucgucacauuaaagaggguucuaccuucaugaccuaauuaucucccgcaggucucaccuccuaauacuaugacauugaagguuaggauuucaacauaggaauuuuggggcaacacaaacauucacuccauggcacugagguucaauuaugugaaauauuaugguucugagaggcugaauauaugcaaaaagauauauucagaguguugcuaccuccuuaauucuuacuaauuuguuccuauucuuccuggcuucccauccuuucucaccuguggcuuguaagguaaccaauuuauuuaguuuucuuuagaagcuuuauauuucuuuugcacaaauaagaaaauacuuguauguuuucugauauuccuuuuuucuuauaguaaagacacacuucacuuuuuaaaaaucuuuuauuugaugguaugucugaaaaucacuccaaaucacuaaagaaaucuuccucauuccuguuuuuuuaagagauggggucucacuguauuguccagguugguuucgaacucuugggcucaagugagccucccaucuccuggggcugcaggcgugugcugcugcaacuggcuuuuauucuuuuugauaccugcauaguauuccuugauuuauucaaccauucuccucuguaugaguauuuaggguguuucauauauauauauauauauauauauuuuuuuuuuuuuuuuuuuuuuuuuuuuuuugagacggaguuucgcucuuguugcccaggcuggagugcaauggcgugaucucagcucaccacaaccucugccucccugguucaagcgauucuccugccucagccucccgagaguagcugggauuacaggcauaugccaccacacccagcuaauuuuguauuuuuaguagaguugggguuucuccauguuggucaggcucaucuggaacucccgaccucaggugauccgcuggccucagccucccaaagugcugggauuacaggcgugagccaccacgccuggccccaauauuuuaaaguuacaaaaaaugcuauaguaaauaaccuuguuccauauauauuuuuguauuguuagauguugaucgauuuuuuuucacauauucaaccaacuuuguauuucuaaaauaaacacaacuuggacaugaucuauuaauuuuuuaaggucauggucauucauucauuucacauuuuauucuuaguacauuccacugggagaggaaagagucaugcaucaguauauagauugugcuauucuguuguacuguuuuuauauaggauuuuugcaugucuguuuauucuguuagauuugccuauaauuuuucucuaauaacagucuugucagauuggugucaaaguuaugcuggccuuaaaaaagaguuguggaguguucacucuuuuuccauuaucuggaagauuuuguauuagagauuggcauuauuccuuaagaauucucuggugaaggcuucuaggcuuggauuuuucuuuaugagaugauuuucaauuauuuuaauauuagaguguuuuugaccuaccaaaaggguacuuuccuguggcccaaccuaauaguuauagcacuaucuagguuuuuaaaguuguuauugugguaguuuugguaaauuguauuuccuuaaauaauauuuuccacuuaauuaaaauuuucaguuuuauagucagggaguuaugaguaugugcaucaguugugauguccucuuucuuauucauggcauuaaugaucugugccaucauguuuguguugucuucgucccuuccuccuccugucauuuuuguuagagguugaucaauuucauuaguuauuuuuagguaaccaacuuaggcuuuagugaccuaucuauugaauguuugcccucuaucucauuaauuuauguucuuuaucaauuccuuuucuacucauuuugaacuucuuguuguuuucagccuuuuugcuuuuauauauauaugcauuuaauauauauaugaauuuauauauauauauaugcauuuaaggcuacaaauuucccuuuaugcacuacuuuaacuguauccaaugaauccauauaucauauuuucauuuauucaguucuacauguuuucuaauuucuagugcagauauuuuuuccugaccuauggauuauuuagaaguauuuauuuuuaaaaauuccaaaacaucucaguauuuuguuuuauuuuucuuucuuucauucuccuuuuggcugcauacaggggacuuuauugaugguacaugacaagguggggccuuccaggccccucccucuucagggggucuggcauggaaacugugucaagaagagauuuuugcaugucuguuuauucuguuagauuugagugcagcagguauuccccagcagcugagguccucucuuguccuuuaguuagugcucuugcuggagcuggugguccugggcacuuacuccuuggaggccauguggaccaugagguccaccacccuguugguguagccagauucauuuucauugucauaccaggaauugagccugacaaaguggucauugagggcagugguggccccaucauggaagguggaagagugguucucacuuaaagucggaggagacacccggguguucaguauagcucaggaugcccuuuagggggcccucuggugccugcuucaauaccuucuuaaugucaucguauuuggcaggguuuucuggauggcagaucagaucugacauguaggugguggggacuuggaagaccaugccagugaucuucccauucaguuuggggaugaccuugccuacaaccuuggcagcaccaguagaugcagggaugauguucuugagagccucauggucgucaugccacaguuucccagagguaccaucuacccacaucuucuggguggcagugauggcauggagugugguuaugagucccuccacaaugccagaguugucauggaugaccuuggaugggggugcagugaucaauugguggugcaggaggcauuacugaggaucucgaggcuauuuucuuacuucucaugguucauguccaucacaaacaugggggugucagcagaaaggacagagaugaagacccuuuuggcucuccccucuaagugagucccagccuucuccaugguagugaaguuguugauggacccaacaacauagucagcaccagugucacccccauuugauuuuggugggaucucacuccuggaagauggugaugggauuucccuugaugacaagcuucccauucucagccuugaugcugccauggaacuugccauggguggagucauacuggaacauguagaccauguaguugaggucaaagaaggggucacugaugacaacaauaccugcuuugccagaguuaaaagaagcccuggugaccaggugccuaauacagccaaauccguuuauuccagccuucauuuucaccauggugucucagggacacggcugguggugcaugagaaggggcggcugucugucaaaugagaggagcagagagcaucaaaaacccuaguauuuucuaauuuauccuuuuuuuuucuuuuucuuuuuuuuuuuuuuuuacugguuucuagcuuaaauuuccacuaugguuagagaauauaugauuucaguccuuugauauuuguugagacuuguuuuaggguccaauauuuggucaguuuuuagaaauauucuguguucugcuuaaaaagaauaucuguuuuacauuuguuguauucagcauucuguauauguucauugaaucaaguuuauucaucagacuguuuaaaucuucuauguccuuauuaauguuucaucugcuugcuuuauugauuaaugcaagugauguaacgugucacuuguaagcaucauauacuuuuacaaaucuuaaagccuuuguauuuuaauuagcacguuuacuucacucacauuuaauuauugauuuuuuaggcuuaaacauuugccaucuuacuguaugcuuucuuucagucucguauauucgauuucuuuuuucuccuuucuugucaauuuuuggauuaucuuuauuauuggauuuuuuaauuuuagaaguuaaacacuuaaaaagcuuuucuuuuagugauuauuuuagauauuauaacaugaauccuucaguuaucaaaaucauugauaauuuuaucuucuucccaaacaauguaagaaacuuaaaacuuuuuauuccauuuucccuuuuccaaucuauaugcaguuguuuuguauauacaaucuauaugcaguuuaauuuugcauauauuuauuuaaaaucccaugagagccuuuuggucccagcagcagcagagcugagcaagcagcucccucccucccuccgcugcccgcuggccagcaggauggaacaggccacacuccuuugucaaggacuuacuggccggaggcauugcccucgcuauuuccaagagggcagcgacccgaguugagccagucaaggcacugcugcaggugcaacaugccaguaagcagauuguggcgacaccguacaaaggcgugguguggugggcugcaagguccacauccccaaggagcagggcacuuguccuucuggaggggcaccuggccagcaccauccacugcuuccccaugcaagcccucaacuuugccuuuagggauaaguacaagcagguccuucugggaggcgugcauaagcaugcacaguucuggagauauuuugcaggcaaccuggcuuccugaggggcggcuggggccaucucccugugcuucuucuauccccuggaauuugccagaaccugccuggcagccaacguugggaaauugggcauauagugggagcucaaaggccuggcagacugccuggagaagaucaaggcugaugggauccgaggccugucccagggcuucagcaucucggugcagggcauccauauguacugggcaaccuaccucagcguguaugauacagccaagggcaugcucccugaccccaagaacacccaccacauggugagcuggaugauugccaggccaugacaguggcccauguggccuccuaccuacuccucacagugcgggcggauggugaugcaguccaggugcaaaggaggugauauuacgaacacgggugcccuugauuguuggcagaagcucuccuaaaaugaaggggcgaagccuccuucaaggaugcaugguccaacauccucacaggcauggggccaagucugggccuguauuaugagcugaagaaagucaccuaagugcauaugucuccuccauagaaauggcaacccagagaaucauguagaauacuuaacuauuguagauuauggaccuucaagaaauucuggucaucuuuguccuggccagagaucaugucuguagagggcugagguaggcucuagaaaagggguucauugugaucacauuccccuuuggcaccugauuccauguauugauuacugggggugggaaaaucaugacgucauugugagcacacaggcgaggcaacuccagcucagaccuagaguccagaugcuuauaggaccugaguuguguuuaaguauuuauuuaaauaaaaggaauuguauuucccauuuguacuuaagcacuagcucuucuuuugcacagugaguauuuguaauuauguucuguguuaggugugcugcugcaaaacaauaaaaacaggacacugagagccagaaaaaacccccauaagauauuauuaaauauuaugauuguauguagagaauauuuaguuuuagccacauacuuauaauuucuguugcucuucauucugugcagcuccuaccaccuuccaucaggcauuguuuaugccuagaaaagaauacuuuuuagaauuuuauuuaaugagcaucugccgauagcagauucugguuuugucagucugaaaaugaguuuauuucaucuuaauucauaaaggauauauuucagugaauucuaaauugacaguuacucucuuuuagccauuaaaugucguacucuauugucuccugguucucauuguuucuuuugagagccuaccugaauuuaauuguuguuucuuugaaaguaaccuguccuuuuuucucccuggcuguuuuaaagauauuuccuauaucuuugguuugcaguauuuuuacugagaugugcccaacuuguggauuucuuugauuuaucuugcuugggauuccuaggacuucugaaugucuuuaaucaguuuuggaaaauucucagccggacagugcuuccgugccaugcucucuuuugucuucuucugggguuccaaucacauguguguuacauuuucucauacgcuguauugcuuacccuuacuucuauauuuucuuuuuuuuuuuuucccaaggcagaagaauuuuucuuagagcagaacaaaaugaaaagucucccaugucuacuucuuuccacacagacacggcaaccauccgauuucucaaucuuuuccccaccuuuccccccuuucuauuccacaaagccgccaucgucauccuggcccguucucaaugagcugcugggcacaccucccagacggggugguggccgggcagaggggcuccucacuucccaguaggggcggccgggcagaggugccccucaccucccggacggggcggcuggccgggcagggggcugacccccccaccucccucccggacuaggcggcuggccgggcagaggggcucuuuacuucccaguaggggcggccggguagaggcgccccucaccuccuggacggggcggcuggccgggcggggggcugacccccccaccucccucccggacggggcggcuggccgggcggggggcugaccccccaccucccucccggacgggguggcugccgggcggagaugcuccucacuucccagaugggguggcugccgggcggagaggcuccucacuucucagacggggcagcugcugggcggaggggcuccucacuucucagacggggugguugccaggcagagggucuccucacuucucagacggggcggccgggcagagaugcuccucaccucccagacggggucacggccgggcagaggcgcuccucacaucccagauggggcggcggggcagaggcgcuccccacaucucagaugaugggcggcggggcagagacgcuccucacuuccuagaugugaugguggccgggaagaggcgcuccucacuuccuagaugggauggcggccgggcagagaugcuccucacuuuccagacuaggcagccaggcagaggggcuccucacaucccagacgaugggcggccaggcagagacacuccucacuucccagacggggugguggccgggcagaggcugcaaucucggcacuuugggaggccaaggcaggcggcugggagguguagguuguagcgagccgagaucacgccacugcacuccagccugggcaccauugagcacugagugaacgagacuccgucugcaaucccggcaccucgggaggccgaggcuggcggaucacucgcgguuaggggcuggagaccggcccggccaacacagcgaaaccccgucuccaccaaaaccagucaggcguggcggcgcgcgccugcaaucgcaggcacucggcaggcugaggcaggagaaucaggcagggagguugcagugagccgagauggcagcaguacaguccagcuucggcuccacaugagagggagaccguggaaagagagggagaccguggggagagggagagggagagggagagggagagcuacuucuauauuuucuaucucuuugacuuacugucuuuuguucucauggguuucuucuaacugcucccaguucuguaauugucucuuugguuguacuuaaucugcuguugaacucaucuauuaaauucuuaauuuugauuauuugucacuuuuggaauuuauauuugauuugauuauuuuauaaaucuaaguggaaaaaaacccuaaaaauaaaaaaggaaaaaauuaugucauuuaugcaauaaucuggagcuccuguugaucuguuucuguugucuuuugguucucauuuaugugugguuuugucuccaaaagugucuccauuuauguguacuugguuaucuuugcuuaugugcuagacauuguauuuuaaaaauuguuuauguaaauuuaauuuagcagcuaagaugauguuaucuuccuacagaaaagauuuucauuugcuuuugcuaguagaugccuggcgucacuaaaaaucugugaucauuuaaaucaauuucaggcaucaagauuuuucugggccacccauaugaccaagcaauuguuuuaauucuaguuuaucacuacucccacagagaaguuguuuggggucccaacuagaacauggacuguuuaccagagcucccauuguuggugggcccuggcuuccaacuucuggccugaaaaggcuugugugguugguuuuuuuuguuuuuuuauuuuauuuuauuuuauuuauuuauuuugagacagagucgcccucuguugcccaggcuggagugcaguggcacgaucuuggcucgcugcaaccuccgccucccggguucaagugauucuccugccucagccuccugaguuacugggauuacagggacccgccaccaugccuggcuaauuuuuguauuuuuaguagagaugggguuuuaccauguuggccaggcuggucuugaacucuugaccucaggugauccgcccgccucagccucccaaaaugccgggauuacagucaugagccacugcacccagccaguuuuuuuuuguucuuaaauuaaagaaguuuuagguucacagcaaaauugaacagaaaguagaguucucauauaccagcuuccgccacacacugacaagcuuuuaagugcauuguccggucugcaauuccucuccuggaauuugcaaugccuccaugagaagugucccuaaauacaagguuuaucuucuaaauuuuuugucuucucccagaucuuggcuugguaauucuuuauuaccuuguugguuugugaugccuucaaccaguuguuuuuuaaaaaucagucuagcuuuucuaguuguucucagugggaagguuggucugaacuauguagccugcuauuauugaacacaauuauucccuuucuuauaaauuguugcaaguagauugcauaucuguaaaaaauauuaauagaucaagcugaaccuauuaaggaaaugguacaacuaaaaaccuuuucuguuagccaucauaguuuuaaaaugauauuuucaaauauggagauauauuauagaauuaaacuuuuaauuuuaauguauaaucuuuuauuccagcccgugaugcugaugagcgagagaaguggauccaugccuuagaagaaacaauucuucgacauacucuccagcuucaaguaagggucuuuacaugguuuccagauaguucauuaguuguugcuuucuuuuuuugucuguuuucuguuuuuuuuuuuuaaauaacugugguaugauguaauaggaacuuauaauuucugaguugcuuauuuuuccuuuacaguuauaguaaaguuauacucauuuauuuucuccugcuuucugcagaguaaaauacugauuuuugucuagaaacaagacagugcaagacaauguugaaagugaaauucuauguuaaaauaugccagauuuauuuuaagaauuuaauaucuguagucaguuaucaauacaaccaaauuacauaauuaugcaugauaauagguaaauacugagaaguucaccucauuuucuuguuaaaggauuuggcuauuaccguaugugucaguuaguacucuuuuguaugguagugaaagaaaacucaacccaaacugauucaugaagaagaaaguaaaucugguuagaugugguuugaauuagguaauucaugucaugaggacucagaucucccaucucuauuucuacguuccacuuuugcauuggcuucauuuucgguuagguucucccuugguggugguaaggugguuguagcaaugucagccucccauuuuuggaaccgaguccauaggaggcuauucuuucuagaccuuaauaggaguaacacaauuauugcucaucacccuagcuuuggccaugugucaaauccugaccagucacaauuucacagucauagauucuacccuggagcugggauguuacuggccucacuagaaacacauugcugauaggguagaagguguguucauccuacccaacccgacccgcaccaaagucagaauagggaaaaacagauguugggugacaugcaacuaacgucugccguacuacacugaagauauuuuucuauguuuauucuccagugaaagagcuuauauuugugguacauaggggauuuuguuuuaauuuagaaaauuuaauuguagaaaacauguuuuauaacccuuucucuguacuuuguucuauaucaggaauugacuugauuagauaaggugacauaggguaucuuaggcccuacaagauaguaaaccccccaucacuugaaaguauucaguagaggcuuaaaaaacauuauuaaaggaugugguuauuaggggacuuuaagaaaugaauaugaaauugaaguaggaaaucuuuaagcuacucugugaguuaugccuuuuaaaagcaauuuguaauuccuguagauuucuuuuaaauuuaggcaguuucauaaaugacuauagcaucauuuuagcaaauuugugauccuguaagaggaggauaaguguuuuuuguuuguuuguuuguuuuuuguuuuuuugagacagagucucacuuuguaccccagaaaguaaaucuaguuagaugugguuugucucggcucacugcaaccuccaccccgugcguucuagcaauucuccugccucagccaccacaccuggccuaagaggggaggauaaguguuuuagugaucauauuagacugaauguggcagaugagauuucccgcccccccauuguugguuagacugacauucaacauucaacaagagccaccugcccuuguaggcauuucugccacuauaccccuacauaaaccuagagugcuauugcuuacuugcuuuccuucaaauacauuuuuucauuuguggccuccacauucuugugugugauguccuuucucugugaaaugucuucuacccuuuuuuucaaagccuaguuuagaacugaccucuucuaugaacccucugccgacuggccuuuccuuccccagucccccaaguucaaaaugaucucuuuccuuugaauacuauaguauuugcacaauucacuaucuccuuaucauauucuucuuguuuauuuguuaucagcugauguugacaucauaaguucagguuccuaacuagauccaauauuggaauuuuucagcuuuugcuaagaagagagcuuguaugucuuugggaauaaugggcagaaaaagauaacuuugagaagucuuagacuucuaauagcuuugauauuuaaaaguacauguaauacaagagguuuuuuuccuacauuuaaugcauggagaagauaggacauuuagaaauauggaauuaauguucauuugacuggcaaaagauuauuuucucagauguagugaagugugguaaagaacuucacucuagagccagaaugucuguguuuguaucccagagcccaccacuuacauuuaaccauuaacauucaacuuacugucucugaguuucaguggccucaucuauaaaaugaggauaauaagaguaccuacuucauagaguuguuuuagugguuaaauaaacuaacguaaacuugcuagaacuugauaaacuaauauuggaugagaacugguugaaauaaugccuggcuauaguaaaaacuugguaaauguuaguugccauuacaaugcaacuacuguuccuaccauucccucugccagugccugguauucaguagcacucaguaaauguuaguuaaaugaagaaauaacugaaggaaugaaugaacaaaugguugauguagagauugcuuuuccauuguuguuuauugaauauuuugagauguauaacauacugucuguuaggcacugugggaugggcacucacggagcugucuuccaaagggguauaggagaggagacgcagugaucucagcaaccuaccuuuaaaacauauccuaguaucuacugccauguuagguucucuucuuuugcuuuuuuuaaaaaaaaauucucacaaaacuccccccacccacuucaguuuauagaugaggaagcuccuacuacauaauagugcuucccagucuaauucuugaccucauuguauuuauauguccuuuuuuuuuuugacagagucucacucauugcaguggcacaaucacagcucacugcaaccucugccuccccugcucaagugauccucccaccucaaccuccugaguagcugggacuacaggcaugcaccaccacgccuggcuaauuuuuguauuuuuuuguagagaugcgguuuugccauguuggccaggcuggucucgaacuccugggcucaagccaucugcccacuuuggccucugagagugcugagauuauaggcaugagccaccauucccagccauguuuuccuuuuucauugaacuuuaucuacuuuagccauuaaacuccacuccauuggucuugucauuacuaagagcugaaccaccugcaaaauauuaaguuaaaaagcguuuucuuugacaacaguuuucuuuucuucaucuuccucuaucacuuuacuucugaacuuuuauucucucauuuugaucugaccccuacuucucuguuuuuccuggccauuuaguacuuucuuguuuugcucaucccauuucccaguggagaccuucuggucugcugcuuuaucacugguuuuguuagaagacauacaaauggcaaggagguauaugaaaaggugccuaacaucauugaucaucagagaaaugcagaccaaaacuacaaugagauaucauuucaccccaguuaaaauggcuuuuuuuuuuuuuuuccaaaagacaggcaauaacaaaguacuggugaggauguggaguaaagggaacccacauacacuauuaguaggaauguaaauuaguacagccacuguggagaacaguuugaagguuccucaaaaaacuaaaaauagagcuaccauauaauccagcaaucccacugcuagguauauauccaaaagaaaggcaaucaauauacggaagagauaccugcacacccagguuuauugcagcacuauucacaauagccaagauuuggaagcaacccagguguccaacagaugaauggauaaagaaaacaugguauauaaacacaauggaauacuauucagcugugaaaaagaaugaaauccugucauuugcaauccugucuugaauagaacuggaggucaugauguuaagugaaauaagacaggcacaaacuucacauguucucacuuauuugugggagcuaaaaauuaaaacaaucgaacucauggagcuagagaauagaauuaugguuaccagaggcuggaagggugguugggcguauaaguguagggggaguggggaugguuaauggguacaaaaaaaugagaacgaauaagaucuacuugauaacacaacagggugacuauagucaacaguaauuauacauuuaaaaauaacuagaagaguauaauuagauuguaacacaaaagauaaaugcuugaggugauggauaccuauuuacccugaugugauuauuacuuauuucaugccuauaucaaaauauuuauacuccaaaaauauauauaccuacuauguacccacaaaaauuuaaaaauuuauauauuguuuuugcuaucaccuuuagaauuucuugucauuggauaguucgucuguauaccauucuggucuucauuccccagggcccccguugucugauuuuucugcuucuagaacuguuagaggucacaaaagcaagaugguuguaucuaucacaauuuuugucugacuuuaacuggguaucuguuacgauuuaguagucaucuuacugacuucuuguugguuuccaauugaauccucacaguagacuguuuucauuguaaucaguaucgaauuauagccuguucccuucuucauaaaugaaggcuuucuucuucaacaguucuuagugacuucaccuguacuuuauuucucugcuuugaauauuucgaagaaaacauauucuugcucuuucccaagguuaacacuacauacauuaccuugaccacaggauguuuucuugcagauugugaccuaauuccaucacccuucagcagcccccaccguuuucauggauucagcuaaaccuucuguaagaugacucuuuuucccccuaaucuuuauaucucuuuugauauguagcuuuagucucacuuuuuuuccuuuuggauuuugccaguuagaugucucccuggaauuccacuucagcauggcuaagacuaagcuugucuucucuuuccuccccaaagcaaauuguaauuaggauagacugaaggugacagaagauaacuaagaucuucuucauccuuucggcucuuauggaagcugaauuccaguagucauucuaaauuuguuguaugucagcuuaugguaucuuuucaugucuuuacauucagccaaagaggaaguuccuugaaggggagaccagagggcgugcugugcuucuuaauccucucuuucuuaaccaguaagaggcauucaguagauaucugaugauacugauuaauagaggggaacuuuucagauucuuuuuuuuuuuuaacccuaguaagcuuuaguacaaacuaaaugcugagagauuaucaaguaagggauugaucaucacaagaagacucaggauguuacauccuguagguuuuauaguuuccuauauuguaaaaaauaugaguuauagcagcuugucuggaugucauacagguauaaaaaucaguuuuauaaacuugaguaaauuggggcccauuuuagaaaaaacucuugcaggcugugaaugccaauauauaaguaaaguauuaaguauaauguuauuuaaugugggcaaacauaaagccagguguaaauuuuuuagguuuaaaaucuuauagaacuauacauccaaaagaaaauuucaaguuaaacauaauacaaagcaauacaaucuaaauuaacauuaauuuaaugugaugaaugauauugccuugcuaaaagugggucacuacuuacaaugugcaaaugguacucaucguuaggguauagauucuuuuaaacuaugacauacguacacuaccauguggaacgugaugauguguucucuguucuaacuacugggaagacuuccuuggcauagcacaugccauggggucaguuggcuuugacuucauauagauaugccauuuacuuggucagugucacuucuaugacaaguaguauguugugccaguuugauuauaaguacaaauaugggcaaugaaguaacuugguuuuaagguuguuacuaagcugaguaacaguguguggcuauacaaauuuuuauaggcuaucaggaaugaaaacacaggagauuguuguagauucaaguauuuuagauucaaguuugaagaugcucaugcagauguuuaacugaguuguauagaccuuuauguuucuuucuuuuucucuuuuuuuuuuuuugagacagagucuugcucugucacccaagcuggagugcaauggugugaucucggcuuacugcaaccuccgccucccagguucaagcaauucuccugccucagccucccaaguagcugggauuacagaugugcaccacgacgcccagcugauuuuuuguauuuuaguagaggcggggucucaccauguugucaagauggucucaaucuccugaccuugugauccacccaccucugccucccaaagugcugugauuacaggcgugagccaccgcgccugacugaccuuuauguuucuuaacuuuaugcuauacaucaguugauauuucaaaaauuuaaaugguuucuaugauuauucuuugggcuaagaaauugggcauuaauuguccucauauguaugguuuuuguggcuacuucauguagauuuuauuuuuggugguuaucaaauuggaauuuuuuuuuuuuuuuuuuuuuuugagacggagucucauucuguuucccagguuggaguacaguggugcaaucucagcucacugcagccucgaccucccaggcucaagcaguccucucaccucagccuucuaaguagcugggacuacaggcacgcaccaccacaccuggcuaguuuuuuguguuuuuaguagagaugggguuuuacccuguuggccaggcuggucuugaacuccuggccucaagugauccaccugccucagccucccaaagugcugggauuagaggcaugagccaccacaccuggcugaaauuggaauuucauugguacugccuguaauuuuauguuaauuuuuuuuuuuuuuugucgucacuagcuuuuaucuaaagccccuagagagaaaggccaugauaccuuguauacaagguuauaagaguauacaagggaaagggagggcugaagggaacagggugggcugguacaagccucauuagaaauaccauugagucugugaguaaaacaucauuauaugaaaaggagaugugguuuuagggugguccaauuacuuuugcaccagccuaauaaaauuacaagucauuaucaauagagacauuguaaaaccuuuuuuuuucccaaaagaaguaucagguaugauaauuacaugucugcccaacuuucguuauagauuaacauaacuuaauuguauuuaagguacaauuuaggagaguugcugaaaaaugaaucuuuaguauugggaugccuugauucuacccucaauagcuauaauggauuaugugucugaguagauuaauaaaaaucuuuugagcauuuuucuugaacuacuucacugaagauuagcuuuuugagcauccauuuuaauuucucaguauauaaggaucgguuuaucacaacuguauuguuuucccuggccuuguuagauuauauuuucauaucauguagaaaaauagguguauucguucucccuugaaguccuuugucucccaaaggaaaugguugcaauacagaugugucaccucuuccacagguaaaguggaauggagaaguagccaguuaaauagugcaugcucaauuuggaacauuuagagcauacaggaaaguuauuuauuugguaaauauuuuuuaagcauuuacuauguuucaugcauuguacuaguuguagaggauauaauugaauacaacuacauguagcccuugacuuuauggaacuagucuaguauaaagauuuaagauugccuggcaugguggcucacgccacuaaucccagcacuuugagaggccaaggcaggauugcuugaggccagaaguuuaagaguagcuuggucaacauaaugagacuccaucucuaaaauaaauagauagauagauagauagauagauagauagauagauagauagaaguaguuagacaacacaaagcaguuucacucaucuuguggcaaggaguuauguauuucuaaucaaauuuggcaacucaagcauuuucaacaaaaucuacauguuuuuucagaauaaagugaccaacacagaauguuaccuguaaaaaucagagcaauaauugcuaucuaaaauaauuuugaaaauuaagugguacugaaaggcucauauagcaaaaauauggccuccugucauuguacuuuccuacuucccagacucaccauuuucaacauuuuuuaguaguuuauuuugccauuuuauagcauaguaccugacauuuuauuuauucaacagacauuucuuaaguaccuaauacaugccauuccuuguuugaagggaugcuaaggauacaguggugaacaaggcguugugggguuguauagaggguauucauuccuaaccuugaaccaaauauuucuuucuguuggauaaugcauuaaaaauugcaaacaguuuacaaacuuuuggagcaaugguggccuugaucauaaaguagggacugcuucuaccguauacaugcuuggugguguauuugugauaucuggcuaaaguuucuacauggaaauugacugacuuuaguuuugagacuucugggaaccagucaggcaaaauagugaaacuguguauccuguuuccaagaguugucuuuuaagguuaucugcuucauucauuuggccugacuugcuaggcaaaugccuaggguaaauaugauuugauuaacuauaacaacaacagcaacaacaacaacuuuauuuuuuagagcaguuugagguucacagcaaaauugagcagaauguacagagauuuucccuauacccgcuuccccuacgcaugugcggccuccccuacuaucaacaucccccaccagagugguuuguuacaauuaaugaaccuacauugacacaucauuaucacucaagguccguaguuuacauuagaguccacucuugguguuguguauggguuuggucgauuuuauaaugacauuuauccaccauuauagugucauacauaguaauuuugcuacccuaaaaauccagugugcuccaccuguuccuccuucccuccucccucaucccuggcaaccacugaacuuuuuaacaucuccauaguuuugccuuuuccagaaugucauaucauuggaaucacacaguaugcagccuuuucaaaugggcuucuuuccguuaguaauaggcauuuaaguuucauccucaucuuuucauggcuugauagcucauuucuuucccucccucuuuucuucccugucuuccuuccuuccucuucuuuccuguuuccucuuucuucuuccuuuuuuaagagacaaggugucucacucuguugcccaggcuggagugcaguggcccaaucauagcucauugcagccuugaauuccugggcucaagugauccuccugcguuagccuccugaguagcugggaucacaggcuccagucauuuuagugcugaauaauauuucauuaucuggauguaccgccuauucauucaccuacugaagaauaucuugguugcuucuaaguuuuggcaauuaugagugaaguuacuauaaacauuguauacaaguuuuauguggauguauguugucaucucccuugggcagauaccaaggagugccauuguuggaucauaugguaaauauaucuuuaguuuuguacagaauucuagguugguauuuuuuucucucucaguccuuuauuuuauuuggagacagucucgcuaugucgcccaggcugccauacaguggugccaucugggcucacugaaaccuccaccucccagguucaagcgauucuugugccuuggccucccaaguagcugggauuacaggagugcgccaccacgccugcuaauuuuuguauuuuuaguagagacaggguuuugccauguugcccaggcuggucucaaacuccugaccuuaagugauucacccaccucaaucucccaaaauccugggauuacaggccugagcuacugugccugaucucucucaguacuuuaaagaaauauuucauuccacuuuucuuuuuuuucuucuuuuugagauggagucucacucugucgccugggcuggagugcaguggcgcgaucucagcucacugccaccuccgccuccuggguucaagugauucuccugccucagccuccugaauagcugagauuacaggcgcccaccaccaugcccagcuaauuuuuugcauuuuuaguagagacggggguuccaccauguuggccaggcuggucucgaacuccugaccucgugauucgcacaucucggccucccaaauugcugggauuacaggugugagcuaccacgccuggcccacucuucuugcuuacauaguuucugaggagaugucagauguaauuuuuauuuuugcucuucuguaggcaaguugaguuuuuucccccucuagcuucucucaggauuuuuuucuuuaucuuugauuuucaguaguuugaaaauuauaugccuagcugucaggguuuuuugcuuguuuguuuuuguuuucucaggugugacuccagaaagguucuaaagaggagcuuuacaaucucuucucugggguuuauggagacuuccuuuacccuucuguguuagccccuuaaagcacugcgucaaccuuaaaagggcacaggaaagggugucuaugccauuuuuaugccauuuauccugcuugguguuuucugagcuuucuucaucugcgguuuaaugucucacauuaauuuguagaaauucucugucauuguuucaaauuuuucuucaguucuuuucucuguuucuucuucugguguucccauuaugcuuuugugguugucguacaguuauuggauauuuuguuccaggcuuuuuuuuuuccagucuuuuuuuccuuuugcuucucgguuuuguaggugucuguugagauacucucaagugcagauauucuuuccucagcuuugucuaguuuacuaauaagcccauuaaaggcagucuucauuucuguuacagucuuuuugaucaguagcauuucuuuuuuauucuuucuuaaaauuucugucuuucugcuuacauugcccaucuguucuugcaugguuucuacuuuguccauuagaguucuuaggauauuuaucauaauuauuucaaauuucugguguaacaauuccaacaucccugcaacauccaagucuaguuucgaugcuuacugugucucuuccagcuguguuuuuuccuauuuaauaugucuuauaauuuuuucuugauagccauacaugaugcauuagguaacagaaacugcugugaguggaccuuuaguaauguggugguaaggugugcauggaggggaaacauuuucagucuguuagugaacuuuugucaacuucacaugugcuucucaaguccauccuguaagugggagaguagggcuagagaggacugaaguuggguauauauuaaauacuuucuccuacaaagaagccuagaggggacgcauuaggggauuuuuuuucccccaguauucacugugaugacccuuauugagcuccuggagguaaaacucacaaaacugugguucuccccccugcccauauuacuacaugucccuggaguuuauaucuuucagacuugucugcacugagcuuccaccaauuugucaaauacagaucagguuucccuaccacccgugcaguugaaaacccacauacaacuuuugacuccuccagagcuuaacuacucauagccugcuauugacuggaagccuugccaauaacauaaacaguugauuaauacauauuuuauauguuuucuguauuauauauuguauucuuacaauaaagagaaaagaagauguuauuaagaaaaucauaaggaagauaaaauauauuuacuguucauuaagugguucccaugggugcugguucccauggagguugccccuugugaguuuuugcucagggaaguugugauucucuauauuugccuguuggucuccuaauuugggagucaucaguuuucccugugaccucacuucucuuacagaguuaagaacaguuguugguuuuucaguuuguucaguguuuuacauguuguuagaacacagugguacuucuaaguuucuuaacaugcuagaucagaaaccugaagucucaccuaauuuggcuuuuuauauuuuuucuucuuuuuuuucuuccauugcuaccaaagcauuuuucaucugugucuggggugacauuagagcagaaugugauuucuagguaaacauuauugggcucccuagcagaaaaauuuuugaaaguaguacaugaauucuguauaauuaaaauuuucuuuucaucuuaauagguauagguaauaggcacggccuauuuuuuuuuugcucaacagucuaaaauaguaauuuaaucaccuaauagccuuaguuauauaguugaaagaagaguuggaaaucugauucauggguuggaaaucaccugucacauaugaguuuuaggcacuggucacuuuauuuugaaacagcuuugggguuuuuuccuuuuucaacucauaauaggcuuuaacagcuuuuaguuuuguuucuguuuuuuuaacagcaugaguugccaaauuugguuauagcuucuugguacaagauggguaaauuugcuuuguguuguguaauuacuuuuuauuuuaaaugcuaccucuuuuaugaacacuaacuuuacacuaagauuaggaaaaugagaauugcaugucugcaacaaauagcuaucuguaguauuaaauugugaaaauguagacuuuggauuggagcuggcaucucuuaauauguaauuguaacauagaguaaauaaguauuuugucccuuguagggucaaacaguacagugcaugggcagaauuagagauguaggcuuuuuuuuuuuuuuuuuuuuuuacuggcuuagagaaccguuugaucagcuaauauggaauuaagucccuagggcugcccaggcacaacauuaacugcuauuaaaggaaaauuuaaaagaguauuagugaagguuaaauacugaccauggacaucuggcaaaauugauguuuuuuuuccccuccaccauuguuuauaguuuauuguuauuuaucagagaauuaauguuuauuuucagaaucuauuaccauaagaaaucuguuugaggacuucguaugugccaggaauucuacuaaauaaugauauaaugcugaacagaauuagauaggauccucacuucguuaagcuuacagucuagugguauagaucaacauuaaucaaagaauaacacaaauagaaagcagagcagugguucaugggauugacuguagagaagcaugagggaaguucccaggugauggaaaauacuuuauuucuuaaucguggugguuacaugugugcauauguuuaugaaaauauauuguacauuuaaaguggauacauuuuaucacauguaaauuaugacucuauaaaguuaauuaaaaagaauaacucagguaagguggugugugcgccuguagucccagcuauuucugaggcaggaagaucacuugagcccaggaguuugaguucagcaugggcaacaugagaccugugagacuuugucucuaaaaaaauuuaaauaaauaacuaagauaaauguaaaauuacagcuguaguaaguucuacaaaggagaguuacaugggcuaugacgauguaagauagcaagaacugacauuggcagggaggaaaugaugaugaguagaaguaaauaagugaaguguggggauugaugucaaggggacaguauaaaagaaauaacagcaugcgccaaggcccuaaaauuggaaaguccuuggcaaauuaaaggaguuugaaaaaggccauugugugcaaagcagaaaauagguacuacaagguaaaagauggagcuaagcgguagguaaggcuaaaccuugucagccauuguuaaauauugaauuguauccuaagcacaacucaguggaaagcaguuaaaguucuuuaauugggggaggcaaugaagggguaauaaaauugguuauagaaauacugcucuggcucuaguguugagaaugaauuggaguagccagaguagauucaagaagacuuuaguaagauuauuccaacaggccaggaccuguuauagggugguggcaauggagagagauggacagaauggagaguguauuuaggagguaaaaaugacagaacuuggugaugcacugaaugugaaauggggaaggugucuaggaggacuacuagguuuaugguuugcguauuaggguggaugauagcaguuucauuuacugagacagggagcccuggcagaguacccagcuuuuagaguggguagggggaaggggagagugcaucugguguugggcauuuugaagugauuuacauacaacaaacugaagguaucuuuaacacugaguccagcagguuagcauauuuauucagcaagcauugcaccuuuuuuuguuguuuuuggggucuucaacuccuggccucgaauccucccuccuucccccgccucucccagccuccgccucccaaagugcugggauuucaggagugagccaccgcgccuggccagcaucgcgcuguuugugcagugugcccugugcuaggucuugcaguggguaccaguagagacauaaaaguacaaaagauaauuggacguuuaguagaguccugaaagggggcgggauaggaagauaccuaaccauaagaaaaaccagcaagagcggaaaaggagcuaguccuccagaucaauaaguuaaucacuuauguuugugauucccugcauuuugggugauucucugucgagguccucuuaaguccagacuuuugauauaaucugcaguuugcgccauuuggauuccugaagcaucuuuacaagccaccuacauuccuuauggagcuguggcacaacagcaagcccacgaugucucaccggauuaauaaaaauauaggcgcucacgcuuuuguuuaccgauauaguaucuccuccuccccucacuccaucaacccccacgcgacacaacuuuccggaaguaagcaaaauccguuaucaaggugaaacuccggggaccaggcuccacagcugccauaaacuggauggcacguuagaagccgguggguguaggugaggcacgcuggcgcccgcgggcccuucuccagccgcuacccagugggaauccgcggggcugaagccccgaaaccaggcugagcgucccagagcgcaaccucccuuucccccagcagcgccggcgccgcagaagccgcguguccccaggcgcacucccccaaggugaacccccgccccccacggaggcggcugggucgcgggucugggcggggcgcuccggacgcccucccgccgcugcgcaccccucccgcgagcugccagcucccucggccucuccacccaaaacuggcccaaccgccaaucgucugccucucaccuccuacagcaggugacccauggccaaucgccaggggucucuuugccaggagccgccagggccagccaaucggggcgaccccuccgccggggaggggacgggaaagggguggggggugaagggggugaagggggugucccgggggacgggcugaaccucagucaggaccgccugcaccgcaguccggggaucgggucgaggggagaagaaaaaggggugcucgggagcagcccccggcuaccuccccuggaggcacagagggcgggggccuuggcgaauggcuuucuugcuggccacuugcggagugaguagaccccgagggucugggagaggggccggccccuaccccugaguccccggggucccggccgccaggccggagcgcgaaugucgugcucacccugccuccuucccgccgcccccuggggugaguaggacgacguggcugcccgggccccucuuccuugggaguucucaguuccucagccuagaugggguggaggcugaggucagggccuccaguuccaccgagagggcauucgcccccaaaugagacuuuggaggaggucucuuuuuuucuauucauuuuuguggaacucuguuuuccuuuugaaagcugucucagaauaugauuuuaagcagaaaaguuaagcuuucucuuaugugaaagcuuaauuuugaccaguugcccauuaauagaaucuccaguugcaggccaaguguuuuuugguggugguuuauuuuuggcacgguguucgugccuggcccuguauuuuuuguguauaaaguaauuacggaugcuauuguuuuugaguaugugugucgggaaggaggugauuuuacgcuuuuuggguagcuugugcaaaaauacugaaaacuuugguauaguuuuaugggguucuuagcccagccgaguuauggaaaguugaguauaauuaauggacuaggaagcauauuugaguaaugcacuuuuugcugacauucauacuguauuauaaguauuuguuaugaaagguugagagauguauugaacaagaaaaccaguuuugcuaauuugaaguaauacuuuguuuugcuuuuugauuaaacuguuuacuuuuagcuguauuaaggaaguuaaaaucaaguaauuccuaguuucucaguggagaagcuggaagcaucuuagaauaguaguuguaguuuuaaaaguuuuuacagugaacuuugaaacuggaaauucucacguaguuaauuaugaauaaucucucuugaacacugccuguauugaacuaaguaguugaugaaacccuuuaaugaauacuguuagcaccugucauuuauuuauacuuuaaauauauugcuuuacucccccccaccuuuuuuuuuuugugcagcccgacaagagacaaccuaaauaaaaauaccguauuaccuuuucuaguucagggaagguguaugauuaaaagucagauuugggccagucgugguggcucagacugcaaucccaacacuuugggaggcugaggcgggagaauuguuugaguccaggagcuggagaccagccugggcaacaaagccagaaccuuccccccgccccugccccaauaaaaauuuaaaaaugagcugagcgugguggugaugugcaccuguguucccaccugcuugggaagcugaggcggaaggaucccuugagcccagaaguuugagguugcggugagcuaugauugcaccgcugcacucuagccuggaugacagagagcaagacucugucucaaagcaaaacaaaacaaaacaaaaaggcgggcgcaguagcucacgccuguaauuacagugcugccuauaaucccagcacuuugggaggccgaggcggccggaucucuugaggucagggguucgagaccagacuggccaacauggugaaaccccgucucuacuaaaaacacaaaaauuagccgggcgugguggcgggcgccuguagucccagcuacucgggaggcugaggcaggagaaucgcauaaacccuggagggggagcuuacagugagccgagaucgugccacugcacuccagccuggcgacagagcaagagucugucucaaaaaaaaaaaaaaaaaacucuuaaagaaaaaaacagauuuguagucugauuugagagcuuaagugagaaacaagaaagacaacagacaaguuucaucuguuuacaaagugcccugaguuuggcuuugacagagaugacgaugaauuuggaagugcccuucaguaaauacgaggaugcaaaggcugucuacuggucacguucauuuugguauuucuaaaguucuaugauauuuuuaaugugaaauuuuucaaauguuuuuuaaugugaaaagauuauuauauuuuguacgcucagccauccccacuucaaucucuguugauauuaagauuaguagggaauuuaacuguaaguuugguucagccaggaaagagcauuauuuuguuagcaccauguucugcugguuggaaagucaggcacucacaugguuugcacgcuguugauuaagaaaggggacgaugacaagaaaaucugauaaucaggcuuuuguucagagaagcaaauucuaggauguccccugggguauguugaguucuaucuguagcuaaacuuuauacuguagagcgaaaacagauauuuaugaugauucuuauauagaaaaaagacuuugugauuacuguaguauacuuagaaaauuauauuuaggaagcuuuucaguaaagguuuaaacaaagauuguuaagcuugaaagaauaguucuuauacugacaauguaauuaagccacguauuccuccuuaaauauuuuaaugaaguucuaccacacacaggcauuuaaagcuacuuuccaucuuccuuauuuuccaucuccagucaccagguccuguuauguuugccuuaguaauauuuuucagauucgucacuuuuuucuagaugauaaugcuuuaauucaggccaucauggucucucaccuagacuuuugcaaggcuuucugacuagucugucacuggacuccccuuaccccauccuuuuuauccaaaaacaaauuuggaauggguugccgcucuuauaguuaagaauguguuuuggcuccuccuugccagaguccagcugcccagcauguccuggaggcccuucuucauauucugguccugauuuaucucugaguccagacucagcuccaggugcuuuacccacggcauccacugugaacuguuucucauugagaacaugccauagccucucacaguuauuugucuuuucacagccuuuccuucuugcuuagauuaccccacuguaucucaagugguaagccuccaguucuuccuuagcauacagcuccuguguuaaccuuuucuaugaugccuuccuucaggcagggugaguuuguuacucuugugugugcuacuacagcacuuugcucauaucuccauaucacagccuucacuaaguuguauuguaaauuuuuaaacauaugugauucuugcauuaaacccugauuuccuagagaucugggguucucacucaucuuuguauccccggggccuuugucccuaguuuagugcauggcacauaguagguguucaguaagugcuuaagugaucaaaauaugugacgauaauagcuuaaguguguaaaccuuugacucaguuuuacuggaguuagguuuuucccugugaguuaaaaaugcuuccuaggucaccaagcucccugguugcuaccagacaugagaaacgggggauuggaaaaauguuuagaaacagugcuaaaaauggugagcagggccgggugcgguggcucacgcuguaauccuagcacuuugggaggcccaggcuggcagaucaccugaggucaggaguuggagagcagccuggccaacaugguaaaaccucaucucuaauaaacguacaaaaauuagcugggugugguggugggcaucuguaagcccagccacuuggggggcugaggcaggagaauugcuugaaccugggaggaggagguugcagugagccgaggucacaccauugcaccccagccugggugacagagcgagacucugucucaaaaacaaacaaaaaaaaaagugggcagacuuccaggacuccccaccuuccccuacccaaucuauaggaccucuaacaugauuaaaauaauacuaauaguaguacgaguacuaauugguucuggaguauuguuaguaucauaggaaaaagcauguaggcuagcuagaaugucagggaaacugcuuuaaaggugaaauuugagcucauuccagaugauuagguaaugcuuaauuauauuugcuauuaauauuaucucuauuguccuuaaagacauccuuugaagaugaugauaguaccuggccauaauagacauuaaauaaauauaugugucaugaaugaaugguuugguugcucuguauguguguguauacaugugcgcacgcaggagagagagaagagaacuguaguuccugccauauuggaguucauuuauuucuggagacaccuuuaggaacuuggcuucuuugcuguauugacugaacaacucguuuuucccaaaaugugccacuucaauuaaguuauucugcuuacuccguuguuucuuugcauucucugcauuccagagcauguuuuaaaaucugguuguguuagucuuucucacucaguuucaagguuacacuaaaugacagaguuugcuuguguuuugacauauuuugucauaccguggaggacuuggcugcaguuggaaccuguaaauucuuacuguguuuauuuaaaugaaauuaauuuuuauuaaggugaauacacgggccccagguuuuccaauaugguuaggaauuuauccuccuggugaaccuaguuguuuaccuggaaguauuggcaucacacaauccuagagcuggagagaauuuucaaauucuaauuccauuucuaccuuuuuaaaaauuuuuauuauuguggagaaaucagucucaaagcagcuaaacgacuugcccauggccacauagcuagagaguaaaugacuagggccagagccuagaugacucuugcucuuuuauuuucuccagagagacucagggugcugcccugguagucuccaccccuuggucgccuuucccccccaaacccuaguacuuauucccauuuuuagccacuaauuuugguuuccuugagauucagcauccagauccaaaaaauauacauucuucuguaacagaauauuguuccucaguuggccuccuugugcuucucagcuccucaguuugggaauaugccuuuucugguuauucuccauuuucuugcagauuuguucucuggccuucucucuuccgugcucuaggaggcugacuuuuacagcuuucagcaucugggauccuuuaucccuuggcuucugguugggguuuagcaaaugggaagcagugacagaaaauggaagggaaaaaaggccuuuggaguauuuguuccuucugcuccuuccaugcuuugaggcaauucuggcagugacuguuuuacagccguccauguccacuggccggugggaaccuuguuuguuuccuugccccuucaggcuacuugcagcucuuaauuccugaguaccucagcaucucuuguuaguuuucuuagcccuacucucacuucuguggguacuguagucacuugauuaaagaaaaguucaaacauuguaucugauuaugcuguuuccugccagggcccacuagcccgguggaguacugcuuuaccccucccauuucuguccaaauccuacacucuaaauugcauccucugugaaagcuuucucguccuuauaacuuucuccuuugaauuucuucgugcuuuucugauaacauuuuaccaugcuugaaucaauuauuuguagacagauauauauucccucuaauagaaugaaacucuuuuagaucugugucugcuucaucuuggcauccccaaaggauccggcacagggccauagucauaagagaugcucagugaauaaguaauuauuguaacacugaauucuaagguccagcauaguauguguaaaaaugugcucaggauaagauuuagugugagauaacgaguuuuuagagagacaagaagauugucauugccucaucuuguuucuuguuuuacuaccauuuauuucaauguguuuuucuccuaguuaguuucucuuucuucuuaaaaacguuuagccuuggaaaaauucagcagccauacauuacagcaaccaacuaauauaauaaaucccuuaaaauaacucuaugaguuauuuaugauuuuuccacgaauauucugauuuauaaucugcaagaacuaguuccuugauuacuuuuuguguuuaaauguuaacaggugggcacauugcagaauuccuuaauucauuuacaaaauuuuuauugaggacuugcuacaaaccaaacacuagcccgguggagauaguagagaauaaaacgaaguccuguuuucauuggcuuguauuuuauaucaucuugauagauucugacaauuaaacuaaaucaguaauuuuguaugcacuuuuuaacaacuuuagcgaaaaccgaaucuguuuucuucugguacucauuggcagcuaaaauuagauauacgaagacagcuuuggcauauauaauuucuaagagauaaaugucagaacaauuguugagucuauucaagucagggucguuguuuuauuuuguuugccugugacugaucaucuaucuguuaguccugacuagcuaucaccuugaguguuaauuugucaauuuguuauauucugcuguagagauucagucuuguuagauuaauauaucagguuuuguuuuugaaaacauuucauaaucaaauuuucaagaaguauuaggcuauaagaauuuugcaguuauuucagaaccugaacuaacuacuaaaguacucaguuuaaggauucacguauuuaauguuaauuuuuccuaguuauuuguagaacacauuuccaggaaauuuacucauuuuugauggauccuuaaaaguagacuccagauaggcuuuccaaaaugcucuuaaucugagguuggggaauggaagaauauuuuucuuucauccuguacuaguaaaccucucagaguuuauuuagauccuggaaugauuuacuccaugacuucuaagaaagauacugcaaguagccuaaccaacuaaaguaucucagaagaaaaguguuggcugauugccagcacuacauaguccaacagugcuuuuguuagguggugugcuguaguagguguuuucuucuuuaagagauugcuuucuuggauguugagucaugaucauguuguuggcaggaaggagguggaaaaaaaaaacuuugccauuuugcuugguuauauuggccacuuuucauuauuuuauuuauuccaguauagugauuacgaaguuuuaagugcuuuuugcuagugcgugcuuuaccuuuaaaugauauuauaaauuugcuauccuacuuuuuugcuuggaaagguguaucugagcagcuuuagcauuugccagauuuacuccuggaaaacauuuuauaauuuuauagacaauuucaaaagaauaaugcuuaugaccuugcaugcuaaaaugguuauaaaauuuucuaaaaauguucauaaccuguagcuucugaacauuuuuaccuaaagcuuuugaauguaaauuauaaaauaaaugcauauuuauuuuaaaaaauuaaacaacaugaauguguaaaauaaaaacucagagucacugucucacaugcccucauuccucagucccauucccuagggguaacugcagguguuuuguuucuuuuguuucauguguuauauuucagggguguguguguguguguguguguguguguguguguguguacauuuuuuaaaaugaaacuucuagugcguaaguaaaauuacauaaaacugcaacuugaguauuauucauguguguacuuaucuagcauaagguaagcacucaguuaauauuaacugcauugaauuccagugucuuuuauuucuguagcuugcuuucugcauucagaaccuguaaacucauuucauuuuagguuuuguaguuuuuuaaaaaggcaauuugcuggauucugaaucaucugaggcaauuuuauaugccuuucauaacauuugugucuuaaaaauccuagcuauauccuauauagagagggugaccauguaauuuauugccuaaacugggauacuugagagugaaggaggcugcuaauaauaacuuugcugagacaaccaggcauaaacugaccauccaggcaaacuaaaauauacagucauccuauuuacagacuuaaguuuuuuguuuguuuugguuaguuuaguaacuucuuauauggguuuguugaauaaauugggagugucugggaaagacaagcugucagugauuuaaauagagaaaaaugguacgaauuccagaccuuuauuguuuaguuguauaaguaaccaaaucacuuuauggaguuaguauuuguguuuuguucuauaagucaaaggguguauuaguaucagaugaggguaucaugaagaguaaggaauugugcuaaggguuaugauugaaguucuugcauuuuagcuguacccgauuccuguaccagauuuuagcuguaccagauuuauuuuuuagcagaaacugaacauuacacauaaaccuuucuuuguaaauuuaaagauaaacgcaauucugguuuuucaaagcacuaacauauguucaaaaauuagauucuuuuaugaaaaaaacuuucuuuauauuguuugauucuuuguuaccaagguaauaauuaaguacaguuuaccuuuugugguucagucauaauacccagugcuuuccugaacaucucauauuggaauauuuuuccugcucuguuuuccauacuguguuuuaccacuuguuuugucuguuauucauuucuuuuuuauuaccauucucuauuaucuucuugggaguucaucaacuuauagcuuguuuuuaaaacagauguuaaauacaauuuaacuuaugcuuauagccuuuacuugauuguagaucuauaugaaaauugccugugguuauaguauuaucuaguucuugauucguuuuguuuuuauccauccguacucauugagugccuucuaugcguaagggccuggagauauaguggugaauccugguuaucuaaggcuccaaauuaugaaggggaaguagaacaccuaccacuguguuacuuuacauguauuacucauuuaaucucuccaguaaccuugaguaguuuauuauuauacucauggaugagaaaauguaagugaaaaaaguaauuuggcuagaucacacagguaauucauuagaaaguugcagauucaggauuuaaaacuagaugaguccuuaaagcugugcucguuuccacuaugucaagggccuucaggcaguuuuuagauuacauuuuagugcccuucugucauuaauuccuuuuaaacaucauugugauuuaauagaaaaguauaauggauuuggucaaaggacuagguugauaucccaauugaaaaaaaauucagcuggaugauuuggguaagcacuuauaaaacagguuuaauaucugucuaccuuacuguauuauaaugcucaaaugagaaagcuuguaaagugucuaguagaguaccuaauacucugaaaaaaauuuaauauacauugugcauccaugauguuagagcugcuuacuuagcauuacagaaaaagaccuuacuuuucagggcauucuugagguaccuagcaguugguaagguaacuacagcuaccauguugacaauaaagaaccuaauuugaagccuuagauuaucaagacauugguaaauggaaaauaacuucucuaagguauagugaaaggaaagguuuaauacuaggcucaauuuuauggauauuuuuuaauugaugaucuucacuccaaaugaauugauaguugacuauuccuuaggauuaaaagagaugaaaaucuuaaccccagaacuucccuguucuucuaaguccuguucuucccuuagcagaaauggauaaaccacggggacaguagggauuguaaauguuuccaaauuuucaguaauccaaggaaaucacagauuagugugccucacauaaaaucaugguauaaguaauauuucuggucucuuuaauauacuuuuuuucaucgucaaaccacuuuugguagggagacaagaugucauuucucuaaaaacuuaauuugcuaacuuaaauuucuaagaaaggccauuauguuuggcauaaucuuuuuuuuuuuaacuugccacuugcugcucauguaccuacuuuuccucuguguaguuacagauuuuucucuuacuauuccuuuacuugauuauugauguuagacucacagcaugguaacuuucuauucucucuuuuccuuacuuuuauggaagaucaguaccacacuugcuuuuuuccagucuucugguaucucuccaguucuugaauuuucaaaaauaauuguaagugauugaauuguaaguaugcucuauacuucuuucauuggaugaaagcuuaucugugaugcaugucaucucaaauugcuaauugugaacauaaacuuuccaauauucucauauuuuaaucaaaauuacauuccugcuaaguuuucauuaguuuuauuauaggguauguguuuuacuaauuaaaaaaaaaugucugcuuuuguccagauucaugccauuuauuuuucauuaggaggcuuguuguguguuuuuucuuuguuaaguuuuuaagcuauuguuuaauuuacaguucuacuacugauaacuuaccuguuuuucuuguuauucugauuuuuucuaugagacaaagaauaacuuacuucuaauauauuuucuuuuucucuuuuuacaacauauuuuuauuauauaugauuuugcccuauaagaaaguacugcauauaggacacuuacuccuuuaaguuuucacugugaaauaaaauuagauaugaaaacaauuauucauuugugaauuucuuuuuacaauguuauuacucagccuuccuguucuaccuuauucucgguuccucagguugcccauagguuucuuaauuuccggauucuggacucaagaacuucaccuuuaucuccacuguucauuacucuuccucugucagcaggaauuacuuuaaaagcuccuacucugccucaggaauugacucuuguguuguuuuacuaaggaagugucucuccaaagcaacuauaauuuauaugcacuucagacaguuuuaaggacuucucuugcaguacuccuuuuaauggggguaaaacauucaguuacguguauguguaaaguauaaauaguguuuaaugucccaacugaaaucauuaagaauugauuuugcugacauuuguuagcuuuuaaguuccuucugaaaaaaguaguguuauuuaacuuaaguauuagaaagguaguaggaaguaccgacauacaguuuugaggcaguuugauauucuucuacaagucuaguuauauuauuuuagaaauuccccuuaaauuggcccagauguguauguuucucuuucucucucuauuaaacuggauacauagauucuggaugauauagaaguauguguuauucuucuugacuuuauguaucuacuuuagauuuugcuucuuuucuuucucucuuucccucucuccuucccuccuucccucccucccuuccuuccauccuuccuucucccucucucucccuuccuucuuuccuuccuuccuccuuuccuuuccuucccuuuuuucuuuacuuccucuuccccuugcccuucccuucccucucuccccacucccucccccaaccucucuuucucucucuuucuuucuuuuuuuuuugagggucuuacccugugcccaggcuagaguagcuuuauuaauaaaguguuuuugaaaaacagagacuuuuuuuuuuuagcauauucaccacagaagugguuuuucuuuacauagguuucuaaauuuuaugguuagauugaaguuuaauuucuauugagauucuucuaauuuaauuucuuguuacaucacagaccauuuugucuuuauuucucuauaauuguuguguauaauuuaaacuuuaaaugaauucauacaggaaucaucuaauuagagcuguggcucacaucaguguaauaaaccaaagagcagcaaccucuuugguccugagugccaauaaugcgacauaaucccuucaguuacuacugaaggaccuggacaaaagagaaagaaagacaacauggagaaaaggcuugagggaguagagaauaggagaaagagaacagaaagguaagagaaaucucgggagaggaggucgggggaagaccgauguuguggcaucaacaauuuccagucacuguagccagcgccauguguguucauuuaacacugagcuggcccugauggguauagugaugaaugaauggcauaguuccugcccuuguggaguuuuaauccuucagagaagucacucaaauauucaauuaugauaaaaugugauaaauguuagagcaaguacagaauacuagaauguguaucuacuugacucccagcuuacuuguucucaaaagcuacuguaagaaguaugaagucacacugucugaaagaauuugcccuauucucaguucuuuucaaagacagaccacccucaauaugguaaaggacuauauucuuaguccuguuuaaaacucggccgggcgcauuggcccacaccuuguaaucucagcacuuuuggggacacugaggugggaggauugcuugagcucaggaguuuuuauuuuauugcggagacagggucuugcaacauagcaagacccugucuccacaaaaaaaguaaaauaaaaaauuaucugggcuugguggcacaugccuauagucccagcuacuugggaggcugaggugggaggauucccugagcucaggagguugagucugcagugagcccugauuguaccacugcacuccagccugggugacagagcaagacccugucucaaaaaauaaauaaaaauaaaucuccauuaaaaaggauuaauaugaauaaguguuguggcuuaguguucuaaauguugaauggaaagagaaacaguuaacacuucaggagaauuuuaaugaaauauucuacauuaggaaguaguggguuucucaucucaugagauacuuaagacaagacuagaugacuuucaaagauguuaugaaaagaacuucugugaaugggagguugaauuaggugacugcuguaagucacaauauaaagucauacuugugcuuucuucuagaguauuaguuuuacuagauuugagaaaacacuuguuaacuacuuguucauguuaucgaugaauuuuacaugauauuuuauugguugcagauggggcaacuauauacauaaauuuuccuuuuaaauacaugaaaaauuuuugcauuacuaugcaagggugauugggccaguucugggacugucauuauaaaccuccuguuacacauuaccuaaagaaaaauggauugaugaguagaucuuuggcuuggaccuugugaagugugaaguuuauucuagaguuaaaagaagguuauggaagacuaucuagaggcaaguguaagaagagagucaaggugagguuuauaugauucuacaaacaucaaaaaguuguuucugaagaauugauuuagguaagguuuagauagcaguaauuuaaaucuguuuccauucagucacugaacaauuuuuaaucuaaucgguaauuuguuuaaaaaggauguuuuaguuagauuuuuacaauguuaauucuaaauggauucagaagagugaaaauacuuaaagaucacuuuuccccucucauuuagaugcuuuuuuuauucauuuaugaauaugccauuaaccuuuuaaaauauuuacuaaaaacaauguauuuagcugauuuuaacugggucuugauaguuaauuauugauaaucauguuacauugcugugugaaacaaaaccaaaaaacaagccaaacaguccugauuuuucuguggcacaguaacauggaaauaaguugcucauuucuuucauaguacaguacucuaauaucuaugaaauaugauguacuuauccauuucuaugucuuuugucaccaaacuguauauuuuaaaugucucuaacaggaacuucuuuggguuaucuuuaaaaaugaagaaguuuaaacacaguuuuauaaauauaucuggauuuuguauacauuguuuauuaagauuuuuuuuuucaacuuuuguuuuuguacaugucaucucauugggaaggggcuuuguaauacucauugucaaacaguuucuugauauguauguaaaauagacauuuaucgccuuugaauuugaaaaagaaaacaaauuaugagauaaguugauuuuucccauggucuuaauaggacuuagauuuuuaauaaaauucuauuuuuucuuugguuccaaauuuuugaauuuuaguuugggaagagcaacaaaaguacuauaauaguaguaauugauagugucauuaguuguugucuuuaguagagguaguagcugcuguacuaauaauaggaggaggaggaugcccguauuuggcuggcaagaaaacccagauuuggacagccacaauauuguguuagugaaugcacuagaauuagaaaccagauuugccagcccauuacuguuuccauaauaccauaccaucuuaauuugauguuuugagauaaugguuguaaaagugcuuuaaugauaaaguauacaaagaucagguguugcuguaauauaaaauaaacuuuggcuucaguuuacuaaaaugagaaugugaaaauaaucagcaugcuuugggcgaaggcagggaggagaugacaagugaaagucaagugugagauggguauguugaucaaguauauuuuacccauuuagugcagaauuuugugguuggguugggauuuuuacaguagcaguuccuaacccucaguccccugcuuaacaguaugaugacugggcaugaaaauguggcagucagagaagauuaagaacucaaaaguuucuuuuggcuaaaguuaaaacauaagaaucccaugcucuuggagcuuaaacucuuuacguaugcaaaaaguaggacaugcaaaugcugcacuuuuagaccgagaaauaaguaggccuucuaaauaaauaaacaucuauaccacgucuaaguguaguguucaugccaagggugaaagugaguaggaaacuugauuaggacagguguuguuacuuucacuuagagaggggccaccucuuagaagaggagaaaauuuagagguucuuucuuuaguaggggaggagggaggaaaacuucagagaucaugggguggguugaggaaugggagaacuaaacagugagaauaugaaguuaacauuaagggaagggaggaaugaacugaaugaaaaaggggaaaauagaaguaaccuagguggguuuuguuuauguuccuuuguuaaauuacuguuguucuaguggugacugggagccaauuacaggguuugggggagauaagaaagugauucuggagagaagaguaaauccaauuugagcagcagcauguguaacugcugagaagggaagcagugcuccaaguuaaugaggaagauugauguaccacuguuuaaauagaccuaacuguuaaauagaccuauuauuugugucaaaauagaacuguauuuuaaaaauugaaaugucuucauguaugaagggaaaaguauuuuuuguacuauuaaacuuugcuuggguucugguagauuuauugcaaauucucuuucucuaggguuuggauucaggauuuguuccuaguguccaagauuuugauaagaaacuuacagaagcugaugcuuaccuacaaaucuugauugaacaauuaaagguauggcauuaguuuguauauuaaauuuauauaaauagaaaauguuacugagcuugauuuuugaguaaaaacaguuacuugauguuaauuuacagcccucaugugguucuucagcaguuuuuaaagcagacuuaaaagaucuagcugacuuauucaaaggucuuuaucucuaauuauauugguaaauagcauauuuacauaaugcuuuuuuggucauuaagaaaaaaaagguaaauauguaggcauaauuagaaaaaaauaaggcaagauuugguucauauucuguuuaaaauuuccaugaaacuguguuuuaguggcucaauuucuuuuuuuguuuguuuguuuuuugagacagagucucacucugucacccaggcuggagugcaguggcacgaucucagcucacugcaaccuccgccucccggguucaagcaauuguucuucugccucagccuccuaaguagcugggauuacagaggugcccguauuuuuaguagagacgggguuucgccauauuggccaggcuggucucgaacuccugaccuugugauccgccugccucggccucccaaaaugcugggauuacaggugugagucaccgugcccugccuaguggcucaauuucuaacacuuuuuuaauuugagggagauggaauauggggaggugauuucucuaccucuuuuaucauuacugaaaugaauugucuccuucaguuccuacuuaaaauuaauuaaaagcagaggugcugggaaaaggacuguugauaaacuuggaaaacaaagcagaaaaaaaacuucaaguuugaauucauaguuuaauuuuuuaaaagucaucuguuuucuuuugcuuauaauucuuccagagugauugaucuugaccaguuaaaaugauuucauacaauagaauuugacuuugauugagugcucgaaaaaaaauacauguugucuugaaaauaacauauaaaucaucccuggacaaaauguguuuaagaacaaauguuuguuuuucuguguuuagugaauguacaucguauaguaaaguggcuugauacuauaaccauuuuuuaaaaucuuguagcuuuuugaugacaagcuucaaaacugcaaagaagaugaacagagaaagguaacuuccauaaccgugcuuuugacguuaaaaauuuuaaauucagccuuuuggagaacacuaaguaucuuaguguguuuuuacuuacuauaauaauauuauugaccuaguguaauauuacugccauauggaccucaaggguacuuuucugauaaauuucuguuaugguuucauaauuaaacaaaaggauaauauacagaguuguggaguuuuuuugguuuuguuuuguuuugagauagucuugcucuguugcccaggcuggagugcauuggcacgaucucagcucacugcaaccuccacccucuggguuaaaaugauucuccugucucagccucccaaguagcugggauuacaggcaugugccacaccuggccaauuuuuguauuuuuaguagagacaggguuucaccauguuggccaggcugguuucgaacuccugaccucaggugauccacccaccuugaccucccaaagugcugggauuacaggugugagccaccacacccagcccagaguuuuaauauaauaccuuuucuguaucauauuccuaggaguaaguuauuuccuuuucauguaucauauguugaagguagaaaguugguuacauauggucacuucagauaccaauaaaccaaccagcaagaauguucagaauaaauaaaaagccauauaugaagaaacaaaucaaauacugcuuuaauuaugguucugcuauugucccccacuugcauuucugacagcuacuuuguaguuugcauauugucuuuuuucuaauuaacauuuuuccucuccuuggcuuuuuuuuuuuuuuuuuuuuuuuugcucuucuguugacuguauagccuugcguuuggcucuuuuauaccuguuaauaguaacucauguuauaacucaccuuucauuuuuaguuuugggauuuagucccaugucguuuuaaaacaacuuaggaaagauaaaugugauuuuaaaauaagugaaauucguagaaaagccaaaacuugcuuucagguaaggaauaagaauuuuuuguuguuguuuuuuguuuuguuuugagauggaaucuugcucugucgcccaggcuggagugcaguggcgugaucucggcucacugcaagcucugccucccagguucacgccauucuccugccucagccucccaaguaggugggacuacaggugccugccaccacgcccagcuaauuuuuuguauuuuuaguagaggugggguuucaccauguuagccaggauggucucgaucuccugaccucaugauccgcccaccucggccucccaaagugcugggauuaccggcucaagccaccgugcccagccaggaauaagaauguuuuauauuauucuuacaaaccuuaaauugaaucacgugaauuuuauuaaagagaacauauaauucauaaaagucuggaauuuuuauacaaauaauugauuuagauaaaaaacaaaauacaacaaaaaguacucccuucccaacuugcuuguacucacuuagaaugaguacauuuugguaaaauucuuuaaaugacuagccaguaaaaaauaaccguccuucuuugugcuucugauuauuucuguuuaaacuuauuauuuuucacagaaaauugaaacucucaaagagacaacaaauguaaguuauauguuugauacauucugacuuugcauuagaaaauguuuuaaaaaguuauuucuauuuuaagcugccacuauugaugacagcaauugagauguuaguuuuuaugaauauuauacaggggugcuuaagcauuguauuuuuuuuuaaaggaauuuaaaauaauacuaauagaauaagccccuuaaucgaaauugacuucauguaccauuuaccuguuucuggucucguuugaaaucuugauaaaaggugucuuccacgcacaguggauauguuauuucauauuuuaaaaaaaauaauuaauuucuuugauucuuaaggcagggucuuacuauguuguccaggucucaacuccugggcucaagcgauccuccugccucagccuucaaaaguggugggauuggccgggcgcgguggcucacaccuguaaucccagcacuuugggaggccgaggugggcggaucaccugagguugggaguuccagaccagacugaccaacauggauaaaccccaucucuacuaaaaauacaaaauuauccaggcgugguggcuuaugccuguaauccuagcuacucuggaggcugagacaggagaaucgcuugaacuggggaggcagaaguugcagugaguugagaucgugccauugcacuccagccugggcaacaagagcgaaacugugucucaaaaaaaaaaaaagugaugggauuauaggcaugagccacugcagcuggcuucuuucuuauuaaaauauauuauaauucaaguuuucugauauaguggacuucugacauuauauaaugggcuacuuaugagauguguaccuugcucaaaauuuuaaaacagguaaaauaauaauuugauucaccaguguuuugacaggauccuuuauucuccauacuuccaucaaagucuuuuuauuuuuuuuuaagaaacagggucuugcugugucauccaggcuggaguacaauggugcagucauagcucacugcagcuucgaacuccugggcucagacaauccuccugcuucagccauuugaguagcuagggcuauaggcacacgcuaccacacacagcuaauuuuuauuuuaauuuuuuauagagaugggauucugcuauguugccuaggcuggucuccuagccucaagcgauccuccuuccuuggccuaccaaagcagugggauuacaggugugaaucaccauacccagccuaucagugucuuagguagauuucuuaggguugcuugcuguugauguaagaauucguaaguuaaucagauucguaugucuuucuguuugaaguguugaaaaaccauuuagagccaagcacgguggcaugugcauguagugccagcuacucgggaggcugagacggggaucgcuugagccucugaguuugaggcugcagugugcuauaauugugccugugaauagccacugcaauccagcgugaucagcauagugagaccuugucucuuaaaaaaaaaaaaaaagaaaaaaaaauuagauauuauuuaguauaaauuaacaauuuguggcauucguuaaaauucauagaacugcuaaugaauaacuucauuuggcauuaucagcauacuagaacccacuagauccaaagaggauauuucuuguguaguauagacuuaaacucuauacaucugaacugauuuuuauauuuuaagcuuuaacauuauauauccauuuauuugagccaagauccuaaaaucaguguuuuguuuuuauagagcaugguagaaucaauuaaacacugcauuguguugcugcagauugccaaaguaaguaaauuuuacuuucaauuaccuuuguguauggaguucaaaaauuauaauggcguuuuucuuuaauagcaaaaaaacucagaucugaaacauaguaccuuucuacauuaaacuguauugugagcuuauucuauggaacaacuguuguguuuggcuauuaucuuagcuacuguuucugguaaugucauuucugguagcugggaaggaggggagcauguuugaaugacucaucccuuccuuccauuuuauccauuaucacugcuuagaacagggacauauuuuacaaaaccuuccacaaaaaaaguuuuucuuagaaaauagagaaguaaguucugacaguuauuguccauaaugaagaauauaauagagauauauuuuuuaaauuuuuacggauuuuuuucugguagugaacuacguuaguggauuuuaauuauucuuccuuauucaugaaacaaaauauauuuugaauuauuguggguuaaaaauuucauauauguugucucuuuuucugaaaaauuuugguguauucaaccuaaauauauauuuuauugccugagaguuucugaaauaagaauauuauuguuugagaauaggaauuuuuaaaacuauuucuaccucacuacaccccuuuauuuccagcaaguggcuagcaaggggugggugaccagcuccacagcccaguugagaaauguuguuugaaugaguuuauaauuacucaucucuuuuacuucuucaguugcauauguuuguuugccaaaucauagagacuuuuaaccuacuguuguuaaugacacaauagcauaggacaguccauuugcauuuggauaguaaggauauuuagcuuauaaauuaaauggggcaaugucauuuucuuuugaggccugauuuaaaauauauuuuuuauuuuuugagacagucucgcucuguugcccaggcuggagugcaguggcacaaucucagcucacugcaaccucugccuccugggugcaacugauucucgugccucagccuccugaguagcgagguuacaggcaugcaccaccacgccuggcuaauucuuauauuuuuaguagagauggggguuucaccauguuacccaggcuggucugaacuccuggccucccaaagugcugggauuacaggcgugagcuaccaaacccagcccaauguauuauacuuaaagugucagaacuuagggcuuauguucuguuucuagauguuagugauaucuagauuuccuauguaugugucuaaauuuuucauuuccuguuguagaucauaguauauuccaaagccaagcagaaggaaagauaggauuggaggcacaaaagagauaaaguuuuuauuuuaguuuuucuuggcucuggaauuacauaggugaguagaagcaccuauaguuauccaaaagcuuaccuacagauaaccaguaaaccacaccaugcccuguuugagugacuagguauuuuagggaauacauacugccuucuauugaagauuggggaagcagaggagcugauacaguguuuaagccaguuugggugaucucugaaaaucauucaggacuuuagauaguuguacaguaggucagccuagccuauuucaguagcucacuguuuagccacucaucgagaacauuuuuaguguaauuuguacuugcuaccugucuguguuagcccagcuuaauaaaacuacguuuuaggguucuucgcaauggauaacuuggaucacguaaaugaaauuuggccuuuuauuuauuccagaaggaaguuuuauuguuguuaagucuucuuauguacaaauacaauccucaauuauauuuguacuguauauggacucuguaucuuuaaacuuaauuuaaauguaaaugagaccgugucacuugccugcucaaauaccccugauguuuuccaucucauuuggaaugaaauagaaacuacuuacguucacugcccucuuaccugucuccuacccuugcuuggucacaccauuccaguaacauuggcucauuucuuuuucucaggcaagacaagcuuccccccuccacccccgcccccggcuuuagggauuuuuacuugcuguucccuccacguggagggcauuuaccacagauugccacuaggcucacucucucacuuuauucauauuucugccacaaggaacaucuuuggaaagacuuuuccugacuccuguaucuaaaauagccuauaccucccacugguuucuuuuucuucguggccucguaucacuagucaaguuuacacgauauauuuguuuguuuaucucuuuauugacugucuacccuagaguacaaucuuggugaggaauuugcucgucuuaccacuuguauuagucugcaugggcugccauaacaaaauaccauagacuggguggcuuaaagaacagaaguuuauuuucucaccguucuggaagccagaaguccaagaucaacauucuggccuguucaguuucugaugaggguccuucucuuggccuguagauagccaugucuucacauagucuuuccuuggugaguaugcacagagagagggagcgugcacgugugagauagcaagcuguuugguuucucuucuuacaaggacacuaaucuuauugaaucagggccccacccuuaugaucccauuuaaccuuaguuacuucuguagaggucucaucuccaaauauagccaccuuugggguuagggcuucaacacaggaauuuggggagggacacaaacauucaguccauaaccccauuguauccucagugccuacaguugcuuaccauauaggaggugccugauaaauaacugaauuacugagugauuuuucuaaugcauuacuuuuaaugguugcaugguuuaguauuuucacuauauguaugauuuuuuuuacuuagccaccucucugaugugcugugaugaccaucccuauaaacuaaucuuuagguaaauuuaaucaguuaaucuaugauuaagauaaaagauuuuaaaauaauaacaacagucaacuuugcauagucuuaaagagcguggauuauggcccccagacugaguuugaauccaagccccaccacuggagcaaguuuauuuauccuuucugugcuuugguuuauauuccauauacaagagggauaauaguaaugucugucucuuacugaugcugugagacuaaaugauuauuugugaugcucuugguagcuggcauguaauaagcucuaaauaaguguuuauuaaauuuaaaaaaagaaggaugcaaauuuuaaagugacaguaacacaucugguaaaaguuggagaacuuccauugaguacugauggaaauauaaauuguuauagccacuuuggcagacucuuauucacuggcagguuaauaaaauaccagaaucaacuacuuugagggagauaaugccauuugagaccccacagugauaugagaagauagcuaauuugauaccuuucuuguuuggggcugauuaguaucagcuucuuagaggcggcaugcuguaaguaaaaauuuuaauuuuaagcuccuuccaguuuugauucuuugauuugaauuccuauucccaguagauucucuccugccuaaaugauuaguguauugguuccuaaacuuuacugcauauuggagucauuuggaaaucaguucugauuccuggcucccaucccuagacauuguguuauaauucuguugugugggguaucaccuggguauugggauuauuuuaaacccccugggugguuuuaaugugcaacaaaguuuugagaccaccugguuaguggaauuuucaagugggcuuuguuaucucagaagacaucccuccccuuacccuugguggagacagcugauguucuucuccugggagacugcaguggagcuggggaguaaggggagagaaggggaguagggcaggacagagugaagauaagcuaggaggccccugcagguggagacuuaaccaguaucacagucaggugaugugaccacauaccacaacucagaaugccugucagaauggcaugugccaggggguugacugugauuuacuagaacacuauuuuugcauuguuuaauuaucacugaaauugggaaaaaggcuaugcuagacaugcuuugguuuugagguauaguugcuacaaacuuaaacucugguugauuuucaccaguuaaaucaugcgguaaaacaguauuucaauacaauuaaaaucaggcacuuuaaauggucauucuuacaggcaaagauagagacuauuaacauuuuucaagguagacacagaucaauuugauuuauguaguuuuuauagucuugcauaaaauagaugcaaauaaauacuguugauuacuuagaauuugaggcuuuaauuuugucaguuccuguugauuauccuaagucuagaccagugcuauacaauaaaaauaugagagcuauaaauguauuuuaaaauuuucuuauaacauuucgaaagguaaaaagaaacaagugagauuaauuuuaauaauguauguuaguaacccaguguaccaaaaauauuauuucaacauguaaucaguauaaaaauuuacuaaugagauaguucauauucucccucucucuucuuucuuacucucucucucauuuuuuaagagauagugucuugcucugucacucagacuggagugcagugucacaaucauaaauaacucacugcaacgucaaacuccuggguucaagcaauccuccugccucagccaccugaguagcugggacuacagguacucaccacugugccugacuaauuuuuaaauuuuuuguagagacagggucuugcuuuguugcuuagacuggucucaaacucuuggcuucaagugauucuccguccucggccuuccaaaaugcuggcauuacaggcaugacucuuucucuuuuugcaccaagucuucaaagucauggauguucuuuaagccacccagucuaugguauuuuguuauggcagcccaagcagauuaauacaagugguaagaugagcaaaguccucaccaagauuguacucuaggguagacggccaauaaagagauaaauaaacaaaugguuuauuucaaugguuuuuguuauauuuacaaaauuguacagccaucaccauaaucuaauuuuagcauacuucuaucaccgcaaaaagaaacccuauaccuauuaagcaaauauuuucuauauagauuuucuauauagauggucccugacuuaauaaugguuuuacuuaggauucuuugacuucaugauggcagaaaaguaauaugcguucaauagaaacuguacuuugaauuuugaguuuugguuuuuucccaggcuacugguaaugcuauaugaucuucucucacuauacugggcaguggcagcaagccacagcugccaguucgccacgcgaucacaaggguagccagcugaaacucugcacuguguacuguguugcgagaugguuuuugcccaacuguaggcuaauguaaguguucuacaacacguuuaagguagguuaggauaagcuaugcuguuugguagguuagaugaauuaaaugcaucuuugacuuaacaauauuuucaacuuaagauggguuuauugggagguaaacuccauuguaaguugaggagcgucagugccucccuuucucuuccaacagccuccuacucuucaccccauccagcccuuggcaacuauuaaucuacuuucucucucuagauuugucuauucuugacucuucauguaaguugaaucuuacaauauguggucuuuugugacuagcuucuuucacuuaacaucauguuuucaaagguucauccauguagagaucacuuuugccuggaauuuugaaugugacuacaguucuacaggauauuuccacgaugaacuuaguuaaaucccuauauagaaaaauaauugccaugcuguugguguugauuguuguguagccagaguuagaauuguguuuggcuaagaauguacacauggaauuaaaaucuuaguggaggcagauaaaucauguucuaacauuauuacuuaccuaguaaauaagcuuucuuguaggagaaauacacaaggaguuacuuacauguaagaaugaaguuaauauuuuuaacauuuuuccuuaaggaccagaguaaugcggagaagcacgcagauggaaugauaguaaguuuaauguaaucuuuuuguuucccuuuacuucugcagagcauuauaaccagucauaucaggagaagccugaauuacuacucauuuuucaaugccaacuacucacugcuuuuuguuguugacucuugcaguuuccuuuaagcucccuucuuucagcaaucauuugcaggggaaaugacaaucuuaaaauuuuucuaaguguggguucagauugaaucacuuugcauguauuaacuugaaggguuaaucaugguaugaauacucagcuuuuacaauuaaauaaugcauaacucagugccacauuucuugucuaauuucuauuuuucucagaugaaagugggggugggggaguacaauauugaaacacaccuuaaucuauuugaauauauuuauagguuccuauuaucuuuuauuuuuaguuuuuguguauguguuaaccaucauuguuaaugugguauguacugcauuuuuguuggaacaauuuacaacaugaauucuuucucuuauaaccaucuucucacucuuuccucucucuuaucuuuuuaccuuuccuuuauauucaacuuccccuccaaaaagaaagaagaaaauuguauuguuaguauuucccagauggaaauaaaagaguuugaagguuugugguuugugcuuacccuaguuuuaugguaacugagugaccuuagucuguauuccugaagcaggaggcagcuuuuuuguuuguccuagacuuuacaaaugccagcuugucugagaucuggaaaaacauucuguaaauuuucaaaaacaucuccugauuguacuugaaaggaugagcauguuaucuuuauauuugguuuaaaaauuuuuuuuaaguuaaaucuguguuugcguauuucuuaagaaagcagaaguaaaauaagcauguuuggaauuugaauuaaauauaucagaauuuuugucaguucaaaguaugauccauggugauauaauacaauuguaugauauaaauguaauacaaacugaaauaauaucucuucaugagauacuaucgaagauuguuagccucauaggaaaggacuguauguauugucuagcauuuuauggucuccaaagacuccaaaggaaaaccauguuggcuguuauuuuuaucucuuuucccucaaagccaaauuaguuauauuauguuaaauaaaacaggcaggauuuuauaaaacauaccaaaaacacuugaucauuugcaaugaaaaacaucuagaaaguuuauacucauagaaaauuuaaccuaauagaaaaauaucuuugaaucauuugcccagggacuagagcauauuuuccuuaagaauuuuuauuuugaaaaaauagaggaacuauucauggaauaggccuuagaggcaggcugcuuggguucaaauaaaauagcccugccacucacuaccugugaccuuggcaaauuacuuaaccuuucugagucuuaauuucuuuuccuguaaagaaagcugaaauguucuaccuuagaaguuuguuguaagguacagaacaagcgcauaguauucaaugaauguuagcuauauguacauguauguguaugugcaauacauuguauuacguggguuucauuaaugucaaaacagauuagggcugaguaguauuauuuuugcuucucaaguucugcacauuuauuuuuaaagcaaguuguagaauguaaugugacauauuugagccugaaguuggcugaccaaggacuguggauaaguguagcauaguuauuuuuucuaucaaaaacaauaacaaaaagauugaguacuuuuaauauacauguugucaaaagacaaaauuacaacaaauuuaaucauagaucuaauuggcuuuuauucaagaugcaugaaucggaucagccuccauucuacaaaauagaaugagaggucucacugggcaguggcaaagcaguggguuuuguaaggugagaacuguaacaggaaaaaaugcugauugguuaacaucagauuacuuuucuuuuaaggguuaaaacagugagcauuuccguauuacacugauucggguagacuggaaucuccuauuuucagaaaaaaaaaaaaaaaccuggucuauuuugggauccacuugcuuccuuagaguuuaaugauacggcauuuaacaagagugacuccauuuugguuuggucuaaucuguugggcccuaguacaagagcucaguccaaaacaguggccucucauaauuuuuguuuaacagugcacaaaguuuuuaaguguuuucuuugguugaccagccuaauuguaagaacguuucaucuggaaaauaaaagauuacauccaaaagagaauucuggucccuuguuccaaaguuauuuuauuucuuauucccuucagugggagggguaaggaggugugacauauucucacugcuauauaucaaagcguuaaugguggaauuuugucuuuguaaagcauuuggaguuauuuucgagaaaagcgcuguguaaacaaggaauuuauuuuaagaacaacuccauguuuguugagauacuuguuuaguuauuauggcuuggucuaguaucugaaaauagaaucaaaguaauaaccagaaaacccuuagcacccauguaaauacagacuuuuuauuuugcagaccgggaaacugaggcccauagaggauaagagacuuaaagauucuaagcuauuaaaaacuccaagucucuguuucuuugcuuuucucagugcuucaaaacauuccccacuucaguuucuuaguuguuuuuuuuuuuaauuauuacugauuguuuuggggguguuuucucuaaguguccuucauuuuucaguuaaaguauuuguggcagauaaacuauuuuagugacaagaaucagaauuccuguguucaagucacuugaucgaaaagaccuuauuuaaugaguuuuagauauucaugcagaaagagggcuggguuuuuuugguuuuaaauuuucuuuaacaguccugaacacaguguauguuuguuuuucacauggccuggaaaaaaauuuuuaacuuagauauuacgugagaaugcuacaaaaacuuuaccauuaccucaguuucuauuauuaggugauuuuaaguuuuuacaacugcuuuuuugggcuuauuuauuggcaaaguauuucccuuauauuucuguuuuaguaucuucuguuauaagcacuacuuaauauauaugugaaguucaguuuuccagaucaauuaaagguaaagaacuuacauuuuuauuucuuggguuugcccaguuuagucuucuaaaugguaaauguaaacuuugcuguggcaaagacuuugguuuaacauguacacacucgcaccccccugcugcccuauggaguuuucuuuuuaaaaugccuucaugcugucagaauaauuucuugacuuagaaucagagaauccuagacuuuucuccccucuaaaauuaacuacaugucugaauuuuucucccucucuucugaauccucagaaagcaagcccucuucucuacacuccccaguuagaagaugcaucucuuucucuuuagugaccauaaaacuagacacacagucagccuucugcaucuguggauucaaccaaccauggauucaaaauauuugaggaaaaaaaaaguaccucuuuacugaauauguauauacuguuuuccuugucaugauuuccuaaacaauacaguauaauggugauuuauauaauauuuacauaauauuaggugucauaaguaauuuagagaugauuuaacuuauaugggagcguauguguagguuguaugcaaauacuacacgauauuuuaucagggacuugagugucuguggauuuuggcauccucggggggugcuuggaaccagucccccuggauaccugaggagugacuguacugugugauagcagcaguaugggauggaaagaugagauccuaguggugcagguacaucaguuggacauuugguguaacucaccaaaagugaaaaaaacagagaaacaauauuuguggugaauuaagagauugagaagcaccgaauugaauugagaggugguuuugacuuccugaaaucuccccacaccauuuuauaacuccucaguuuuuccauuuagcuuuaccuucuucugugacagagauucauucauugucuuuccuuacuaugcuuuaagcaacucuuacacuucuguauagaaaagguguuucauucccucuuuucauuuugaucaacauaucuauauagcuacccucaggauuuugaagucauaaaugugggcauuugggaggguagcaugagaagagcauuuaauuaaaaauagcuauauuguguuucuuuauuuuagaguacuauuaaucccguagaugcaauauaucaaccuaguccuuuggaaccugugaucagcacaaugccuucccagacuguguuaccuccagguaauuugggaaaauguuucuuagauucauugaugagaaaaaaauaauuuguguggcugucauagcagucuuagcuauuacuguuuauuuuugauuuuccuuguuuuuaauaaaagcacucaaaaaauaauacagccaaaagugaacugaaaaaagaugauaauguuuugauauuggggcuuuacugaagugugaugaaagugguuuuguuauucaaagugagauagaaaacaaacuugguuacuacgauuuggauucacugguagaacaggauucuaugacucagaauucauggcuagcgaggaaaaauuacuauaccuuauucuggauaauccagggauguuccguuuugggguauucuguguagcucugaacaauacaaaugguauguucaugguagauuuuaagauaaugagaaagugaagagggaaauuuaugaugccuacugaucacaugacaucuggguuuuguuuuguuuuuuuuuuuuuuguauaaagcaauacaugcaauuuuuuaaaaacuggcaaagaagggcucagggccaauaccuagcuacacugacugauuccuuuugcccuuuuguuauauccaacauuucuauguucucgauggcauagugaagucagaaauuguacuguaaaauggaaaacucuuuuuaaaaguacuaguaaguaugugaaauccuuuugugaguuuuuacuucuuaagugaauuagcuuaaacuaccucuuggggcuaaagaggaacagguacuguacuccacuucagauuuuuugugguuugaggcucagaaacacauuaucaucagaagcauuuguugguuuuacagcauaguuauacugcaguauuggccuacuguggcugguuuuuugauauccugccugguaucuuaguacucuguagccuaucaucauugaguuuaagaggcuaggaagucaaaaggaaggaguagcauggaacuagacuuaaugaaauaaaguuucaaaaauuacuggccuuuaggauuuugaaucccagacaauuacagucaauagaauguguguuuggcuguuucuguaccuuauuuuauacguucaaaucuccuagaaccuguucaguuguguaagucagagcagcguccaucuucccuaccaguuggaccuguguuggcuaccuugggacaucaucagacuccuacaccaaauaguacagguacagauuugcauaauuucuuuaugucucauaacucuauuaacauuugagguuuguuugugaccucugaugaggagggggaaaguugaagaaauguguuguauauuuucuguuggagauauguuaguuuuaacauuauaguuccauacaugaagugguuagcuuuguguuugaaagagaagcuuuaguuaaguuuuauuuauuuuuaaguuuuuaaaauuuuuauuuuugagacagggucucacucugucauucaggcuggagugcagugguacgaucagggcucacuguaguuuugaccucccaggccucaggcucccaaguagcugggaccacaggcacacacaccacacuuggcugauuuuuaauuuuuguagagaggagucucccuauguugcucaggcuggucucaaacucuugggcucaagcagucuuccugccucagccucccagugugcugggauuauacaagcaugaggcaccaugccuggaauaauuuaaauaaaauaaaauauuacagaguuuuguuuguuuguuaccuuaacauuuauuuggugaucuauguugacuuuuugaaaaauuuacuccagcuagacuugcauacuuucuuauuaugaagcugacacagaagugcacagaauaaaaacugcaaguccucuuuacucuccccccaguaauuugcauacauguaugugcauauacacuuaugucguguauuuuuauuguuuuuguuuaaaccuaacuuagguuauguguuucugugacuugcguuuuuccuuuaacaaagaacacuuagagcacuuuccauguuuguaaaauuaggucuacagcauucuuuuuacagcugccugggcagguauugcuuguuuuuuccacugauggaagcaauacuucagugauauccuuguacagcaccuuuggcauauguauauuuuuuuagaaaacauuuaucagucuuucaccuuuuugccaguuuuauaguuagaaaaaagauacuucauuuuaauuugcauuuucuuuuuguuuguuuaaacguuuuguuuuuuguuuuugagauggagucucacucuguugcccaggcuggaguccaguggcacugucucgacucacugcacccuccacuuccuggguugaggugauucuccugccucagccuccugaguagcugggauuaaagaugugcgccaccacgccccacaaauuuuuguauuuuuaguagagacggcauuucacuauguuggccaggcuggucucgagcuucugaccucaggugaucuguccaccuccaccucccaaagugcugggauuacaggugugagccaccgcgcccagccugcauuuucuuaauucguuuaggcuuagggucuuuauuuuuucucuguuuuacagggauacuaucaguguuagauacuagauuuaucuuguuuuaaaauuaauuaaauguauguugaauaacuuguagaaccaaacucaaggaagcaucuagcacuuuucacacuguuaaaccuggaaaccaaaaccaaaaccacucuugaagaagugggagaucagccccuuuuguucauccucagauuuuuuucccggguaggauuuuuccuguguaaugaugaauaauuacccugugauuuaaaaaauucgaauuaguaaaaguacugaugcuauuacuuugaucuuuacuauuuaacagcaugggcaguugccuuugaauuuugaaagaaaaaaaauagcucucuuacuugaagcucuugggaaaaggcugauaagcaauuugaauaaugaaauugaaauauuuuggcugacuucuguauuuccugagcugugucaccucuucuucauuuaaaaaauaguaccuguuuguuguuguucguauuuuuauguuggaauuuugaaacaaccaaaauuccaaaauuuuucuguuuggaaauacguaaaacuagcaacagacuuugagaaagugagaagcucuucuuauguauauuaauuuuuguaaaaauuacuuccagaagauaaucuucugaaaacuauuucaguugaagguauuucaaaaaucuaacacuuuagaguagauuuaaagaaaaauuuaaaauuaaauuccugugauuuauaucuuauuugauuuuucauccuaacuucauuuucuccacuuuucuuucccuuacuucucuuguuaauacaaaaaagaaauaaaggaauaagauaaaauguuugcucuccuaaguaaaucucagaucuuuuguuugcaguucccacucaaacuuuucuucuuagauacaguuucacuugugugaucaccuggaauauuugcaugcuacuuaaucauuugcaauucuugaucaauuuuuuuuuuauuccaauaagaaaaagcugcuuuucucucuuacuuuuucuguuggguaauaaaaagaauaugaaguuauuuacuaauaaggugagcuaccuuuggaauuuccaaaauaagcauuaccuuuuagggguuaaacuuuuuguguuaucuuuuuaaaauaccuuugugaauaugaugacuaaauguggcaaacugaugugcuuuuuuucacaacuauugaaccauacauauaggaaugggcaaaaaauccguaagugacucuggauucuuuuuuuuuuuuuuuugagacaaggucucacucuguuuacccaggcuguaaugcaauggcacaaacacaacucacugcagccucgaccuccucagauuaagugauccugccccagccugucguguagcugagaccacaggcacaugccaccaugcccagcuaauuuauuuaucuauuuuuuuaagagauggggcucucacuuuguugcacaggcuggucuugaacuccuggccucaagcaguccucccaacugguccucccaaagugcuggaauuacaggcaugagccauugugccuagccuggauucauuuuuauugcugucuucaauuucuuccagaacuguggcccuggcuuucagauugccaucagugucuuaauaaacuuuagucuucaccagacaucuguagauuaguauaaauugccugacugacagcccuuaaaugcucaguaaguuaaauugaucuuaauacuccauuugucgauugguuugauacuuuuuuguucuugcuuuacuaguagauaagguaccagaugaucaucucagagauuagauggcaggcuucuuugucugggucuucauuaauuuccauuucuuuaguuagacuauuuaggaauagaaaaauguucuucugaaucuuuucauuuucugcauucuucucaucguaguccucuauuuuuaucuccaccucugagccccugacuuagguggaaaagaggagaggaauuuggaugguguguguauuuuccaugugauugccaaaaaauauugaaugauaggaaugugauauccugcaauauuuuaauguuuauguggucuuaauauucuuuucauuuugcauucccaguggcucacugcugcauuuuuagguaucuggaucugcaguguaaaauaagagucccggcaucccauuguaaucauaucuguuguuggacuugcaacuccacaacucauauaaucaaaagggcccccuuccuaguauuaaugauaaucuuuaauuauagaaugaggacauagcuuuuuguuucauuuauuuaaaaggcuguguccucauuuuauaucaugauuugccauuuucuguguggaguuuaaauguugauuuucuuuauaaauacuguagcgacuuuuacaaacuuaaccaaacucuuuuuugauuuuagaaaagucugcuuugacuccaucucccuaguuucuucucuuucaccaauauuuuucucuaaaacccuuuuaacuuccuaggcaguggccauucaccaccgaguagcagucucacuucuccaagccacgugaacuugucuccaaauacagucccagaguucucuuacuccagcagugaagaugaauuuuaugaugcugaugaauuccaucaaaguggcucauccccaaagcgcuuaauagagugaguagaugaacagaauauguauuuaaaugauucuccugauuuuuaaaaaucuaauuugauuuugagacuaguguuaaugacagacuugccucaucaguuauuauuugggaaaauuaaaagggcaaccuuuuuaauagaaguuuuuuuauugauguauaauaguuguauggacaacuuguuuuugguuggcuuauugagcaaagccaguucugugagaguuuugauuuuaguccuaaguuaauccaaguggaauaaauagcaucaccuauaguaaugugccagcguuauuaguugaacccuggccguuucuacaguaccaacauuaggagaggguccaaugagagugaauaagcuaugaagcauuauacaaauaagagguuucuauuacuuuuuucuuuuuuuaauuagaguggaaauauucaacaccuaucagccaggcacugugcuagguugauaucaagguuacaaagauccaggcccugcccacagggaacuuuugggggaauaggcagacauuuauaaucuaaugaaauacgugguaugguaucuuagucccuuuaagcugccauaacaaaauacaguaaucuagguagcuuauaaacaacagaaauuuauuuccuacaguguuauggagcaaaaggggcuugcugcccaaugugcuagaagccauuacuaagucccagguuuuugaggaaagaaaagcuuuuuauugcaagucuacuuacagggaaauggaaguccaccucaaaucugucucucugcacuggcuuuaaggcacuaauuuuauuuaaaaacguuuagggaggccaagugugguggcucacgccuguaaucccagcacuuugggaggcugaggcuggcagaucaugaggucaggaguucgagaccagccugaccaacauggugaaaccaucucuacuaaaaauaccaaaaaaaaaaaaaaauuagccaggcauggugguacaugccuauaaauuccagcuacucaggaggcugaggcaggagaaucacuugaaccugggaggcggagguugcagugagcugagaucacaccacugcacucuagccugggcaacagagcaagacucuguuuccaaacaaacaacaacaacaaaaacaguuuagggagccaggugugguggcuuaugccccuaaucucagcaaucugggaggcugaggugggaggaucaguugagcccaggaguuugagaccagcuugggcaacaugguaaaacccugucucuaaaaaaauacaaaaauuagcugagugugguggcacacgccugucguccuagcuacucgggaggcuaagaugggagaaucucuugaacacaggagguguagguugcagugagccgagauugggcugcuguacuccagccugggugacaagagugagacucugucuuaaaaaaaaaaaaaaaagaaguagaauuacugauuuacuuucauuuuacuuguguuuguuguagauguauuaauagcuuaguuuuuguugggaauuacuucuaauucugcuuucucaggggacuguuacuauacuguuacuauagcuaggguuuuugcuuuuuaacacaguacaaauuuggaaauaauuaaauguaaauuugcaagccaauuaccuucagccaguccuauguggucuaggugaauauauauaguuaagacguggaagggagguuuaaaucuacaacuaaagaaggccaguguagcagaaagggcuuaguuuagcauauugguuucuuuuuuucauuuugaauguuaaaacauaaacuauugagaaaccauuguuagcaguuugccaauagaaauuuaauuuuggaaaaaaaguuuuuauaauaaugggguuaaaagaaaauaagcauuuggaagaaaauucgaaaaugaaagguuauuauuaauuuuugaaggguucagucauuauuuuauuuaaaagagaauuaaagaccgucuuuuuuuuuuuuuuuuuuuuuuuuuuugagacacagucuuugucgcccaggcuggagugcaguggcgccaucuuggcucacugcaagcuccgccucccggguucacgccauuuuccugccucagccucccgaguagcugggacuacaggcgcccgccaccacgccuggcuaguuuuuuguauuuuuaguagagacgggguuucaccguguuagccaggauggucucgaucuccugaccucaugaucagcccgccucggccucccaaagugcugggauuacaggcaugagccaccgcgcccagccuuuuuugagacggaguuuugcucuuguugcccaggcuggagugcaauggugcaaucucggccuccuggguucaagcaauucuccugccucagccuccugaauagcugggauuacaggugcccaccaccaugcccagcuaauuuuuguacuuuuaguagaggagggguuuugccauguuggccaggcuggugucgaacuccugaccucaggcuguccgccugccucggccucccaaagugcugggaucacaggcaugagccacugcaccuggccuaaagacaauacauuagcuauuguucuaaaaaagugcaauugaaugucacuugcuaguaaaucacucauguauccauccuuuaaaagcauaugacuguauucaguaaaagcuugauaauaugugguuagcucuugguaacaucacugauagacacucucuggcuccguuuugagggauucucccaaaauuucuaugaaaucgaaacauuuaaaacaccuguuguaccuguaauaggcaggucuacaaagucaugcacaggcucaugggcuucuucuauuccugcuguuaagguuccuucuaugcucucccaguacccugucccauaauaaacacacaguucaugaacaucucuuugaaaggguccagaguuaaguuuuuauguccaacuaacccacucuguguuccuuuucucccucaauuucacucuuccuuguuuguauauucuaaucuagaagcccaaaccaguaaggacugcagauguuuuauuugggcagcacaguguucuguugacuuguuuuuuguuuuguuuuaacaaggcuuuagauucuuucagguuggguaugcugacuccccaguuccauauauaucuuaugucuugguccuauccacauauucucugccuggcaucuguagcuauuugagcuugugacaccugcuggucaucagcugcuacugcugauuuucuaacugaggucaaauuucuuuuuacuauuuuuuguuuuucucuuucugaaggaagagaacuugaaagcuuaaguccuuucacuguucuuuuucuaaagaccuauacuaaugauagcuucuguguaacuauggcacugagcacuguaguuuacacauuuauaaauuagauaaaaguacauguuggaaagaacuuguacuuuggagccagacguguuugaaauggcuccacuacucaccagcuguaugacuucagaccagucauugaaccuccgagcgucuguguauuaugagcgucauuguguuuuccuuaggguuguaauguagauauagacauaccguguauggugcauacaagguacucgauaaauuauuauuauaauucauagcuuuaaauuguuuuugcauacuuuaugauuuuaugccuaaauucuagacaacuuagcccauugcagauaaaacuuuccuguauacauagguguuguuuuuaacuguuuucuuuauaucauuuguucugaacaagguaaauuaugaaauggcugaaaauuuaucccauuuuuuuucaauuuacagucuuacugaguauuucacuuggcucagacaugguuucuaaucauggguaaggagaaaaaacacagcauaaauaggaccuuugaaauuacaucuaaaauaagauucauauguuauaggauuugggguuuuuaggucaauugauuuaaaagauugacucuauuuugagauacaucacagaggcacaaagcauuuuaaagguaacuuucaugcuuuuuuuugagacagagggucucacucuaucacucaggcuagagugcaguggcacgaacacagcucacuauagccucaaccucaugggcucaagugauccucccaccucagccgccccaguagcuggaaccacaggcacacaccaccaugcccagcuaauuuuuuuuuuuuuuuugagacagaaucucacucugucgcccaaacuggagcuggagugcagaggugcgaugucggcuuauugcaaccuccaccucccagguucaaacgauucucaugucucagucuccaaaguagcugggacuacaggcgcaugccaccacgcucggcuaacuuuuuguauuuuuaguagagauggggcuucaccauguuaaccaggcuggucuugaacuccucaccucaagugaucugcccaccuuggcuuuacaaagugcugggauuacaagccugagccaccaugcccagccuaauuuuuuauuuuuuguagagauggggucucaccauguuacccaggcuagacucaaacuccugggcucaagugauccucuugccuuggccucccaaaguguuggaauuacaggcgugagccaucaugccuggccccaguucugucauuuaaugaucauuugauuucucuuaccuguaucuuuuagacauauuuuccauugccucucaaaacuggugagguggacauuaguuauaauaccuugugauauauacuacuaaauaaucaaagaaguaauacuuaguuacucaagaaauuuugaaaaauagguaaguaaccagggcaaacuagaauaacauaauauauucuaauuuuagaauauccuaauauucuaguguucuaauacaggcagagcccagaggauuuuuacagcagugaaacuauucuguaugauacaaugguggauacauguugucauauauuuaucaaaaccgauagaacaggcaacuccaagagugaacccuaauauaaacuguagacuuugagugauaaugaugugucaauguaggcucauugguuguaagaaauauaccucucugguaugggauguugaucaugagggagguuugcagguguggagacagggaauguaugcaugcugucuauauuuucuguucaguuuugccaugaaccuaaaacugcucuaaaaauaaaguuuauuaauuuaaaaaaauuaaaagaaguuaaguaacaagggcaaauuaugauuagauuagaauacauguuuucgcacguguagaguuguaauaagacucauguguacuguuuuauaaauaucuaaagcgugagaaauuugauuucaauuuuuacauuuaauaaguaaauugugugccuuuuuuauuuuuccuuuauuuauauacaaauaccaacugggugugguggcucacaccuguaaacccagugacuuggguggcugaggugggaggaucacuugaggccaggaguucgaguccauccugggcaacauaaggagaccuugucucuuaagaaaaauauaaauauacgugcgugugcgcgcacacacacacacuuccaucgguaaauuaugaucacagguaugauaaucuauuaauaauagaauaaucuuucuuuagaccuguuaacuggcucauaaaagccaguuagcaugaauuuacuugcauaaauaagauguuuuuuuauuuuauaauuucaaguacaguuuuuuaaugauuaggaagaguguuaauaccaaugugggcuuuuauuaaaggaucucaaacauaaagacaagacauguuucugagacuugccguuucuggaauuguugccaagaauugugacauauuuagauuuauacccaguaacaaaaucauaaaaggaacucuaguuuuaaacuuaaaugcagaggcaaagaucucacuaauuuuugaugacuucuaggucuugacuaucaacauggcuuuguugagcacauccugugcauaaaggauaagacaagagaccuugucaucaagagaauucuaaagcauauauaugcaugcauguaaccagcuaacuguacgagucuagcuuacuaugauucuaaauugcuuucuuuagcuuaaauaagguaauuaauguuuuuauaguucuucuggaucugccucaguccugacacacagcagcucgggaaauagucuaaaacgcccagauaccacagaaucacuuaauucuuccuuguccaauggaacaagugaugcugguaagugaccuuugauaauuuaacuuuuuuuucuuuaaaaauauuuguggccagaugugguggcucaugccguaaucccagcacuuugggagaccgaggugggcagaucacuugagguccggaguucaagaccagccugaccaacauggugaaaccccaucucuacuaaaaaaauacaaaaaauuagcugggcaugguggugcgugccuguaaucccagcugccaaggaggcugauucaggagaauugcuugaaccuggaagauggagguuuacagugagccaagaucgugccauugcacuccagccugggcgaaagaaugagacuccaucucaaacaaacaaacaaacaaaauuguaauucuaguaucaggacagauuggcccaauuuagcaccauucuaauaagaucugcuuuauuuuagaccuguuugauucacaugaugacagagaugaugaugcggaggcagggucuguggaggagcacaagagcguuaucaugcaucucuugucgcagguuagacuuggaauggaucuuacuaagguaagaccaaauuugcuguaagucuguguggguauguauggauucucagugauugcguggugagugugccugcaaauguaguaaaaugacauaauuucuuuuuauaccugugucuucuugugauuuaauauagauguagauaaguaaacaaaauuuuauaaaugaugaaauaagucaagcuaggauaauuucauagagaacaguguguaugaguuguauggauuaagauuugguagaguucuaaucuuagggucagaggaucuguguuuucguccuaccucuaauauuagcaaaccacgcacggucuucagugaguuucuucuguuucuuccucuguggacuucaggguucucuaugcaaauuggacacauaguaaccuguuucagaggguuauuguaaggauuggaagagguaguaaauguaaaauugugacauauuugugaccucugucucccagguucaagcgauucuccugccucagccuccuugguagcugggacuacaggcacgcaaaaugacacauauugagucaugcaaaauuaccauagucuggauuugaauuugaauuuaaacuuggagcucucaacagaaugcaugcuugaauuaggagacugguguaugggugccuuuguauauuccugccacugugcuagaaaacccccuccuuucacuuaauucucaccacaguaccacagaguagguguuauuaacuucauuucaucaggaaacuaaaacucagaaguuaaguaauguggcugagucguguuaagucauauuaaguggcagacugagauucuaaucugcuccaugauuuuaaaaccuguaaucuuuccacuacugccuuugucuugaaggcuugaacuguauuaacuuucauauugauuauuguucugccgagcuuuggggaguugauuaaauuuagaguucucacuuuuguuagggcaaaaucaauuccaguguuauagucuuugucaguagugaacuccuuuuuguuuuggauuuagagggccauuaagaaaaagacuaauucauaauaccuucaaguaagugucuguaauaaaaccuuuuaccccuaaucuaagugagaacagagacacaaggacaacuuuuauuuguggagcccaacacacuuacuaggaauguucuagguaggagaacauuugcaggaguuuguccccggaauugcuucaguaaucauuagauuguacagcugcuggcguuguuguuguuguuguuguuguuguuguuguuguuguuaggaaggacguuguuuuccaggaguggcucauuaggcuuccuguugaaucucauuggccaguaucaggcauaugcucgugccuaaaccugccacuggcaagggggaggcuaaaugauugguuuaaaugaauccacauucaccccuugagacguggaagagaaggccauggcagcccacagcugaaccugaacugaaucagaguucuugggggugaagcauggauggggagaggcaaccagauguauuugccacaaucaaguuuguaauucuugccucacauaauuuucucugccaaauaaaccauauuugaguccauagcugcuaaaagcuuguuauauuauaaaugauauuaucauaauuauuuuuuacugaauguguuuaaaauaagucauuuuugaaauuuuuauuggcacaaauggcugugauugccaacagauucugaaaucuugguuccuuuuaugcauuccaaaguauuguuacaauaaugccuuaaauuugugucuuuuauaagaauguuuucucacuucagauacuuuccaaaaagaguuuguuuuccaaauacuuuguaguuuuuaaaaauacuacacagucacaucccauuuaaccucacucagucuuuaaaauaaaagaacccuaacauauaagcagggcauguaauuaucuuccuuuucagguacuuagagaaauugaguuaauuuuucagggccuccucacagcuaagaagaggcuaaacaagcucuugaacccagguugaagacagcuaaacccagcucucuucaucacuguuacagcaguuugacuuaauagcauguaucaguauagcacuacaaacauugaagaaaaucuguuaaauaagaguucucagaaaaauccuaaguagaagaaaaaaauauuuauuuuuuuuaaauuacgugugaaauuaaacuuuuuaaaaauguuuuuuggcuguucaguuccuuuguccauuuaucuacuggaguagugaucuucaucuugaguuguaagagcuguuuauacauuaaagguauuuauccauguuuucuucuucagcauuuuuacucggugguuuauaauucugcguuaucuaaagugguaagaaguuguaccaaggcaguauauaagcuucccugcuaaucuaacccuauuuggauuaugaauuuacauguucuguggaagaaaaauguuuaccuaaaauuuaaaugcugagagucugauaauagagauucuaaguguuacagucuuagugucccuuuccaagcuuguguucaucagcccacuuuauauuuucauuauauguccagccacacugguucacugauuaaucccugucacaccccucuuccuauccuuuccuugucuuuuuuuuuuucucccgucuccaugucuuguucuuuuaucacagccuuacucuucuuuaaggcuuuucucuagugccaccucaauaaauuguuucccagcucugcccucauucuguucccccaaacagagcaugaucuuuccuugaacugaacuuccagggugcuuagagcauucuuguaugauguuugucacauuccaccuacaauuuaaaugcucuuguuauucucucauacuuaccuuugucuccaccauagcuugcuugcauuuauuuauuuauuuauuuauuuagagauggggucuugcucugucacccaggcuggaguauaguggugcaaucuuggcucacggcaaccucugccuccuggguucaagugauucuccugccucagccucucgaguagcugggacuacgggugugcgccaccacacucagguaauuuuuguauuuuuaguagagacgggguuucacuguguuggccaggcuggucucgaacuccugaccucgggugauccacccaccucagccucccaaagugcugggauuauaggcacaagccaguaugcccagccuccaccacagcuuuuaacacaggaccuugaauauaguggauauguaguuauuacuaaauguuaagaaauuuuugcuuacucugggguguucuacuucguaaugaauaauugauaaucugauacucauuucaaaaacucuucucccauucccauucucuaaugaaauucuucucuuuuuuucauugguuaaucaucuuucucaugucuucccguauuccaguuuguugguucccagucuguauucuuuucuucuuuuuguuuauuccuuuaauugcucauuuaaaaguuucuuacuguguaaauaguagugagagcgcgagugugaauaaaacuuaauucuuggauuguaggugcucaucauguauuuccuauacacuugucuaaugaugauagagcaacagcaguagaaagugcacacacgccccaaacucagauccaguuugaauuccacauuaauaaugggacaauuaauagugggacgcugagcuucauauuucuucacuguaauaauuucuucaucauagggcuauuguaauauaauauguauguaauauacaaauaauaaaauaauguauauguaauguccagcagauaggaggcaucaaaggauuccucugagugaguuuguugaguaguuuguuguuguuacuauacuuagggagaaaaaggaaguuucacagaggaagugacauuugaacauucaaaagucuuucucuguuuuugaucugcuaggcagguuaauggucauuucugaaucugacagguugagaauuaguuuuuggagcaugccugggcaauaugugguggauguuaccaugauuugaaugaggugguguuuuguuuuguuuucuuuuuuuuuuuuuuagucuguuuaucugaagagaaauuugaucuucaagggucaaauguguauguuuuucagguaguucuuccaacguuuauucuugaaagaagaucucuuuuagaaauguaugcagacuuuuuugcacauccggaccuguuugugagguauuugacugaacaugguaguuuccaacguuuacagauguuacucagcagcuuucugccuuuuauuuugcaggauagauggauuccuugucaccuuucaaacauuucuggguauucugugguauugaauaauguguuuacacugguugccuguuugcuuaaaguuauaugguggcgauguuaggcaaccaaguuuaacacuuuaaaaaauucucaagagcccguuaauagguagccaauauucacaaggccaaugguauaaguuuauuuaauccaggcacuggcaaucacugucaaauuauuuguacuauauccuaaugaagcuuaauuuucugaguucagcaaaccuuuccaaagcaccuguuguuugcuaggcacuuucuuacaaguuggagaaaggaaaagucaugucugcccuugagcuuacaauauaguauccaaauuauagaugauuuauaaauuuuaaauauaaagcuugcaauauuauauauguguauauguaugagauagaaguaauguaaaggugaaauugauuuacaaggaggugaguucacauugccuuucgcugguagcaggaaauuuuuuuguaauggggaauguuguuaguucgucuucucugcauuccuuagucucagacugugguuuacugaagcuagauacauaucacugaaguuucuugcuggguggauacauuggcugacauugauaaauauauauuuuuuuuuucuugaugaagauuuaaaagaauaaccaauuccccaaaggcagaaauuuaaauaaauauggcaguguuuaaauuaacagauaauuuaagaaguaaaauuuaagcauuuauuaguaacguguaagcaaaaauggaacguaccaguuguucauuggguauagauuugagauuuaaggguaguuuuuaugugugagaauuuaaacuuugaggcccccagaacuauuuacaggccaguugcaguggcucaugccuguaaucccagcacuuugggaggccaaaguagaaggauugcuugaagccaggaguuugagaccagccagggcaacacagcacaacccugucccuacaaaaaaaaauuuuuaauaauaagccaggcuugguggugugcaccuguaguuccagcuacuugggaggcuaaggcaggagggucaugcagucccagcaauuugaggcugggacugugagcuauaaucacaccacugcagcuugggugacagagcaagacccugucuuaaaaaaaauaaaaguacaguucaaaagccaguagauaagauuaaacggaaucauacaaauacuccauuaauucuaagaaaggagaaaaggagaaauaauggcaugaacaaggaacaaagggggcauguagaaaaccuauuaaaaugguagaguuaaucccaacuauaucaacaguuaccacuccauuuaaugucagacuggauuaaaaaagcaggauuuaucuauaugauauuuucaagagagaaacuuuaaagacacugguuaaaaguaaaaggauggaaaaugagauacuaugcaaaacacuaaacauagcaaaaacugguguaucuguauaaguaucaaaggagacuuuuaagacaagaaauauuauuagagacaaauaggaauauuuuguaaugauaaaagcaucuauuuaucaagaauaaauaauacuccuaaauauguauguaccuaauaacacagcuucaaaauacaugcagcaacaaaaauugacuaaaaagagaaauagccaaguccacaaauucauccgucagggucucaugaagcaaguagccucugccuucaccaccuccccgcccccccaaaaaaucaggaaggcuauagaagauuuaaacagcauaucaaaucaacuugacccaguuggccuuucuaaacacuacccaacaauuguauaacacagagucuuuuccaggugcaugugaaauguuuaucaagauagaacauauauagggaagucuuaauaaauuuaaaauaauuggaaucauacaggguguauauucuacacccaugaauuaaauuaguaauugauaacauacagaaaaucuccaauuauuuggcaauuaagcaaugcacuuacauggacuuaaucuaugauacuagaaaccagaagcaguguuugccucagaguaaguaagauguggcgauuguuuggaaagggagauauggaaacuuucuggauuaauggaaauauucuguuuuuugauuaagugacgauuaauuaaauagauauauacguuugucaaauccucaagcaaaacacuaagacccaggcacauagaccaauggaacagaauagagaacccagaaauaaagccaaauacagccaacugaucuuugacaaagcaaacaaaaacauaaagugggaaaaggacacccuucucaacaaauggugcugggauaacuagcaagccacauguagaagaaugaaauuggauccacaucacucaccuuauacaaaaaucaacucaacauauaucagagacuuaaaucuaagaccuaaaaucauaaaaauucuagaagauaacauuggaaaaacuucuggacauuggccuaggcaaagacuuuaugaccaauaauccaaaagugaaugcaacaaagauaaauagauggaacuuagucaaauuaaaaaguuucugcacagcaaaagaaauaacagaguaaacagacaacccagagaguaggagaaaauauucgcaaacuaugcaucuggcaaaggacuaauauccagaaucuacaaggaacucaaacagaucaggaagaaaaaaaaacaaaaacaaaaacaaauaaucccaucaaaaagugggcuaaggacaugaauagacaauuaucaaaagaagauaaugauaauaaaauaaaugguuggccgggcgcgguggcucacaccuguaaucccagcauuuugggaggccaaggcagguggaucacgaggucaggagagugagaccauccuggcuaacacagugaaaccccgucucuacuaaaaauacaaaaaaauuagcugggcgugguggcaggugccuguagucccagcuacuggggaggcugaggcaggagaauggcgugaacccggcagguggagcuugcagugagccaagaucgcgccacugcacuccagccuggacaacagagcgagacuccaucucaaaaagaaaaaaaaaaaaaaggccaacaaacaugaaaaaaugcucaacaucacuaauuaucagggaaaugcaaaucaaaaccacaaugcaauaauaccaccuuacuccugcaagaauggccauauuaaaaaaaaaaaaaauagauguugauguggauaugguggaaagggaacacuuuuacacugcuggugggaauguaaacuaguacaaccacuauggaaaacagaauagagaugccguaaagaacugaaaguagauccaccauuugauucagcagucccacuccuggguauuuacucagaggaaaagaagucauuauaugaaaaagacacaugcacacacauguuuauagcagcacaauuugcaauugcaaaaauggaacuagcccaaaugcccaucaaucaacaagcaaauaaagaaaacguggcauauauauacuguggaaugcuacucagccauaaaaaggaacgaaauaauggcauucacagcaaucuagauggaguuggaaaccauuaugcuaaaugaagagacucaggaaugaaaaaccaagcugguggcaagcaccuguaaucccagcuacucgggaggcugaggcagagaauugcuugaaccugggaggugagguuacagugagccgagaucacgccacugcacuccagccugggugacagagcgagacuccgucucaaaaagaaagaaugauacaguggacuuuggggcuucaaggggaagggugggaggggugugaaggauaaaagacuacacauuggauauaguguacacugcuugggugaugggugcaccaaaaucucagaaaucaccacugaagaaguuauccauguaaccaaacacaccaccuguuccccaaaaaccuguugaaauuaaaaaaaaaagaaaaaaccacuaagaccaaugcauuuaauuauauauauuauacucaauuuuaaaaugaaacuguaagcuaacuccugguccuagguccucaguccucucagccugacuuagguggaccaugcuggggguuguugcaucaucuugucuuguaccagaaagcaggacauuaaauuuugucuuucucccuugcagcauuagugaccagaaggaucccaaggaucgaaugguucagguugugaaaugguaccucucagccuuucaugcgggaaggaaaggaucaguugccaaaaagccauacaaucccauuuugggcgagauuuuucagugucauuggacauuaccaaaugauacugaagagaacacagugaguucugcauugacauuuuuaaauuaucuuaauuguauacugauucaagauuuuauuuaggggcaaauaauaaugaugaaagcaaugaucaaaagauggucaccacccauagaagaaauuguuguuagagcagcauaguuugaauguagugagaaggaggaaaaagaguaggaugagaugaggauggggauguagaaaucagaucuugcaaggucuuguagaccauaauauaauuuuauggcuuuucaggaucucauuuuuguuuugagaagaucaauagaaugauuuugugaaaaauaaauugagaaggggcaaauauagaagcaugaagaccauuguggagguuuugacauuauuccaagagagacauggugauucaagcuuuauuuuggagguagaacugauugauggauugggggagguaagggaaaggagacaucagagaugaauccuugcauguggauguaagcaguggcagugucauuuacugauaaggaaaagauuggauuuggggagggaaaaaucaaaagcuaauauaaaauauaaaguuuuagaggucugugaagcugucaaguagggagauggaauuuaagaguguggaguuuagggagaggucugagauggggauggggcuuucaaagaguauaguguauuuagaugacauuuuaaagcucuaggauuggauaaaauuauuuaggaagacagcauagcuacagaagaguagguaacccagaacuggcucugaggcuccaacaaauuuagugguugaagaaaaugaccagcagggaagacucaaaugcauguaaaaaggcuuuaagaaguaaaaaaaacaaaaccauagcccacagcaccugacacauaauaaucugucaguaaacaugauucuccauauauuucccucuccaagugaugcacuacguauaguccauacugaagacagacaaguaugugucuguucuuauucauuuggcagacauugauaagugccuacucuugucagcccugaaugaggcacacaauccuugccuuuaagaaugucuuagucuagucagggagacugacacaaagcaauuaaaauauuguaguuaaguucuacaauagaaauauauauauagggugcuugguguguguagagcgagcagagaccccaauuaccagauucucugaaaugucauuuguguuuucucaucaaaagaaaauuauguuauauuugcuugcaggaacuaguuucagaaggaccaguucccuggguuuccaaaaacaguguaacauuuguggcugagcagguuucccaucauccacccaguaaguuacagagcuccucugcaaccugugcucucaaaacuauucugucuaaagagggucauuaaaagcgccauagcugaggguacugucaguugugugacuagcuguguguuucuuauucccugaaguggaaacucaaguugauuuguuccucauaucuuuuccuuuuguaagcuccagacucuuagcuucacaaauuaagugcguauaaaaagaagggauuuaggaaaccaacuuuuaaugcuuccagagucaucuuauauauaguaauuugugcuguagagaccucagcaacugugagacaguuuauauaagugauacguaguuucuacacaguauauuccuggcauacugcagauaccaaaaccgaggaugcugaagucucuuacauaaaauggugucuuuuauauucauauaaccuaugcacacccuccuguauacuugagucaucucuagauuacuuauaauaccuaauacaauguaaaugcuauguaaauaguuguuucacuauuuauuuguauuauuuuuauuuuguauuuuuaaauuuuuucuuuugagacagggucuugcucugucccccaggguggaaugcaguggcacaaucauagcucacugcagccuccugggcucacaugauccucccaccucagccucccaguuagcugggacuauggacaugugccaccacacccaacuaauuuucuuauuuuuuuuuuuuuuuuuuuagagucaguguaucacuauguugcccaggcuggucucaaauuccuggccccaagugauccucccgucuuggccucccaaaguacugggauugcaggcguuagccacugagcccagccucuguauauuuuagauccacaguuggcugaaucuguggguacaaaacccauggauauggagggucaacuguacauacccucaacaucugguuuguuuagugcaguauuaaaacuggaaacacuggcugggccuagguuggggcuggagccuggguguacuugcagaccagaacagauagcccuuuugguuuuaagcuuccuggguuggccacagcaucauuucagggaugauccugcccacguggcucugaaugaaugcuugcauuggggaaaaggguauaaaaggcagguagguaccuccuggcguaauuggaggcuguuugaaggguaaaggauuuccccaugaagccaauuauuuccccagguuaugugauuuuggagagguggcuguagguauauauaaucuacuaauugaaaauuucuauucaguuucagccuuuuaugcugaguguuuuaacaagaagauacaauucaaugcucauaucuggaccaaaucaaaauuccuugggaugucaauuggggugcacaacauagggcaggguaaguguguuggcauuggguggacuacaauguuauaggagaauuuuaugaaaauggcuagacuagaugucauuguuagcaacuaagcauugguauugggggugagagcaaaggguggggaacuagauagguuaucccuaaauugaauggaguauccuggaguaaccaucagcucgacaagaaagccuuguggccacuuggcacuacucaucagagauucugucccuucucuccacaggcugugucucaugucuagacuaugaugaacauuacauucucacauuccccaauggcuauggaaggcaaguguguccauuuccucugaucagcaguagacucugcuguuccuugagacaugccccuucccccucuuccucuuaacugucaaccuuaccuaaaaacuuuugauuuugcaggucuauccucacagugcccuggguggaauuaggaggagaaugcaauauuaauuguuccaaaacaggcuauagugcaaauaucaucuuccacacuaaacccuucuaugggggcaagaagcacagaauuacugccgagauuuuguagguauuuuuucugccuuagagcucuuaugcuuuucugaaauaacugccuuuugucuugaacuacagcuucuggauuaggagugugaaagaaugguucugucuuuguaagcguguuucacauuuuaugugucaugucuuuugcugaagucccauaucagaagaagaccuaaaacauauauucagagcagucagaggucauugauagguuuccuuccuaaaaaccugacuugcaauguugaacuaaaagaggccuuccuagguugccuagcuaaaccagauuauggaucccuaauuuauucuugccagauugaaugaugagcugguccuuacagcagacuuugugaccccugcagcacugccuccugguccucacagcuaucccuuuuucugugccuuugcuggggaaaaacaguaaccaucacauuuugcacgcaucuggcuugcuuccacuugacacucuugggucacgugcagaugacugugccagucaguggaaagucuauagugauggcaccaugacucucucugccucuggaacccuuaacugggggggaaggggacagugggaaagaaaguuucaggcguugauagcagcucuccucccucugcccuggucaugucucccuuuucuggccucuuucaauccuguuuaugccuugcccuuccuaaccaggccuuugcuguguugcuuaucuucucacauuccauaguuguguguccaaguagaggucuguuacggcuuuugcagaauggauccuugcucagggaaaguauucacaccaucuggcacagaggucccuuucaaccugaggaugaaagccugcauuauauucuuaagcaaagccuucccugacccccagugcccauguaagcucaccacagcacuuaccaccuagaauuucaauggugguuacgucucucuccacuacgcugugaacagcuugaggauagggaauuugccaacucuguuaugguccuugcacccagaauaggacguucuugcccaaacccaccauucuugggaucucaaguucauaagcguccuguugaaggcccucauucuuauaguuagcccuggggaguccaguucuguuaagaugcuuucaucaaaaacuucacaguugcucuucugugcucuacucuguaguugggccacacugagcagauucuuugguagaauuuucaacuugagacuaacacaaguauuuccuuuucuguucaguucuccaaaugacaagaagucuuuuugcucaauugaaggggaauggaauggugugauguaugcaaaauaugcaacagggguaagauccucuauuuugccacuuguuuuaggcuacauuagauuguacucuaucccuuuuucuggcuuccuucauuaguacuuccuucauaaugcauuuccuucuacaguauauuagagcuggaacuuuaggacagcuccaguguaugucaucucuucagggcaagcuuuuucuuuccuucccccaccuucucccagcaguauagguaauuauaaucauuuuuacuuuucucucugcucucaaaacacuugagaauaauauauguaaaacaaugccuggcacauaguaagaacccaguaaauguuagguauguggcguauguuuauaaaaugaagcacuaaacuguguguuuccauacacacacaguugaagauuuuguauaauaaaauuuacugacugccuggcaccagagauaccaaaaugaguuaagauagaccuuuccuucaaagaacuugcacucuguacuacugcccacucaguguucuuaaacagaggaaagauguuaugaaauuaacaggaggagccaguuaacugcauuuuggaccuagagaauuugaagugucaaaagcacuacaaugcaucuaacauuagguuagggguuuaugggucuaguucccauccaccucuauuguuuucuaggaaaauacagucuuuguagauaccaagaaguugccuauaaucaagaagaaagugaggaaguuggaagaucagaacgaguaugaaucccgcagguaagccgacauuguuaaguggaacuauugcugcagugcuuaaacuuugccuaggcguaggcacagggcuggguuugagagacaguagggcagagcauaauaguauagaccaaguuugaauuccuggguucguaugucagaacuaccacuuacuaccuuugugaccauggauggcucagucagcuaacuucucuuuaccuucuuuccugaaaugagaauaaaggccuugagaggaagccacaucuuaacuaacuuuaaagccucuguaauuuacuucuugacccuuauucucuccauucauacuauuuucuccaucauauuguuaaauccaagggaguuuuucugaaauggaacuucucaguuccucuaacacuuacagguauauauuaagggacacucaagcccuacagagguaaacugauugacccagaguugcacaguaaguuagacauagagccagaaguagaaucccaggucucagcuuccacuauucuuuuucuucuguugaccuuaucauacuaucaggcagcccuuauuuccuucuuugacaacuagcaguggagucuucugagcccauaugucuguuccuuacuccagugcccuggugccagcguaaggagauuuagucugugaccuacagcacuuaaagccauuugacuuguauuauacuauauucaggauggcugcaggcuuucauucucaacauuggcagcuccucuuaccucuuuguuuuagccuuuggaaggaugucacuuucaacuuaaaaaucagagacauugaugcagcaacugaagcaaagcacaggcuugaagaaagacaaagagcagaagcccgagaaaggaaggagaaggaaauucagugggagacaaggguaagcuugccugccccacccuccuaagugcuguuccuccuaauuuauuucagugaauguugaagaagugaugugccaaacacuguuuauaaacaagaugaucgcuggucccuacuugaaacucauuucagucuaauggcgggguggggagcagauaugaaauaguaaguauauuacagaaguacaaagcaaauauguaacuaaauucuuccucuuugucuuacaguuauuucaugaagauggagaaugcuggguuuaugaugaaccauuacugaaacgucuuggugcugccaagcauuagguuggaagaugcaaaguuuauaccugaugaucagggcaguaggcauaauucagcaacaaacaaucuuccuuugggagaaaccuguucauuccaaucuucuaauuacagugguuccuaucucagggauacuggacuuucugacgcagaugaacaauuaaggggaaaagcuucccuuuucccucuguggcaguuacgauuuugacuucaguccugagaaaaacuucagguuuugaaaaucagaugaugucuucuccuuuuccaaacaccacacguugaaagcauuuauaaauccaagucugaaacucugcgcucuaguacugcuguuaagauacacaacuuguuucuuaguucauauaaucucgggauacacacacacacacacauauauauacacacacauacguauacacacacauacauauauauaaauauaccugaugccagauuuuuuucauaaauauucugccuacuguaaauauggguuccucugaguuguuuuagaaaauuagcgcaauguauuaaaaucaaguguuaggaaauuucauggucuuaccuacaauaacuuuuauuuuggaauugaacuauuauuaaauuguaucuaauccuggauuacaguuuaauuaauuauucuuagugcuuaaggcuucauaaaguaauuuuuccaaccuuuuuuuuaaaaaugugcaucuuuuauuaucuuuuaugguuaaacuuggaagccaauuauuuggcaaccuugaauacaagagcuagcuuuucaaagaaagacacuugaaauaauggaggauccauucuuuuccucugucagauuguauguucugucuuuagccccugccaggcaauuccccagaaucuucacuuaacucauauugcacauguagggcugccuaccaacauuuuauccaaaaauguuuuauugccuuagaggguuugggaagaguguguauuuauagauccccaccccacagugaacaaaaauagauagauagauagaauaaaaugaaugccacagcagcagauggcucauucugaagggaaauacagaacuauaucuaucuaucuaucuaucaucuuuuuuauuuaaaaauacauuaaaaaaacagguauuaguaccuagcauuuaguuaguuauucaauauacugguuacguaaggccuuucaagaaguagauucucagucugagaggacacaggccagggcuucucaaagugcugcugcaggcuuucuggucucgcuuggcccauucugcuaauuuuccuuugccagcuccuacaguaacccuggguuuauuagucucaacaaaggauaaaaaguaaaucaaaugcuaugaugccagugcaaaacuucaauggaagcccuaaggcaguaguauaacuaacuccauaaaauacaaacaaacacauuuuaaaauacacauugcuucaggccaa

SEQ ID NO: 191393 - RNA, 67859 nt, Homo sapiens
gauuauuuuucuccucuuccuuuuuuaaucuauccucuuuucaccacauuuuagugagaaagcaauuuuuuuuuuacaaauggagcuuauauugauuuuuauuucauaaauaauugaaagaggguagaaaaaucugcccuucauuuaaaaauugaauguuucacuauguauuuaaaaagcgauucaggauuaggaggauggauaaccauaccagcuguagcugauguucuaaaauauucuugcauuguuugcuggucuucuagggaaaagaauaauguggaacaggaccuuaaggagaaggaagauacuauuaaacagaggacaagugagguucagguaagugaccauaaaauuuaguguuccacugcugauuuaggacuauucauuuuaaauuuauaugguuauuuacuauuugcuggauguaguauuaggucaagagaaugccuaauguuuauauuauauaaauguuuaucuuuuccaagaugauuguucuugcuuggaauucuggccugcaaagauuauacugcaaugagaaagcaguauuuuucagcauagauuucuaguuuugaaaguauuuuuuaaaugguacuuaccugcauauuauaucauuaaagggguaaguuugcaugacuuacaauguuaauauuuuugcaccaguaaaauuagagugagaucaucaucucaucaucaucaucaucaucaucaucaaaaaccaguaugcuuuuucaugcaugugagguuuuuguuagcuaggagaccuaguauguuaaaggacuguuucucauaauacuuguagggugggagaugauacagaacaauuuaaaguagcauuuuaugaguagcuuaguaaccagcauaucuuaaacuuuggcauaaagagcuuuaguucauuuucauuagguguuguguuaaauuguuucauuuuacaaagagaaaggaugacaaaaaccucaguuuuuguuugggaaaugauaaaaauaagggaguagcaguguuucuaacguuagaaauagagaaaacugggcagugccucacuuagagcaguaagcaaugcauguggccauguuauugggguacuguuuccuuagugcugcaccggcacauagaggagauuggauauagaagcacugguagcaguugcuaguaagaacucuuggaugggcauuucuuaauguguugcuuguauguuggauuuuccugcuuuuccuaauaguuuuaaguagggaaaaacucuaaauuguguuaggcccauuguuuuguuuugaugcaggacauucauuagagauugucugucugguggacugugcuaggguggggagaaugauuuacugaagaauugaggaagaagccagagagacuucuuguuggaaguugauucucugauugggugacuacauuuauuauauuuacuugaauuuuccugaaggcagugcaaguuaagagaucaucaucaauauaauucucucucuggcagugagguuaggugggcauaagaggguaaguuaucugaauuacauuauuuugugcaguuuuugagcuucuuaggaaaugcaaaagagccacacauucuaagcaguuauuacuaaaaauaguuuaaaauggaagauaaaauaaucuacacaaguuuucauaauuugaagaaauagguguagcuacugauacaauuuuggacagcuucuaaauuuagccaguuacugcuuuaaaguacauagguucuugugauagacaguauuuuguugaguauaucuaccuguugguuuuucccugcugcauuuuuugaggaugugaauuuaaauacccaguuuagaagagugcugaaauuuacauuguuuccuucaguuuaaauaggcuaucccugaacauuuggugucuuauaauuauagaaguuuuguuguccaucagaauuucuccgugauuugcuugcccuucuuacuuaguggcaaugguaagguguaugucuaaccuuaagcuuugcaaaauccaaaaugugugauuggcacaggaagucgaaaugguucaauuuuuccacauagagugcucuaaguauaaguaaggcaucuugggccaugguaaguaaagaccaaguaauaaucaaugaaaaaaauaguggauuaauuaaagauuuggguuaguagauucauuauuuauucauuauacacuacaguuaucuauguuacgcaugguaaugagguacuagacuaagaaugauguggauaguugacaucuaccaguaauuaaaacucuuauauuagugaucauuuucaauuuucugaagcaaaacuuaccauaggugguaauaaguauauuucauuaccuauuuugagguaacucugauuuacccauugguacugagauguagacuggaaauaauauggauaauuaaagucuguaaauaacuccaacucucaauacuuacuuucuaauuucccuggcaaaaggcaacucacuggagcuauuaauaaauggcagaaucaaagagaguguauuucacugcuucuuucugaucuacuuucuaauggugaugcuaaugagaaaugucaaaaugaagacauuggggaggagaaguaagggaauuuugaccuaucaguaccugccgcacuuggcuuuuugaguguucuugcuuuucuccauauuaauaaagucacagugauaauaugagcucauaucucaaacacagaaaucaaacuuuuaaagccaaaagcuuuaauuuuuuuuuuguuuuguguuuauguagucugucuaauucaguuagaguagaaagucugcuauguaauuaauuucugaauuuuuguuuccugucuguauuucuguuaauuacugccuugaaaacuuucuguuuaggauuuuuucuugaagaugacuucacauuuuauuucaugagaugaucacuguuagcuuguaugagauauauaccaguggaucaaguucuguggacaaauuaggcccaaagugauccaauuccaagggggaaauguugugaaaagccauuuuaucuaaaaugucuaagguuuggguguguauuuuuuguuuuguuuuucauaaggggagaaaguaggcucacauucuuccuaccuuaaagaauugccuauguaugaucuuauuaaaaauuuuuuucuucugaguagucaacagauauuuuagaaauucacucucauaugccugguuucuucaguuuugaguagaacuuuauagcaacaauuugaugucaaacaaacuugaauucaguuccuagcucugccacuuccuagguuugugaucuuaaguaauuuaaccauucuauacuuuaguuuccucuucuguaacaugggauaauaaaaauaacaaacacuuaagagcugauguaagaauaaaaugagauaaugcaguaaagugccucacagagugauuggcacuugguaaguguucaguaaauguucuuacuagcuguauuauuccgcacccuacaaucaucucuuuauuaucuucucuucaccuuuaagcucuuucuucucuuucuucacauaggccucuuggacauaggacucuucaauuugaaaauaccccuuccuuggcuauugcugccacuuuaacuaccaacuuauuuugcucuacuuuuauugcuuuguguggccauuuucccccccuuccuaucuuuguagcaacccuguacagucugcugcuugcccauaccacacugugcauuuucuccccagggccaagaauaaucuuaaggccaaaucuguucguccuucuuguauuagguacuccuuucuuggguuguauucuccuggauaucuuccuaccucucugaaccuuugcuuccauugacuuugccaaggacagauggacagacagauuguguguguguuuauguguguccuuucuuuccuucuccauaaccccugucauccauaugcugauaacacccaaauguuuaucaagcucucaacucuccugagugccagucccacaucuccaguuaaccauuuugguguuuaucauuugaaaauccgugugucuaaaaugaaucuuauugaaaaaacuuggcuucugguuugaacuuuccuauuuuucuuucucacuacugccaccuguaucgccuaauaucuaaaaucuuaaagucauaucagaaguacucacuccauucgcucuugccuuuccuccuaaaccaauuuaguaucaugacucucagaugugggaaucuuuacuguugcucacugccaccauuaaugaugggagggugucauaccucagguuauuggagacagagaaaaagaugaaauacaaacccuccucuuuuuugacugucugacucuguacucugugccauauauauucuccuucuuauucccacuuuuauaacuuuuguuguuauaguccagaauguucucuacuuuccugcuuaugugaauuccacucaugccuuaaagccuagcucauaucccaccgcuugucuuaaacuuucccuucucugucucuugguccacaccagucuuuccuguguuggaacucccagaggaaggaauacguauccacuuauauauggcaugaaccauauguuaccugguaguguuagcuuggugugauguguauagcuuccaauaucuuccuuccuauauauugugaguuccuugggcuuagaaauugugccuuggaucauauuuuucauuauauuuggcaauauauuguuagauggagguaaauuuaaggaagcuguucacagcagaagugaauaaacuuugguuuuguguauacaauuuaaaauaagacaauauaacuggaacccauagguagaaaagauugagagcauaguaguuaucaugaaaagucagacuucuugauauuguucauauuacccucauguaaaagaagcucccuauuauuuauguuucaucauaagauucaguaauucagaguacuuguccauguuuuuuauuuuaauucacuuaguuuuuuucuuagaugaagagggaugacuuaucuuagauagaaauaaaauuagauacaugagcucagcauucuuuuucuggccauaaugcucuuuagaacauacugggaagcauaugauugagaaauaaaggcagucuguuaaugggguuuucuaacacccacccuaguuuauuaggcuuccuuucuguucauugacuuaaacaucuuguucuauaguugauacauuuuuaauguuaagaauaguccuaaaacuuccaucagauaaaacaguguaucugauuauuucuaauuguagguuaguuuauagagguuuucuuuuaaaaauaaauaauuauauaauuauguauaauauauaaaauauauuacugauauugauaugaacuauuaacaugauauguuugcaucuguuucauauaaaauacagaguuaaaagguuuaacuuuucagauaacuuuuaaaguaacuucaucaguuguacaucugacuugaguugcuaaaaugaaaguuuuauuuuuucauaugucuaaaauucuuagguauuuguuuaaauuuuauuuccacuaccccauagcacuucaugggggauagagggauagcagauaauuugccauuuucaguaacuucagugauuucuagaaaacaggacguuuuccuugaaauuucuuuuuaaguaaagccaagauugccagcucaaauauccuuuaauuucuagaugaguaaccucggauauggcuugcuuugauauuuuucuaaaauaaaccuuggcacuauauugcucuaguuuuguucacuucauccuugccaugcuucagcugcugcuaucuuccuuucuuuugcuguugauggcacuaguaggcaaguagaccaugaucaggggaauaaagcagaacuaggaaagcaucugcaaaugucuucugucauucacuggagggaauggcauuugauagugcugagucugugcacagacccaggaaaggauguucccaagggccacguuuaggaaagagaaaauuacccaaguucagcagaagacacuguuuguuaggagaaccuuccacugcucuaguuaagggcauggcgggggaggagagagcaggaagagagagagagguacaucuguugccuuaauuuagucucaggauaagcaaucuguaccaaaauaaaguugcuaaguauaucuagaugcugauauugauauugaaauugcauugugauggugguagccuuacaaauaauuuuccagugaaauuuguuauuagcauguauauuugcaugaguucauuuugauuuugugcaguuuaauaauuuuaauucuguauacuggaaaggaaggccuuuuuguauguaguuuaguguuggaauuuuuuuuuuuuuuuuuuuuuuuuuuuuuuuuuuugagacggaguuuugcucuuguugcccaggcuggagugcaauggcacgaucucgacucacugcaaccucugccucccaaguuuaagugauucuccugccucagccucccaaguagcugggauuacaggcauccgccaccacgccuggcuaauuuuuuauuuuuaguagagacgggguuuuuccauguuggccaggcuggucucgaacuucugaccucaggugaucuuccagccucagccucccaaagugcugagauuacaggcgugagccaccacgccuggcccagaauuuuuauagaccuuuuuucauauuuagaaauagacauagagagacauuaauuauaaugaauuuuaauauggacaucguuccagcuugaaguuucucauuaauguuagguauuuccucaguaaccuuuccuuuaaguccuguaguuuuguauuacuauguggauuuuuacugaagcuaagaaaugaaaaagggcagugagucugggaaauuugaaugaauguguuugcucuuugggagagaaagggcagaaagaaguaaauauuauauugguuuguuuauuugucuuccucuuacauaagccugucuuuugagguuguguuuaaguggcucacuaaaaauauuauuuaugaaaaauaguucaguuuauuaaaggaaaccagcauugauucuauuauugguaguucuuacauaaaaauuuagucacaucagaauauuuuuguauugguauuuuuauauuuuauauugguagcaaugugauacuuaaaaaaaacagcaaacuugacauuuucugauuauaaaaguaacauggguucaugguaaauuuguaaaaugaagaaaaguaugaaaaagauguaaaaagccuuucuagagagagcuauuguuaacauuuugcuguauuuucuacaaauauguauaaauuucuuuauauuaauuugugaucauacuguauaugccucuguauucagcuuuuaaaacuuaguaucauguccuagacauuuucuuauauugugugacccuuuuaagguaaauuguguuuuuugucccuggauuuacaauaaaagacaucaaaauuacaucuggcuuuaaagauauuauuagagacaugaaguagauaaagaauauuuuucuuugggguaugagggaggguggggaauaugacuagaguauuuacuaauggggauagauaacauauuuuuccuauucccacucuugaacauuuuuaguuaaagggaaagagaaaaaacuuuuuucccucuaggauuuaaaacaugcuuuugggaccagcauauuguuauauaaaccuauauaauaauuuuaugaacaaaguaaggaauucaaaauagauuauauuuucuuuuuucuuuuuuuuuuugagauggaguuucacucuuguugcccaggcuggagugcaguggcgccaucuuggcucacugcugcaacuucugccuccuggguucaagugauccuccugccucagucucccuaguagcgggaauuacaggcggccacuaccacgcccagcugauuuuuuguauuuuuaauagagaugggguuuuacuauguuggccaggcuggucucgaacuccugaccucaggucauccacccgucucagccucccaaagugcugggauuacaggcaugagccacuuugccggcucaauagauuguauuuucaaacuaacaaaauuacuuuagaucugcagguaacauucuuuuaaaauauuuuauagcugaacuagaccaagcacuguggcucauguuuguaaucccagcauuuugggaggccgaggcgggcagaucauuugagccuaggaguuugagaccacccugggcaacaugguaaaaccccaucucuacaaaaaaauuuaaaaauuagccaggcgugguggcacaugccuguagccucagcuacuugggaggcugaggugggaagauuacuugagcccaggagguugaagcuacagugagccgugauuauaccacugcauucuagccugggugacagaguaagauccugucuuaaaaaaauaaagguauaugccacagugacauguuaaagcaguaaugauuauuuccaaauaaugaaaguuuuaaaugucagaucagccuuggucuauagauuauaaaaauacugaaucaguuuagaaauguagguauuauuuuaaaaaguuuaaaaagcauuugucauaggucaguuugggguauuaauaaauagcuauaguuuaaauacauagugaaguguuucacauuauguaaaaagaauguaagucuuuucuuucugucagucucaugcguguuucccauuaguuuuucccacauacuaaaauccuaugauaguuacaguaauugcuuaauuaagccccuggaaugugcuaggcauuguacaagauuuuggauaaucaaagaaagaugaagcauggacacuguccuuuagaaguuuguaauuuagagguuagcuaugauuacaguguauuaaguaugacaguagagguuaggaacaaacaguagaguuugagcauaggugaaggaagcccaagaugagucagacgagauuaaauuuggcuggauucugaagaaucaauaguggguuuccagguacauaugguguggaaggacauugaagacagagguuauggcuuguggaaaggcauagggucauugaaauauguugucuauuggagaaggaauagggucuucugaggcugggacacaggugaauaugagaggaaaagaagguagaacccagaacugaagguuuuaaugugucuugcagcaaguuuuacuuaauccucuagauaagagggaacaacacauauuuuaaaaauaacagugacuagagaaauauccuuugcagugaguuauuuuuuaagcaaguuggacauuuggaauaggaagaaacaaagggagaaaacccaguuguaugucaaggaaggaacgaugaaagcuaaaauaauuugguaaacagcuuaaagagagauuuuaagguagaaucuauaggacauguaugaauggagaaaaucaaagaugaaucugaaguuacuagacugggugauacagaaauugaagucauuuuucucuuuuggcauggguuuauucagagccaaugccaugugcauaucuaaagucguaucucuauaugguauggauuaguuaacaguguaggcaagguuaaaaauuuagacaugaaaaaaauuaggcaugcugguaaauuaaugauaaaguacuaaaggaguucaccaguuugaaacugugaucacacaaacucacggaauguuagcacuggaaagucuuucaugaucaucuauuguguuggcauuuuuaaaggaauuuuuaaaauaaauuauaguaaauaauugauaaacauuuuugucaaaggaaucagaaagagaacaucuaauucuuuuuuauuauuauuauacuuuaaguucugggauacauguguggaacguacagguuuguuacauagguauacaugugccauggugguuggcugcacccaucaacccaucaucuagguuuuaagcucugcauguauuagguauuuguccuaaugcucugccuccccuugucccccaccucccgacaggccccggugugugauguuccccucccuuguguccaugcguucucauuguucagcucccacuuaugagugagaacaugugguguuugguuuucuguuccugugguaguuugcugagaaugaugguuuccagcuucauccaugucccugcaaaggacaugagcucauucuuuuuuauggcugcauaguauuccaugggauguaugugccacauuuucuuuaucuagucuaucguuggugggcauuugcauugguuccaagucuuugcuauugugaauagugcugcaauaaacauacgugugcaugugucuuuauaguggaaugauuuauaauccuuuggguauauacccaguaaugggauugcugggucaaaugguauuucugguucuagauccuugaggaaucgccagacugucuuccacaaugguugaacuaauuuacacucccacuaacaguguaaaagcguuccuguuucuccacauccucuccagcuucuguuguuuccugacggguuaaugagagaacaucugauucuuaagaaaccuaggcaaagcaaaacucuauauaauacaauaaagaaaaauucaauuuagaaggggcauaagcauauuuaacuaagauuuaaaauguacuuauuuccucauuuaaaauuucuucuccuucaauauuauaauuucaagucucuuaaaauaaggacugaauuaaaauacagaaauuguuuuucuuccagaaaucaagugucccuguaucuuaaauucucuguacaguuccauuuaucaguccuuugugcaagaguuagcaauucauggcacaagggucacuuuuugccuuucuuugcagaguugaugauacucaucaaacauuguccgaauuccucaaguaucauugaggaauucaaaggcuacugccuuugaguuucccuuuuugucugccugcucugccugggcuuuaaaggaauuuuuuaaagaaagcaacaugauauuuuuagacuaaccaguugguuaagaaaauauaagauaaaaagcaauuauugaaagcauuguucaguguucuauuuaaucacagaaacaucugcauauauuugaaaaauagugacacaugugagacauuuagucugcagaugguaugucacauggugguuaagagcucaggcuguggagucagaacccacuuugaauccauagcuuacuauuuuuaacuuuggacacauuaccuacacaucaguacuucaguuuucucaucuguaaaauaugaaaugauaucaguaccuaacucguagaucugucauauagacuauaaauaaguuaguauauuuaaagagccuagagcacaaccuagcacauuuuaaguagcauuuaaaguguuggcuauuaucauaauggugcuaucuuguguaaccuaugcaguaauucagagaccuuuuaccuguaaguuucucuucuguucuuagauucuuauucuggugaaugacuguugggaccuuugaauagauauuauuuuuagaaauuuguguucaguuuuaccucacccgcuuugaaaucuuugccuaccuccugcugacagauacuucggaguuauuaaucccugagccacugcgccuggcuuuuuaaaaauuucuguaguucuuguuauuaagcaugaggucugguauguacauggaugaauaaauaacauuuucaaaaugguucuuuuuuuguuuuaagaaaucuuuuccuacacugagaucugcauuucuucuacacauuuuaaaguuagacuuuuacauucagguccauuauuuaccuggaauuaauuuuucuuuuuuuuuuuuuuggagacagugucucacucuguugcccagucugggcaugcuguggcaugaucacagcucacugcagccuugaccuccugggcucaagagauccucccaucucagccucccaaguaacugggaccacaggcacguacuaccacguccagcuaauuuuuuuuuuuuugagauggaguuucacucuuguugcccaggcuggagugcaaugcaugaucucggcucgcugcaaccuccaccuccuggguucaagcaauucuccugcuuuagccucccgaguagcugggauuacaggcaugcgccaccacgcccagcuaaauuuuuuuuuuuuuuuuugcauuuuuguuagagacaggguuucuccaugugggguuuuuuuuugaccagagaaucugagaggggaaagauugagcuuaaaacagauuuguggggaaauuccaggaguucuauuuucaacauguuagcaaagcccaucacauguccaaggacagauuugaguuagcaaauugaauaucuaaauauggauucuaggaaagaugucuucaaguaaagauuguauuuaaagcuguuaaguacccuagucucaucaacacaguauacucaguaagacuuuauucuuucuuaagguagauuuaaaauuacuaacuuaacccuccccugcccgcaaagaaaauaaauauauuaauuuucuuggauuuuaggaucuucaagaugaaguucaaagggagaauacuaaucugcaaaaacuacaggcccagaaacagcagguacaggaacuccuugaugaacuggaugagcagaaagcccagcuggaggagcaacucaaggaagucagaaagaaaugugcugaggaggcccaacugguaaugucuggcuguuuccugcugccugcaccuauacauuaguugcuuuuccuggcuuaagaugaaaacauucucuacuuuuuguuauugaugguggugguuggcaauccagucagcauuuggguucaugggggcgauggagcaagguucauccagaaauuacaggccuucuuuagaggaaauagaagggcaguuaaugaacuguuuuuccaaauuuuuguuggaaauauggugccuauaccuucaacucuccucugucccucccccaguuacccuucuuuacgaaaaccauacaucaaaaaacaucauaauuggcugggcacaguggcucacaccuguaaucccaacacuuugggagucugaggcggggggaauugcuggagcccaggaguuggagaccagccugggaaacauggagaaaucccaucucuacaaaaaauaugaaagcugguugggugcaguggcucacgccuuuaaucccagcacuuugggaggccgaggcaggcggaucacgaagucaggagaucgagaccacggugaaaccccgucucuacuaaaaauacaaaaaauuagccagggcgguggcgggugccuguagucccagcuacucggcaggcugagccaggagaauggugugaacccaggaggcggagcuugcagugagcugagaucacgccacugcacuccagccugggcaacagagcgagacucugucucaaaaaaaaaaaaaaaaaaaauugaaagccaggcgugguggcccacaucuguaaucccaccuacucgagaggcugaggugagaggaucaccugagccugggaaaguugagccugaagucugaagugagcugugaucgugccauugcacuccagccugggugacagagugagacugucucaaaaaaauaaaacaucaacaacaacaacaacaucaaaaacuccauaauagggcuagguauggcugggcauguuccuauagucccagcuacucaggaggaucacuugagcccaggaguuugaauccagccugggcaacauagcaagacucucucucucaaaaauuaaauuaaauaaauuauuugcuauugcugucaaaaaaaacaccaaaauaguaaacuaaacaaauaaauguauugcauuuuggaacauuuuaaugacaucucuucuuuuaauccccauuucuucucauucacuuucacauuauagaucucuucucugaaagcugaauuaacuagucaggaaucgcagaucuccacuuacgaagaagaauuggcaaaagcuagagaagagcugagccgucuacagcaagaaacagcagaauuggaggagaguguagagucagggaaggcucaguuggaaccucuucagcagcaccuacaagauucacaacaggaaauuaguucaguaagucuuuguaaagcaagaaauauauucaaauggauccucuguguccuuuagucaguuauacuuuccaacuucugcuccuucaaccucuugccuaguuuacuguucauuuuucagucauuuuauacaauagguuuuuuugucaccuguuauauauugaaacuaucauacaucuuguauaucuaucugaugauuaucauuggaguagugauuaagagugugggcuuuguggcuagauggucuagguuuaaguacuggugugccacuuacuagcuaaaucaccuuaguaucagauucuucaucuucaaaauuggaggauuaauaaauacccuaccccuuagggccacugugaggauuaaugaggcaaaaccuguaagacauuuuagcauggugcuugguacauaaaugcuccauaaguguugccuguuuuauaaacaauaaccuaguuucuucuguuuugugauucuaauuuugaauucacauuugcuaauuuggaaacuuuuuucuuaaggaaauuguuccuucuguagauaaauuugcaguguuauaguuggucuuauguauagauccuuugcuuuauuuccagguuucccuacaugaagacuaauguuuuaaugaaugauaagauaguuagggcucggcauggugguggcccaugccuguaaucccagcacuuugggaggcugaggcaauggaucacuugaggccgggaguucgagaccagcccugccaacauggccaaacucuguuucuacuaaaagguacaaaaauuaacugggcauggugguaccugccuguaauuccagcuacuugggaggcugaggcacgagaaucacuugagccugggaggcagagguugcagugagcucagaucacaccacugcacuccacccugggcaacagagugagaaucugucucaaaaaauaaaaacuaaaaaaaaaaggauagaaacacagagaucauggaguugauuucuuucauuaugaauuugaacaaacuaaagccaaggaaguucaaguaacuuucucaagguuacauauccuugaaaagagcuacaucuaaaauccaguucuucuaaaacccaguccagugugcucaguuauuacauauaaugaaguccuucacuuuugcgcuuccuuacccccuguuaucuggcagcugaguaccuaccuacucauucgucaugcaagauauaccuuaaauucuuauuucuuuaugguauuuucugcauccugcuuuuguuggacuuuguauuuauguuacagcaauaauaagauuuuucccugcauauuugcuuauaugucugucuccccuagcagagucaugguuuuggucugggaacuuacacauuuuuaaaaauccguaucauuuagcacaguucuugucccaguguagguacucaauaaacagguaaccugaaagaguuguuguagugagaaugcuaccagaugaauggguauucuuuaaaguauuuucuuuuuuugaaucucuuuaaaaaaaaaauccauguauacuaaaauuucaagagagaaauacuuauugucagaaauuacugaaucuuuucucuaagucacguagcauucccagaggauucuucuuaaaggaagcaaauguauccuagaccaagucuacagguauagccauuuuuauuuuauuuauuuuuuugagacagggucucauucugucacucgagugcaguggugugaucauggcucacugcagccuugaccucugggcucaagugauccucccaucucagccuucugaguagcugggacuacaggugcacuccaucaugcccagcuaauuuuuauauuucuuguagaaaugagguuucaccguguugcucaggcuggucuugaacuccugggcugaagcaguccuccugccucaguuucccaaaguguugagauuauaggcaugagcuaccacaccuagcccgucaggaaguggaggagggcguuuuuauguuacaugucuuucuaguaauaaauucuguucuauauuucuucuuuguguuggcagaugcaaaugaaacugauggaaaugaaagauuuggaaaaucauaauagucaguuaaauuggugcaguagcccacacagcauucuuguaaacggagcuacagauuauugcagccucagcaccagcagcagugaaacagccaaccuuaaugaacauguugaaggccagagcaaccuagagucugagcccauacaccaggaaucuccagugagucuaauacuuucauaaccuucauaaucaaccuccuugugcagauccaaguuucacugacauuauaucuaauauaaauacauggccuugccucaucugaggacaauugagauuuccuuuuuagaagcagagaguccuaauccaaacaauuguacguuuuaacuaguauaaaaagauaacuuuagcuaauuuuuuuuuuuuuggagauggaguuuugcucuuguugcccaggcuggagugcaguggugcgaucuuggcuuacugcaaccuccgucuccuggguucaagcaauucuccugccucagccuccugaguagcugggauuacagucacgugccaccacacucagcuaauuuuuuguauuuuuaguagagaugggguuucaucauguuggccaggcugguuucgaacuccugaccucaagugacccaucugccucggccucccaaagugcagggauuacaggcgugagccaccacgcccagccagcuaauuuauuuuuuguagagccuguuuuuaaaauggugguucuauagaguaaaacuuuuuuuuuaaguacccucaccaaaagcuaaaauuauuuuuauuacguaguguuaaggacauucauuuaccaauuauuugacgaguaccaacuaugugcaagagugcuguauuacauaauauaagagcuacagagacaagagaccucagucuuuccuucaagcagccuacaguguaguaguguaacacuguguuaaagggcugugcuaaaggaagcgcagaauuuucaguuaggacaguuuggaggggguucauaaagauuuuguuggggaaagcuuugcgaguuuagacaagugagaagugguuaagcaaagaagaggaggauacauuccugccagagaaaacaguauuaguauagguacaagguggaagaauacaugcagcacagaaucuugagaaguucugaaggauaucuugugaugguggagaggguauugguaagagaugaggcgcuucuaguaggcaucugcauuaccucuggugauugucaaaguauaaauguguaucccuuuccccaaacuugcugaacuaguuucugggauagagccagauauguauauuuuaaaaacacacucuaugggugauugucaugugcaccuggauaaaaaugaccaauuuuaggucagaaagugccagaagaugagaaauuuagauucaucuuaaagcauugggggauuuauccuacugcaaugaacagccauugaagaauuuuaagcaagaagugacgugauuaacuuuuagaaauguggaaaacggauuagagagugagacuguacccguagaagggauaaugagaagaauagaaguuugagagguauuaaaagugaaaaguuaacagacucgauuuuauuuacacagugcagucauguaugcauuauaaaauauucuuucaagcgcaaaaggcagauuacuagguuauccugcaaauagauaagggugguauaaaguagcuauugcccugcuacuuuuuuuuuuuuuuuugagacggagucucgcucuguugcccaggcuggagugcaguggcgcaaucucagcucacugcaaccucugccuccuggguucaagcuauucuccugccucagccucccggguuuaagcuauucuccugccucagccucccgaguagcugggacuacaggcgugugccaccacaccuggcuaauuuuuugcauuuuuaguagagacgggguuucaccguguuagccaggaaggucucgaucuccugaccuugugaucugccugccucggccucccaaagugcugggauuacaggugugagccacugcauccggccugccccuacuacuucuuaagucuuucacccacucgucuaaaugaagaagacaaugggaagccauugaaggacuuuuaaccagaagggucacgaucacauccacauuuuagagcuauuaguuuggcuacaauaaggagaagagauuggaaauacauguauuggaggcaggaaagcaguuggaaggaagacugcuauaguaauuggaaccaaagaugauaguacuauaagugauugauagugacagugaggauggagaagaaggcaaggauuugaaaaagagguaagagguagacugagcaagacuuggagucauauucugaggauuaaagaugaccugaagguuucugacaugagugacuuugaugcuugaugacaccauuucccuaaaaaagauuauagaaggagaaguuauuugaugaauacauucugcuugucuuuuuuuauuuuuaaauaguuuuugguuaucuuuagucaguuuucucugccaugucaaaaaguauauuguuaaucuacuugcauuaauauuuuguaggcaagaaguaguccugaacuacugccuucuggugugacugaugaaaaugaggugacuacagcuguuacugaaaaaguuuguucugaacucgacaauaauagacauucaaaagagguaaaaaaugauuuuauauuuacauuggggacuuguaaggguggaaggacaggaggaggugaauuaucagacauuacuuaauggguacaauauacauuauucagaugauagauacaucaaaagccccgacuucaccuuuaggcaauauagccauguaacaaaauuccacuugugccccuugaauuuauacauauaaaauaaauaaauguucuuaauagcuggaugugguggcaagugccuguagucccagcuacucaggaggugaaguagguggauugcuugagccugaguuggaggcacuaggcaacauagagggaccuaaucucuaaaaauuaaaugauauuuuaaaaaaauguccuuaucacuguuuuccucagaugaauuauacacuauuuuaggugaaggaaagagaaaaauauguuaaggugaaggaaagagaaaaauguguuaaaggugcuuuaugacuagagagauauuuguuacauuaccaucaguugauuuuccuuuuguuuucaagaccaagucucacucugucacccagccuugagugcaguagugugaucuuggcucacugcaaccuccaccucccagguucaagcaauucuccugccucagccuccugaguagcugcacaugcccagcuaauuuuuguguuuuugguagagacgggguuucaccauuuuggccaggauggucucuaucucuugaccuugugaucugcccacgucagccucccaaagugcugggauuacaggugugagccaccgugccuggcccaucaguugauuuuucaaagcauguguaugaccugaauguguguuauuuuauuuuaaaauguuaccuuuuaaaacuuugguuucuaaaaaauaauuuuaauuuaaaauuauuuuuaggaagauccauuuaauguagacucaaguucgcugacagguccaguugcagauacaaacuuggauuuuuuccagucugauccuuuuguuggcaguaaguacucuuuuuuuuauauuauagauuuacccaaaaaaaagacuuuuuaauauauaaacuaaggauucaaggcuucaguuucaauagccuaccaacucagucugucgcccaggcuggagugcaguggcacgaucucggcucacugcaaccuccgccuccuggguucaagcgauucuccugucucagccucuugaguagcugagacuacaggcgcccaccaccacacccagcuaauuuuauguauguauguauguauguauguguguauuuauuuauuuauguaauuaauuuauuuagaaauggagucucgcucugucgccaggcuggagugcaguggcacaaucucggcucacugcaacuucugccucccggauucaagcuaaucuccugccucagccuccugaguaguugggauugcaggugccugccaccacacccagcuaacuuuuguguuuuuaguagaggcgggguuucaccauguuggccaggauggucuccaucucuugaccucgugauccgcccacguuggccucccaaagugcugggauuacaggcgugagccaccgcgucuggccuaauuuuuguauuuuuaguagagacuggguuucaccauuuugaccaggcuggucuugaacuccugauguaaggugauccgccugccucggccuucuaaagugcugggauuacaggugugagccacugcgccuggccugcuuuguauuuuccuacugacuaauguugaacaucuuucuagaugcuuauuagccauuuguguaucuucuuuggaaaaguguuuauucaauuuuggugaaguccaguuaucuauuuuuucuucugucacuugugcuuuuggugucaucuaagaaacuauuaccuaagucgcaaagauuuaaugcugucuuugucuaagaguuuuauaguuuugcuguuacaguuagaucuuugauccauuuugaguuuauuuuuguauaugaugugagauagaggucgagcuucauucuuuugcaaguggauauccaguuguccuaacaccauuuguugaaaagacuguccuuucuccauuuuguguucuugauacgcuugucaaaaaucaaaugaccauaaagguaaggauuuauuucuggacucuucaauccuguaagaauuuuuuuuuuuuugcuucaguaaagcucaguaccuuuauuucugaacuggugaugauaauacccucccaguacucuuguggagaguagagauuuuguuaguaaaauuuuugcuguaaugucuuccccuccauccguaaccucaacuugugaucaagguaaguauaguuggcuguauauuucauaaggucaaugacauuccuuauuuuaucuacugugaagugaaguuauugaaauaaacuuugcuuugcuuuuguuugaaaguuacucuuuaaguaguggugucaccacaguaaauauuguuauuuggauuucuuuguguuuauuuuaucacaggugauccuuucaaggaugauccuuuuggaaaaaucggucaguaucuuauugaguuucaucuuagcuuucauucauuucugcuuaauaauaagcuuauguuauuuaggucugaaacugaagccccaguaagaugcucuaugugccuggcauuuucagaaagagaguaguaaauucuuuugauuuugcuuaaugaauuguugcuuuacuuuuacuucuucuuuuuuuuuuuuuuuuuuuuuuugguguuuuuuguuuuugagacagggucuuauucugucacccaggcuggaaugcaguggugugaucauggcucacugcagccuugacuuccugggcucaagcaauccuccugccucagccuccugaguaccuaggucuacaggcucaugccagcauacuugacugauuuuuuuuuauuuuuuguagagacagggucucacuguguugccgagguuggucucgaacuccugggcucaagcaguccuccugccucagccucccaaagugcugcgauuacagacaggugugagcgacugugcccgauagcuuuacuuuuuuaaaaaugacauuaguguuuagacuuuggugcuuuaaauauuuauucugauuccuccuuacuaacuaaagguuuggugagcauaaugaucuauacugcuucaggguuuagaauguaauuuuguuuuccuaagauuauagcccacacgugugauuagaggcagagaaucuugaagaauuacuaaaacaucaggcuuuuugagauauucuuuuucugggaauuuucauuagaauaaugcaaaucuuguuuaccauuuaguuuugcaucccaaaccuguucuaaacuauuggcuguuagcuuugagcucagagagaaaaauacauuuagaaguuuuuauuguguuuucuuuaguuacgguagcguagaauaaggggacuuaaaauuggaucccuugaaauuauauguuaauuuuaaaaauaaguuuauuagguggaagguucuguaucuuuuaucaaaauugcaaaggagucugugaaauaaaaaguacucagcuuagauucuacaguauuucaaacugucuuuuuggauuuuuuuuuugagacagucuugcucuguugcccaggcuagaguacaaguagugcggucuugacucacugcaaccuccgccucccaugcucaagcuauuauucucaugccucagccucccgaauagccaggauuacgggcgcgcaccaccacgccuggcuaauuuuuguauuuuuaguagagacaggguuucacuguguuagccaggccggucuuaaacuccugagcucaagucauccgucuaccucaaccucccaaagugcuggaauuacaggugugagccacugcaccuggcccaaacugucuuuuuguuuguuuguuuuugagacagggucucacugucacccaggcuggagugcaguggcagaucuuugcucacugcagccucugccucacagguucaagugagucucccaccucagccucccgaguagcugggacuauaggugcgcaccaccaugccuggcuaauuuuuguguuuuuuaguagagaggagguuuugacauguugggcaggcuggucuugaacuccugaccucaagugaucugccugucucagccucccaaaguggugggaaugcagacgugagccacugcaccuggccccagacugucuuuuaauuaaggcacugaucauaccuucaagugaugggaaauuuagugcaauaauuuuuuuuugucucuuauauucgugccuuauuuuuuuagauccauuugguggugauccuuucaaagguucagauccauuugcaucagacuguuucuucaggcaaucuacugauccuuuugccacuucaagcacugacccuuucagugcagccaacaauagcaguauuacaucgguaagugggagaauuaaaaacuguuaaguuaaauggauaauaaguguccuaagcaaguuucuugaaauacauagugaugaaagaacccucauuuagauuacuucuaauggaccauauaagaauuucagucucaucccaauucauuuaguuuuugguucagacugguauuucauaguuugauuacccacuggaauuaacuggaaugacugaacggaguccaaaagugauguucaucuuucaagagacuaaaucuuauccuauugaggauacuaaaaaugauuggaaauuuauaagccaaucuuacauaaaacuuuucugaaauguuugguauauuauugaaauaaugaaaauuaaaagaauuuuagaaaaauaaaaucguuuauguuauuucauagacacaucuggaauguuaauucugcaaaguacaaauucucacuaaaugucaagcucucuugagaauguacauaccuacagcaaucacuguuuaauaaccacaugccugauccagguacuggugugugcuuuacauucauuguuucuaaucuucacaucaauuuugcaaaguagguguugauaucccuauuuuaaaaaugaggacacugggacuuagaaaaauuaacauguuuaagguccuauagcuaguugcuguuuuaucuggaggcuuuaaaaaaaucuucauggcugggcgcgguggcucacgccuguaaucccagcacuuugggaggcugaggugggcggaucacgaggucaggagaucgagaccauccuggcuaacacggugaaaacucgucucuacuaaaaauacaaaaaauuagccaggcgcgguggugggugccuauagucccagcuacucaggaggcugaggcaggagaauggcgugaacccgggaggcggagcuugcagugagccgagaucgcgccacugcacuccagccugggugacagagcgagacuccgucucaaaaaaaaaaaaaaaaaucuucaucuuguggauauuuagaaauacucaaaggagaauaauguaaugaaauauuuuaacaagcuuccaugcauccauuacccaauuucaauaguuaggaaugguuuugcagguuuuugguuuugcuuuuuaauuuguauuuugagacuucguuuuugagaccacaguuucaugucuguagguaaacugaaccuauaaaggaccaguuaacugagaagcauuugaagcaaaaaauuugucuucuaguacuauuagauuaagaauauuuccuuuaaaauguaauugauuauuuuaaagauaauagguuuuguauuauugaaaguugcuucuuuuuuguauucaguaaagagcugcuuggcuaagaacugguguuuuccauugaauaaaaacuggacagauaccuucgugacugaauauuuuucguuucccugggcugcuggauacucuguuuuccuauagcacuuaguuugcaauguggacccauuugccaaauucuucuaaaauugcugcuacuggaauucuucuccucucaccuucuuauucuagccucucauucuccuaucaucuaaagagcaagaaagcuaaauuagcucuucuaauuuaaaaaugaauacauuccucuuguccugucccccaugagauuuuucuaccauuuguuuuacugacuuuuauucccaguuuucuaaaggaauauuguccuugcuuuacagcuuguaauuucaccauucaaaacaaaaaaccagauuggcaauauaauaauagcugcaguuuaucuaauuuccucugugugccagggauggugccaagcucuuuauaugcauugucucauuuacuuuucacaguaauccuaugagguuuacguagguuaaguugaggccaggugugguggcucccaccucuaauuccagcacuucaggaggccaaggcaggaggaucacuugaggcaaguaguucacaaccagccugggcaacaaagugagacacugucucuacaaaaaaauuaaaauauuagagguguaauagcaugcaccuguaaucccagcuacucgagagacugaggugguaggauugugugagcucaggaagucaaggcagcagugagccaugauuguaccacagcacuccagcuugggugacagagugagaucuugucucaauuuaaaaaaaaaaaaagauagauuaaguugguaguaaguuaguaacugguagaacuugacucaagccaaaaucuaagauuuucaccaauacaaucuggaaauuuuuaaaaaauugcccugcuaaacuccccaauuaucaaacugacauagaguuuuguggccccuuauuccuucaugggcugcacaaucuauccuguucccccugcuauccugauggccuuuuagggugguugcacaguauaugaugaaggacuagaaacuaaaccugacacacaugugguuaugcccuuucccuuucuccuugugauggcaaaucaaaucugcaagcuguuguuuaaaacacagccuguuaguuuuuucuucucucaaagagaagaaguaauaauacagguugagcaccccaaauccgaaaugugccagugagcauuuccugaguaucaugucagcacucaaaagguuucagacuuuggagcauuucacguuuucagauuauggauguucacuugguaaguauaacacaaauauuccaaaaucugaaaaaaaacccaacauccaaaauacuuuuugucccaagcauuucagauaaggaugcucagccuguacuuggugacuuguuaugucagugaccuucucuuacacuggaguuaugacuaucauauuaggaaacauggaaaguuaucucgcuauauagaccaguuuaaguuuuucuuuaauugcuguuuauucugcagauaucuaaguuagugugcuaguuguauaauaguauaauuggccucaguuaauacuaucauuacuuuuuaucauucauaguuuucauuucuaaaaacuucauuaguauuaauucuuucugcuaguaguuuuaauggacucucuuuuauaaagagagaagguuagucccaguuaacauuaccuuucucuacaauuaauuuuuuuaacuuggagauuuauacauuagcucuggcaguauuauuugacauuuauuuguaauauccaacuucuugauaauuggaaauagagucuguaauacaaaugacauugauaaucaugcaucagaguugcauauaaauguucagaaacucuuuucacacucuuuuuaccuguuugccaagucuuucaucuagccccuuaaaaagagccuggugccagaaagaggaaacucaguuaucuuccuagauauacaauuuguuugacuaugauuaaaaacuaaaguauaaaguaggaagacaguuaaaagccagaaucgcuggcaucugguaacauccucaccuuuagcaagaucaguugcucuugaucccagacuuuuacauagcuuauuguugaaagcaggaucuuagcaaaaagcuaucuuuguguauauguguguguguguguguauguguguauguguguauauguguuuucucucugagggucagaaugcagaaugauuuuuagauaacaauuagaaaauagaaauguaacauuuuaugauauuaaguacuaggauauuugagaauuaaaauagugugugcauucuaaacguaaaaugauauucuggaaucgaaaaaggacauuaauggaaaaacuggugaaaucuaauaaaaucuaugguuuauaguuuuguaccaguguucuuaguuuuaauagauguacuauaauuaugugagauauuaacauuaggggaaacugggugaaaagugcaugggaacucuguacuaucuuuacaacucuuauguaaauguaaauuauuccaagauaaaagguuagugguggcugccaccuaaaaucccagugcuuucagaggccaaggugggaggauuucuugaggccaggauuugaggaaaacauagcaagacccuaucuauacaaauaauaacaaaaauuacccagguaugguggcauacaccugcggucccagcuauucaggaggcuaaggcaggagagaggcaggaggaucacuugagcccaggaguuugagguuacaguaagcugugaucacaccacugcauuccagcuggggugacagagcaagacccugucucuaaaaaauaaguaaaaaguuaaaacaguguacaucuauacaacuagcaagauuaugaagaaaaaaauaaacgaauaucaccaaagucaggauugugauuauagagggacacaugaagacuucugagguauuggcaguuuccugggagaugacuacacaaguguucacuugauacuuacuuguuaaaccauagaucuguuucauguacuuuucugaauagauguuauauuucacaguuaagauuagaaaauaauauguauuauuuccaguuaguaagauugcagaucacuauggggaaacauuuguuccuaaugucuauauuccuuaauuaauuaagaauuuguaaagaauauauucuuuggaguggugaugagguuucagcugugaaguguugccucucucauucaugguuuuguaugcuuuguuuagguagaaacguugaagcacaaugauccuuuugcuccugguggaacaguuguugcagcaagcgauucagguaaauaaauaauuuaucaacuucauugaacauuaaacauuuuuuuuaagauucuuuuuucuuugucucuaaauauauuuguccuguuauuuauagcuuuaaaauuauugcauaauuauauccaauaguaauuuaccaauaauaagcauuuguauaucacuuucuacuuaucuuucauucuuucauuuauuauucauguugaauauuacacuagaauaugaacucuacccaguaucaguaaaccaauaaaaauguuuugcuuuauaaaaugcuguguugcuuggcagcuucaaagucagcauugacuguuacggaucuuggucuaaguuaaaagauuaguggcuuccaguagaaaaugaaaauugcuuuacaaauacaaauggguucuguuaauaauacagagaaaagcuaaauguuauuuuagcauccagucuucauacuucauuuaugguauaaaauuuuuuauuuauucuuuuaauaacuuuuuaaauaguaaucucauuuuaaacauaaacugaggaccagaauauuaagcaguguucaucaagaucguacaguuuaauagauuugaaccagguaaagccaagauucaauauuaggucugacaaaaagcuuuuucaacaaaguaacucugcuucuuuucuacuguucauuuaaaacaaaacagauaaacagaccagcuaucauuugggaugggagagcagaaaauuugaggaaaguaaacucaaauguguaaauacucuaauauuaugcugaaaauagaucgcuuuauuuuucuaggugaauacagagugaguuguucaguauacagauguauuaauugugacuaauuaaggauuaugaacauagaaaaagaauaguagaaaugccuuuacaggagccugggcccgguggcucacgccuguaaucccagcauuuugggaaaccaaggcagguagaucacuugaggucgagaccagccuggccaacauggugaaaccccgucuccacuaaaaaugcaaaaauuagccagguaugguggugggugccuauaaucccagcuacuugggaggcugaggcaggagaauugccagaaggcggagguugcaaugagcugagauugugccauugcacgccagccugggcaacagagugagacucugucuccaaaaaaaaggcuggcucuaaaaaacagguuggguuucuuauaaugaacaaauuguaacaagaugagauuuagcagagugcauuguuuucggguuggaaauuaacucccaacaugaguagcaagagugaggaauacaaaaaggagauauguagaaaauaagauuuaauguaggcuggauauugauuuaaauagaaacuuagaaugagagcaagugagacuucuaaaaggcuuauuguauuaacagugguuaaauuacauauuuuuuaaguacaugugcucuuuuuauacccucauuauuaagcugauuauauugcuagggguacuauagaauuaaaaaggauaaccuaagagaauaaaaugaaagguuaauacguuuaugauugcccacaccaaggaaaugguaagugccauaagaguuaauuaaaccagcagagauuaaaggaaggggagaucacguuaaggauaaaucauuaaugauaucaaaguggaauguggcuuuugugguaugccuugaaagcaugggcuaguauuuuagcagguaaauauggaaagagauuauguggagcaaaaagaacaaugugaacaaggaauggaggcagaacauauagggcauauucaaggaaaaacuaacacauuuuugcaagagcuauuucucuuuuuuuugcaagauagaggaauagucaaggcugaagugguagguuacaguguuacauuaaagauuucuaauaccucuguugaucuucugcuuaaauuccaguuccuaauucauuuccuguaaagugguagaauaaaugaugauaauagccuaggagggugcaaagauuuaucauuaauuguaauaauaauggcuacuauuuauugaacacuugcagaguuccagcagucaacaugcuaaucauuuuucucuacuuggucccauuuaauucucacaacaacuacguuagauuauuuguauuauguuuauuauacagacaaggaaaauccaggcauggagagaugaaacaguuuucagaagguuaaaguaguaguauuagauguauccaauucaaaugaggucucugguuuuccaccugccucuuuggucauucuuucuuuaaucuccuuuguugauauuuccucuuuuucucaaccucuuaauauuguguugucccaagucuuaguccuuggaccucuuuucuuuuuuaucuguacucccuugggggaacucaucuguggcuucaaauacuacugauacacugaucuauaucucuagucacaucucuuuccugaaccccaggcucauuuuuccagcuauuuauuuggcaucuccacuugaaugucugauagauauaucuaaugcauaagucuaacacaaagcagcuauuuuuccuuccuaaaccugcuuuucuuggcaccuucgacaucuucaugguucaucuuuaauguuguccaggccuaaaaucuuagaaucauccuugguucuucuuuugcucuuccucugucucuaaucugucaggaaaucuuauugacucuaccuucaaauuauauccaguaaaagccuuacaguggccugcacuuuucuaacaauaucucaucauuauucccauuacucacucugcuccagccacacuggucuucuugcugcugcucaaacaacagacccauguucuuuggcccuuugcacuagcuguucccucuuccugggaugauccuucuccguauguucacaugauaaucucuacuaccucugacaaaucuuuuauuuuauuuuauuuuauuuuauuuuauuuuauuuuauuaaaguuuuaggguacaugugcacaaugugcagguuaguuacauauguauacaugugccaugcuggugugcugcacccauuaacucgucauuuagcauuagguauaucuccuaaugcuaucccucccccuuccccccaacccacgaaaggccauggugugugauguuccccuuccuguguccauguguucucauuguucaauucccaccuaugagugagaacaugcgguguuugguuuuuuguccuugugauaguuuacugagaaugaugauuuccaguuucauccaugucccuacaaaggacaugaacucaucauuuuuuauggcuccauaguauuccaugguguauaugugccacauuuucuuaauccagucuaucauugauggacauuuggguugguuccaagucuuugcuauugugaauagugcugcaauaaauauacgugugcaugugucuuuauagcagcaugauuuauaguccuuuggguauauacccaguaaugggauggcugggucaaaugguauuucuaguucuagaucccugaggaauugccacacugaauuccacaugguugaacuaguugacagucccaccaacaguguaaaaauguuccuguuucuccauauccucuccagcaccuguuguuuccugacuuuuuaaugauugccauucuaacuggugugagaugguaucucauugugguuuugauuugcauuucucugauggccagugaugaugagcauuuuuucacgugucuguuggcugcauaaaugucuucuuuggagaagugucuguucauauccuucauccacuuuuugaugggguuguuuuuuuuuucuuguaaauuuguuugaguucauuguagauucuggauauuagcccuuugucagaugaguagguugcaaaaauuuucucccauuuuguagguugccuguucacucugaugguaguuucuuuugcugugcagaagcucuuuaguuuaaugagaucccauuugucaauuuuggcuucuguugucauugcuuuugguguuuuagacaugaaguccuugcccaugccuauguccugaauggugaugccuagguuuucuucuaggguuuuuaugguuuuaggucuaacguuuaagucuuuaauccaucuugaauuaauuuuuguauaagguguaaggaagggauccaguuucagcuuucuacauauggcuagccaguuuucccagcaccauuuauuaaauagggaauccuuuccucauugcuuguuuuucucagguuugucaaagaucagauaguuguagauaugcggcguuauuucuaagggcucuguucuguuccauugaucuauaucucuguuuugguaccaguaccaugcuguuuugguuacuguagccuuguaguauaguuugaagucagguauuugaugcugccagcuuuguucuuuuggcuuaggauugacuuggcgaugcaggcucuuuuuugguuccauaugaauuuuaaaguaguuuuuuccaauucugugaagaaagucauugguagcuugauggggauggcauugaaucuauaaauuaccuugggcaguauggccauuuucacgauauugauucuuccuacccaugaacauggaauguucuuccauuuguuuguauccucuuuuauuucauugagcagugguuuguaguucuccuugaagaggucccucaugucccuuguaaguuggauuccuagguauuuuauucucuuugaagcaauugugaaugagaguucacucaugauuuggcucucugucuguuauugguguauaagaaugcuugugauuuuuauacauugauuuuguauccugagacuuugcugaaguugcuuaucagcuuaaggagauuuugggcugagacagugggguuuucuagauauauaaucaugucaucugcaaacagggacaauuugauuuccucuuuuccuaauugaauacccuuuauuuccuucuccugccuaauggcccuggccagaacuuccaacacuguguugaauaggaguggugagagagggcaucccugucuugugccaguuuucaaggggaaugcuugcaguuuuugcccauucaguaugauauuggcuguggguuugucauagauagcucuuauuauuuugagauacgucccaucaauaccuaauuuauugagaauuuuuagcaugaaggguuguugaauuuugucaaaggccuuuucugcaucuauugagauaaucaugugguuuuugucuuugguucuguuuauaugcuggauuacauuuauugauuggcauauauugaaccagccuugcaucccagggaugaagcccacuugaucaugguggauaagcuuuuugaugugcugcuggauucgguuugccaguauuugauugaggauuuuugcaucaauguucaucaaggauauuggucuaaaauucucuuuuuugguugcaucucugccuggcuuugguaucaggaugaugcuggccucauaaaaugaguuagggaggauucccucuuuuucuguugauuggaauaguuucagaaggaaugguaccaguuccuccuuguaccucugguagaauucggcugugaauccaucugguccuggacucuuuuugguugguaagcuauugauuauugccacaauuucagagucuguuauuggucuauucagagagucaacuucuuccugguuuagucuugggaggguguaugugucgaggaauuuauccauuucuucuagauuuucuaguuuauuugcauagagguguuuguaguauucucugaugguaguuuguauuucugugggaucgguggugauauccccuuuaucaguuuuuauugcgucuauuugauucuucucucuuuuuuucuuuauuagucuugcuagcggucuaucaauuucguugauccuuucaaaaaaccagcuccuggauucauuaauauuuugaagggcuuuuuugucuguuuccuucaguucugcucugauuuuaguuauuucuugccuucugcuagcuuuugaauguguuugcucuugcuuuucuaauucuuuuaauugugauguuagggugucaauuuuggaucuuuccugcuuugucuugugggcauuuagugcuauaaauuucccucuacacacugcuuugaaugugucccagagauucugguauguugugucuuugugcucguugguuucaaagaagaucuuuauuucugccuucauuucguuauguacccaguagucauucaggagcagguuguucaguuuccauguaguugagugguuuugagugaguuucuuaauccugaguucuaguuugauugcacuguggucugagagacaguuuguuauaauuucuguucuuuuacauuugcugaggagagcuuuacuuccaacuacauggucaauuuuggaauaggugugguguggugcugaaaauaauguauauucuguugauuugugguggagaguucuguagaugucuauuaggucugcuuggugcagagcugaguucaauuccuggauauccuuuuuaacuuucugucucauugaucugucuaauguuaacagugggguguuaaagucucccauuauuauugugugggagucuaagucucuuuguaggucucuaaggacuugcuuuaugaaucugggugcuccuguauugggugcauauauacuuaggauaguuagcucuucuuguugaauugaucccuuuaccauuauguaauggccuucuuugucucuuuugaucuuuguugguuuaaagucuguuuuaucagagacuaagauugcaaccccugccuuuuuuuguuuuccauuugcuugguagaucuuccuccauccuucuauuuugagccuaugugugucucugcacgugagauggguuuccugaauacagcacacuaaugggucuugacucuuuauccaacuugccagucugugucuuuuaauuggagcauuuaguccauuuacauuuaaaguuaauauuguuaugugugaauuugauccugucguuaugauguuagcuggugauuuugcucauuaguugaugcaguuucuuccuagucucgauggucuuuacaauuuggcaugauuuugcaguggcugguacugguuguuccuuuccauguuuagugcuuccuucaggagcucuuuuagggcaggucugguggugacaaaaucucucagcauuugcuugucuguaaaguauuuuauuucuccuucacuuaugaagcuuaguuuggcuggauaugaaauucuggguugaaaauucuuuucuuuaagaauguugaacauuggcccccacucucuucuggcuuguggaguuucugccaagagauccgcuguuagucugaugggcuucccuuuguggguaacccgaccuuucucucuggcugcccuuaaccuuuuuuccuucauuucaacuuuggugaaucugauaauuaagugucuuggaguugcucuucucgaggaguaucuuugugucguucucuguauuuccugaaucugaauguuggccugccuugcuagauuggggaaguucuccuggauaauauccugcagaguguuuuccaacuugguuccauucucccugucacuuucagguacaccaaucagauguagauuuggucuuuucacauagucccauauuucuuggaggcuuuguucguuucuuuuuauucuuuuuucucuaaacuucccuucuugcuucauuucauucauuucaucuuccaucacugauacccuuucuuccaguugaucgcauuggcugcugaggcuucugcauucuucacguaguucucgacuuuuggucuuugaugauggugauguacagaugaguuuuugguguggauguccuuucuguuuguuaguuuuccuucuaacagacaggacccucagcugcaggucuguuggaguuugcuagagguccacuccagacccuguuugccuggguaucagcagcgguggcugcagaacagcggauuuucuugaaccgcaaaugcugcugaccgcugacaaaucuuaauucagauaucaccuucucagugaagcuuauucaggccacucugucugacauuuacaaguaccacuacccagcucagugcucccacauuacuauucucuacuuuucuucuuucauugucacuuacuuuccaucuuauuauauaaauuacuuuacuuuucucuuaucuguuuccuuuucauccuauuagaaauuaagcuccagaaggaauugagaucuuuguuuucacugauauaacccaagaaccugaaaauaugccugggcguauguuauugaaugaaaaaaugagccagcugcucuucucagagaacauguaaugggagucuaguggguagacauuauuuauuuuguuaugauaaguaguuuuuuuaaauugugguaaaauauacauaacauaaaguuuggcauuuuaaccuuuuuuaaauguacaguucacgagcauuaaguacauucacauuguugugcaaucaucaccaccauccaucucaagaacuuuuuucauauuccagaacugaaauucuguauccauuaaauaauaacucccuauccucccucucaccaaacccuaacaaccaucauuacuacucugcauacuucauauaaguggaaucauaaaaaaaauucauauuuuggugauugacuuauuucauuuaccauaauguccucaagguucauccauaugguauaauguauugaauuuuuuaccuuuuucagacuugauaauauucuauuauauguauauacugcauuuuguuuauuuguucauucauuaauggacacuuaguugccgucacauuuuguuugugugcauaaugcuacugugaaugugaggguacagauaucugagucccugcuuucaguucuuuuggguauaauucuaaaaguagaauugcuggaucauaugguaaugcuguuuuuaguuuuuugagaaaugaucauacuauucuccacagcagccauaccauuuuauacaccagccaacaauucacagugguuccaguauuuccacaucuuugccaacccuuacuacuuucuguuuuauaggcauccuaaugggugugaagugguaucuuauugcuuugauuuguauuucccuaaugauuaguauguagugccuuuuuuuauaugcuuauuggcuauuuguauaucuucuauggagaaauaccuauucaaguccucugcccauuucuaaaucagguuguuuuuguugaauuuuuuauauauccuagauauuaaccccuuaucagauaaaugauuugcaaauauuuucucccauccuguggguuaccuuuucauucuguuaguacuguccguuggugaacaaaaguuuuuaauuuugauguagcucauuuuaucuauuguguuguuguugccuuugcuuuuaguguuauaaccaagaaagcguugcuaaauccaauaucaggaagcauuuccccgauaaguuuuauaguuuuagcucuuacauuuagguauuuaauccauuuugaguuaauuuuuguauauugugugagguaagaguccaacuucauucauuugcauguggauauucaguuuucccaucaucuuuucuugugaagaccguccuuuuuccauuguuuguucuuggcacguuucuugaaaaucauuugaccauauaugugaggguuuauuucuggauucuguauucuguuccauugaucuauaugguuuguauuuaugcaguuccucacuguuuuaauuacuauagcuuugaaauaagauuugaaaucagaaaguuugacuaccaacuuuguuguuccuuuuuaagacugcuuugggcugggcacaguggcucaugcauguaaucccagcacuuugggaggucaagguggguggaucgccugagcucaggaguucaagaccagccuggccaaugacugaguucaggaguucaagaccagccugggcaacauagugagacucugucucuacaaaaaaaugcaaaaauuagccaggcauaguggcaugcaccuguacucccagcuacuugggaagcugaggugggaggaucacuugagccgaggaggcagagauuacagugagccaagaucaugccacugcacuguagccugggugacagaaccagacccugucucaaaaaaaaaaaaaaaaaaaagaaagaaagaaaaagaaaaagacugcuuuggcuauucagguuccuugagauuccauaugaauuuuaggaugaauuuuucuauuucugccaaaagaaaaagucauuaggauuuuugauagggauugcauugaaucuguagauaucuuuggguaauauuaccaacuuaaaaauauuaagucuucuaaucugugaacaugggaugucuuuccauuuguuugugucuuuaauuucuuucagaauguauuguauugucaguauacaaguccuccuugguuaauucccaaguauuucauucuuuuugaugcuguuguaaauggaauuguuuucuuaauuuccuuuccagauuguucauuguugguauauagaaauaugacugauuuucauauguugauuuuuguauccugcuacugugccaaauucaacuauuaguucuaauuguuuuuugguggaaucuuuaggguuuucuacauauaagagcauguuauuugcaaacagauuuuauuucuuuguuuugaaucuggaugccuuuuauuucuuuuucuugccuaagugcuuuggcuaggacuuccacuacuauauugcagggauccccaaacccugggccacggaccaguaccagucuguggccuguuaggaaccaggcugcacaggaggaggugagugaugggcaagugagcaguaccuaaugccugagcuccgcuuccugucagaucagcagcagcauuagauucucauaggagcuugaaccuuauugugaacugcacaugugagggaucuagguugugcacuccuuaugagaaucuaacaccugaugaucugagguggaacaguuucauccugaaaucauuccccucaucccacccccaaguccuaaaaaaauugucuuccacaaaaccggucccuggugccagaaagguugagaacugcugcuauauugaauagaagugguagaaaugguaagagcacgcauccuugucuuguuccuuauuguagagaaaugguuucagccucucaagauugaaugugauauucacuguuggcuuuucauauauagccuuuauuaaguugagguaguuuuccuucuguucuuagcuuguugaguguuuuuaucaugaaaggguuuugaauucugucaaauacuuuuuuugcauccauugaaaugauugguguuguauuuuuccccucauucuguuaaugugguguauuacauugaaugauuuuuguauguugaaccauucuuauauuccaggaauaaaucccacuuggacaugguguauaaucccuuuaaugugcuguugaauucuguugaggauuuuuacaaaaauauucauaaaggauauugaucuauaguuuucuuuucucaucuauaugucuucaucuggcuuugauagcagaguaauacuggcuucacagaaugaguauggaauuguuccugccucuucaauuuuuuggaagaguuugagggagacugguuuugauuauacuuuaaauguuugguagaauucacccgugaagucauguaaucgugagcuuuucuuuguugggagguguuuuguuuuguuaauuuuaaaaauaaugguggccgggcacaguggcucacgccuguaaucccagcacuuugggaggcugaggcggguggaucacuugaggucaggaguucaaaaccagccuggccaacauggugaaaccccaucucuacuaaaaauacaaaaaugagccaggcgugguggugggcgccugucaucccagcuacucaggagacugagauaggagaaucucuugaaccugggauguggagguugcagugagccgagauuacaccacugcacuccagccugggccacaaagcgagacucugucucaaaaaaaaaaaaaaaaaaaauuaaaaauauggaaugccacaagaauuugcauguuauccuugcacaggggccaugcuaaccuucccuguaucuuucuaguuuuaguauaugugcugcuaaagugagcacuguuggaagguuuuugauuacagauucaaucucuuuauuaguuaugagucaauucagauuuucuuuguuuuugugauucagucuccaugacuuguguuucucagaauuuguucuucucauuuauauuauucaguuuguugauguauaauuguucauagcacuguguuaacaauccuuuuuauuucugugaaauuacuaguaaugucuccucuuucauuucugauuuuaguuauugagucuuguuuucuuagcccaucuaggaaugucaauuuuguugaucuuuucaaagaacaaacucuugguucuauugauuuucucuauuuuucuauucucuguguugucucugcuccaauuuuuauuauucauuucuuucugcuagcuuugaguuuagcuugcuuuucuuuuuuuagguccuuuacaguguaaaguuagguuguugauuugagcucuucuuuuuuaaguauuuauaguuagaaguuuaucucagcacagcuuuugcugcuauaucccguuaguuuugguaaugcuguguuuccauuuucauuuguuucaagauauuuucuaauuuucuuugugauuuuucuuugaccaauugguugagcgugauauuuaauuuccaccuauuuguaggucgucuaguuuugcuucugcuguuaauuuuuaguuuuauucuguuuuaauuggaagagauaaauuuauuuauuauuuuuauuuugagauagagccucguucugccacccaggcuggggugcaauggcgcgaucucagcucacugcaaccucugccucccggguucaagcaauucuccugccucagccucacaaguagcugggacuauaggcgcccaccaccacgcccgugucauuuuuguauuuuuaguagagacgggguuucaccauguuggccaggcuggucucgaacuccugaucucaagggaccugcccaucucggccucccaaaguguugggauuacaggcaugagccaccgcaccuggcuggaagagauauuuuuaugauuucaauuuuuuaaaauucauuaagaguuguucuauggccuaaaguauguucugucuuggagaacauuagauauguacuugagaaaauguguauucugcuauuguuggguggaguguucuguauauaucuguuagguccaguugaucuaaaguguuguucaaguccucucucuccuuauugaaagugagauauugaagucuccaacuguuacuguagagcugucuguuucucccuucaguucugucaguguuuaauguauauauugaagaagcauguuuggugcauguauguuuauaaauguuacaucauauugguaaauugacccuuuauuuauuguauaauguccaucuuugucucuuguaacaguuguagaguuaaagucuauuuuuucugauauuaagauaucucugcuuucuugauauucuauuugcaugaaauaucuuuuuucaucuuuucccuuucaaacuauguguguccuuagaucuaaagugaaucucucuuauacagcauguaguuguguuuugcauuuuuuuucuaccaguuugugucuuuucauuagagaguuuaauccauucacauuuaaaguaauuacugauagggaaggacuuauuauugucauuuugcuguuuguuucuguauguccuauaguuuuaugucccuuauuuccucuauuacggucuucauuuauguuuaguugauuuuuuguagugacauuuuuuauucccuccucauuuccuuuuacucuuuucucuguguuucauggagauuacacaaaacauccuacaauuauaacagucuauuuuaaacugauaagauuuaauuucaguuggauccaaaaccacuccuuuacagcuccacuccccacuuuaugugguugaaagucacaauuuacuucuaaaguugaguugugagccaguauuauaguaauacuauuuuuuauauuuguccauauguugauauuuaccuuuaucagagaaaacuuuauauuuucauuuggugucuaacauccuuucauuucaacuugaaugacucccuuuagcauuucuuuuuuuuccuuuuuuuuuuugaggcagaguuuugcucuuguugcccaggcuggagugcagugacgcagucucggcucacugcaacgucugccuccuggguucaggcgauucuccugcuucagccucgcuaguugcugggauuacaggcaucuaccaccaugcccgacuaauuuuuuuuuuuuuuuuuccuggaagcagagucucacuccaggcuggaaugcaguggcaagaucuuggcucacugcauccucccccugucgcuucaaguuguucuccugccucagccuuccaaguagcugggacuacaggcacgcaccaccaugccccacuaauuuuuguaucuuuagcagagauggagucucaccguguuugccaggcuggucuugaacuccugaccucaagugauccguccaccuuggccucccaaagugcugggauuacaggcaugagccaccacgcccagccaugccucacuaauuuuuguauuuuuaguagagaugggguuucaccauguuggccaggcuggucucaaacuccugaccuuacgugauccacccaccuuggccuccgaaagugcugggauuacaggcaugagccacugcucccagccccuuuagcauuucuuauagaguaggucuagugguaaugaaccauucaguuuuuguuuaucugggaauaucuuaauuucucucuuguuugugaaggacaguuuaccagauacagaauucucaguugacaguguuuuuuucgaacccuucaauauauuccccuacucccuucaagguuucugcugagaaauucacugauaauuuuauugaggauccuggccaggcacuguggcucauaccuguaaucccaacacugugggaggccgaggugggaggaucacuugaggucaggaguucgagacuagccuggccaacaugaugaaacuccaucucuacuaaaaauacaaaaauuauccgggcgugguggcuugcgccuguaguccuagcuacuccagaggcugaggcgggagaaucacuugaacccgggaggcagagguugcaguaagccaagauggcagcauugcacuccagacugggugacagaacgagacuccauccaaaaagaaaaaaacaauuauugaggaucccuucugcaugaugagucaguuuucucucacuacuuucacagugcuaucuuuguuucugucuuucagcaguuugauuauaauguaacucagcauaggacucuuuugaguuuauccuacguggaguuuguugaccuuuuuauauauccaugucuucccucaaaguuggggaguuuuggccauuauuucuucaaauaagcucucugccucuuucuuuccgguauaaagauuagugugggggugucuccauuguucuuuuuuuuccccucaaacuuagagcuggaagaaaccuuagacauccugugggccagaauuucauauuaccuuccacaaaacuaacuuccagagaggucuucaggaaguuggcaaauuuuaguuacguauuuuuaaagugucuuugaacuuuuaagaacuacaucucguuaauuauauguauucguauauauuauuauccaaauuuuaacaaauuagagugcauuggugcuuuaaagugcugucaacuacucugagaaugcaaaauucuuguuuuaaaauguguaucuuacaacuccuuccuuggaugaauuagauuuuuuuagauggagaaaccaaaaucaaguacagccauaccuuggagacauuaugguuugguuuuguuuuaggaacccaggcuggucuugaauuccugggcucaagcaguccucccaccucagucuccuaaagugcuaggauuacaggugugagccgcugcaccuggcccagcauggguucuuuuccauaccaccacaauaaagcaaauauugcaauaaaagaagucacauauaaaaguucuguuuucacuauacucuggucuauuaagugugcaguaacaugucuaaaaaaugcacgugucuuaauuagaaaaugcuucauugcuuuaaaaaaaaaaaaugcuaaugaucgggcacaguggcucacaccuguaaucccagcacuuugggaggccggggugggugaaucaccugaggucaggaguucaagaccagccugcgcaacauggugaaaccacgucucuacuaaaaauacaaaaaauuagccaggcgugguggcgggugccuguaaucccagcuacuugggaggcugaggcaggagaauugcuugaacccaggaggcugagguugcagugagcugagauagugccauuacacuccagccugggcaacaagagugaaacuccaucucaaaaaaaaaaaaaaaaagcuaaugauuauuugagccuucaacaaauuguaaucuucuuggugguggagaaucuugccucgauauugguggcugccgacugaucaagguguuagcugcugaagguuggggugccuguggcgauuucuuaaaauaacacugaaguuugucacaucaauugacucuuccuuuccuguacgauuucuuuuagcaugugacacuguucgauagccuuuuacccacacaagauagucuuugaaaauugguauccguccuuuuagauccugccacugcuucacgaacuaaauuuauguaauauucuaaauccauuguucucauuuuaacaauguucacagcaucuucaccaggaguacauucuaucucaagaaaucacuuucuuaucuguagaggcaacuccucuuugguuccaguuuuaucaugagauuucagcaauucagucacaucaucaggcucuacuucuaauugaaguucccuuacuaauuuguaccacgucugcaguuacuuccuccacugaagucuugaauccaucaguaauacaugacgguuggauguaacuucuuucaaaguccucuuacuauugcuauuuucaccuccuuccaugagucacacuguuuuuguuuuguuuuguuugagacggaguuucacucuuguugcccaggcuggagugcaauggagcugucucggcucauugcaacuuccgccucuuggguucaaaugauuuuccugccucagccuuccaaguagcugagauuacgcccgccaccacgcucagcuaauuuuuuguauuuuuaguagagacaggguuucacuguguuggccaggcuggucucgaacugcugaccucaggcgauccaccccgccucagccucccaaagugcugggauuacaagcgugagccacuacacccggccugagucacauuguucuuaauagcaucuagaauggugaauccuucccaggagguuuucaguguacuuugcccaaauccaucagaggaauggcugucuauggcagcuauagccuuauaaaguguauuucuuaaauaauaaaacuagaaagucaaaauuacuccuugauuugcaagaauuacugccuggcugcaagaauggauguuguguuagcaggcaugaaaacaacauucaucuccuuauacaucuucaucagagcucugggugacuuaggugcauugucagugagcagauuuuuggguuuuuuuguuuguuuguuuguuuugagacagucucccucuguugcccaggcuggagcacaguggugcaaucucagcucaccacaaccucugccucccagguucaagcaauucuccugccucagccucccaaguagcugggacuacaggcacaugccaccacacacggcugauuuuuguauuuuuaguagagacaggauuucaccauguuggccaggcuggucucgaacuccugaccucaagugaucugcccgccuuggccuccaaaaguacugggauuacagacgugagccacagugcccagccuagcaggaguauuuugaaagaaaucucuuaucugagcaguggaucccaacaaugggcuuaaaauauucaguaaaacaugccauaaacagcugugcugucauccaggcuuuguuauuuuauuucuacugucaauuuaucuuaauucauaggggccuuaggauuuucagaauggucaaugagcauuggcuucaacuuaaaaguugccacagcugcauuagccccauaggagacucaaccuguccuuugaugcuucaaagccagacauugacuucucuuuagcuaugacaguuguagauggcauuuucuuccaguagaagacugcuuugucuacauugaaaaucuguuguuuaguguagccaccuuuauagaucaauuaucuaagcuagacuucuggauaacuugcugcaacuucuguaucaguacuugcuaaguuuguuuuucuucuuuuuaaaauccuuuuguuugugaaaugaagaauggacuguuuuuuucaguuccuaugguuaaguuggcaaaccuguucuugcccuauuuauguauuuauguugguuuguuuguuuuguuuuguuuuuaguuacaacguaagucuuuuccuacauugucuucuuaaauguaauuccacuugacaugaaaacuuuuaauuaugagaauauggagaaggagaauuaguuauuauuauauaggucauucaggucagugguuccuaaauaucuuuuaaacuuuauauggggaaaaagagauauguauauagguuuuuaauguauuuauuuaauuaguuuacuuguucauaaaaucccaacuucuggaaacuacugagauucugagaggugauguuacauacccaagucacaaacacaagacauuuacccaccuuacugguacccuucuacccuuauuauuuucuuccacuagguagaauuccaccaggcaaaaagauugauccuacggaacaggggaauuguuaagcuuucaaaauaaauaaaaacaugccaguaaauuuuuguucuuaaauguuauauauaacucuacuccaaccucuaaaauauacuuguuaucauagggauagaagcauauuaaauauagucgggcgcgguggcucacgccuguaaucccagcaguuugggaggccgaggcagguggaucacaaggucaggagauugagaccauccuagcuaacacagugaaacccugucucuacuaaaaauacaaaaaauuagccgggcgugguggcgggcaccuguagucccagcuacuugggaggcugaggcaggagaauggcgugaaccgaggaggcagagcuugcagugagccaagaucgcaccacugcacuccagccugggcgacagagcaagacuccaucucaaaaaaaaaaaaaaaaaaaaaaagaaguauauuaaauauuuuauggcugggcgagguggcuuacaccuguaauuccagcacuuugggaggccgaggcagacaggaguuugagaccagccuggccaacauggcuacuaaaaauucaaaaauuagcugggcaugguggcaugcaccuguaauuccagcuacuugggaggcugaggcaggagaaucucuugaaccugagagauguugcucgccugagcaacagagcgagacuccaucucaaaaaagguauguuaaauauuuugccucacauugagaucuuguuagcauuugcuucuggugaauagacacauugcagacugugaaagaaaacuaaggaaagcaaauuuagaauucuuacuggguuuuuuuguuuguuuguuuuguuuuggagacagaguuuugcucuuguugccugagcuggagugcaauggcgcaaucucagcucacugcaaccuccgccucccagguucaagcgauucuccugccucacccucccgaguagcugagauuacaggcauccgccaccacgcccggcuaauuuuuguauuuuuaguaaagacguuggccaggcuggucucgaagcccugaccucaggugauccacccgccuuagccucccaaagugcugggauuacaggcaugagcaaccguacccggcaggauacuuacuuucuacauguacuuuauaaaaauuauuuuuccauuuuauugugagauuaguuuaagugccagaaauuuuuuuguguggaauauuuuacuaacuccugacagaaaaugcagaacuucccaacuguuaauuaaaucuuuauaacauccugaggauauagaagggagcucaugaucucccuagagcaucuuugacuccagcaggaguaaaauacccaguagguuuuccuuuuuacaggcaaugacucaggcuaaacguauauguguucauguauuuacuuagccucugcuuucuuucauauuucuucucuuaauuuucaucauuuccagaaaccacaagcugugacuguccuucaaguucacuuaauuuuuuuuggagacggagucuugcucuguucacccaggcuggagugcaguggugcaaucucggcucacugcgaccuccaucuccuggguucaagugauucuccugccucagccucccaaguagcugagauuacaggcgugcaccaccacgccuggcuaauuuuuguauuuuuaguagagacaggguuucaccauguuggccaggcuggucucgaacuccugaccucaagccauuuaauugugucuuugaagguaaauaauauguggaacuggaucccaaauccugagaaugccagaacuacagguccaaaacaugaugcacuauucucagcagaguucagaagggucagaacucaagguguuaugaggcagagaacacaugaaauucgugcauuccauuuagcagcccccaugagaccagaaauacaccccaggagucuuugaagauggggauaauucaacuccugguuuuauaaauagaagaaugaggaguaccaaaaauguuauguugaauucucuucauuuuucucauacaaucugaagccugagcuaucuuauccucaacucauagcagcugaugcugcaguuuagguuugagaucagucccucuauccauucaagagugacccgaggcauagagcucuaaucaggacagcuuuuuaacaagaaccuucuagugacauacugguuuaguuuauaagauuuuaauuuacaaauuuaaaaagcugcaucuuuaacuuuuucuccuuuuucuuuucuuucuucacaucacucuuuuccuuaucuauaucuuacucuuugucaucuuuucuauccuuuuugcucccuucuguuuccugcccuucuuucuucucuacauccugauuggcaaucuuguuguugaugaaguuguguagggcaacuauggaaugugucagggaggcagaguaccccacugccauuuggucguugaucuucagguacaaggccuugacagacugcugcaggcugaugucuggcagcagauugaagacuuccugcagcuaaugaucuggugguugauuggcagcuugccuguggcuguuuuuuccagguagcuccugauauccagaagcuuggaguucagccuccucaaaccauggaccucuuugugaucagcugguaaagacuguccacuguagcaucuuugaugucuuguaacaaguguucagcuccagcugccucagcuuccucugcuccaguuucauuagccacaugcucaaauguuuuugagguuggagcaccaucaucauggacuucucucacugaaauauaugcuucugugggcagccccagauccuuuaguuucagucaguaauaccaauacugaguuagguuagugucuuuucuugaguucauugauggcaauguuacucuuguguaguuuagggccugugugguaccacccaacuauucuuuggcauuaauuuucuuaaacauuccauacauguuuuccaaauaaucauggucuaaaaaccagacagaaugauuuuugucaucuucaucaaaagggacuccagaacuguuggauacaucaaguacuuuugucugccaugaccccaaaagcacaccaacaaugcacugcugguuuccaaccuugcugauucgguugaaaugauccaccacacugagcagcaccggaagguggaccacugccuucugcacugccagcucugacaucuugacacacaccgcccacuaggccuagcucccugcaacccacaaacuccagcaguagcagcaacuccugugaagacuacuuaauuuuuuaaugaaaaaaaugugugugcaugggcagguaugaauuuauguauagucaugcauugcuuaaugaugggaaaaugugagaaaugugugguuaggggaacaucagaaaguguacugacacaaccuggaugguguagcuuacuacacaaccuaggcuauucgucauauagccuauugcuccuaggcuucaaacuuguacagccuugaauacuauacugaauacuguaggcaguuguaacgcaaugguaaguauuuauguaucuaaacauagaguaaaaauucaguauagaaaauagaaaugguacaucuguauaggacacuuaaccaugaacggagcuugcggggcuggaaguugcucugggugagucagugagucaaguaauagugaaugugaaggcccaagacaucacuguacauuguuguaaacuuuauaaacacuguacacuugcacuacacuaaauuuauaaaaaacauuuuucuucaauaauaaauuaaccuuaucuuacuguaacuuuuuaacuuucuaaaacuuuaaaaaauuuuugaacuuuuugacucuuguaauaaaccuuuaguuuaaaacacuauacagcuguacaaaaauauuuucuuucuguauaucuaaacuuugccuacuuuuaaauuuuuuuuuucuuuuuuuuuuuaacuuuuaaacuuuuuucuuaaauguaagaugcaaaagagaaaaaaggaaaaaaaauuaauacacaaacaaacaugagccuaggccugcacggggucaggaccaucaauaucacugucuuccaccuccacaucuugucccccuggaaggucuuugggggcagucaaacacaugaagcugucaucucuuacgauaacaaugccuucuucugguauaucuccugaaggaccugccugaggcucuuuuucaauuaacuuauuuguuguauauguagaaggugaacacuaaaauaacgauuggccaggcacaguggcucacaccuguaaucccagcacuuugagaggccacgguggguggauugagguugggaguucgagaccagccuggccaacauggugaaacucaaucucuacuaaaaaauacaaaaaaaauuagcugggugugguggcauacaccuguaaugcaagcuacucggaggcugaggcacaagaaucgcuuuaacccgggagguggaaguugcagugagaugagaucgcacgaccgcacuccagccugggcaacagagcaagauuccaucucaaaaaaaccaaaauagggugggcaugguggcuuaugccuguaaucccagcacuuuggaaggcugagguggguggaucaccugaggucaggaguucgagaccagccuggccaacagcgaaacccuaucucuacuaaaagugcaaaaauuagccaggcauggugguacgugccuauaaucuuagcuacucaggaggcugaggcaggagaauugcuugaacccaagaggcggagguuucggugagcugagguuaugccacugcacuccagccugggcuacagagugagacucugucuuuaaaaaaaaaaaaacagccuaacaaacaaaauaauaauaaaauaacgauuaaaaacuauaguauaguaaauauguaaaccaguaacauaguuguuuauuauuauuaucaaauacggguugagcauccaaggucugaaaaaucuaaaauuugaaaaucuaaaccuuuuugagcacugauaugaugcuccaaggaaaugcuuauuggagcauuuuugguuucaggauuuuuggauuuggaguacucaacuuauaagcauauacagugcaaauauuccaaaaucugcaaaaaucugaaauccaaaacacuccuucucccaagcauuucagauaagggauacucagccugcauuguguacuccacauaaucgugugugcuauacuuugauacgacuggcaacacaguagguuuguuuacaccaacaucaccacaaacacaugaguaaugcauuggacuauggauauuaugauggcuaugaagucauuaggugauaggaauuuuuuagcccaauuauaaucuuacugggccaccaucauauauguagccuguuguugaccaaacauuguuauguggcauaugucaagauuucugguagauagcuguuuuucagggaauuauuugugagccuuaaaauugguuucccuuauuccuuguuauucaucugguuaugcuaagaaauguuauauuuguuuggacgauucuuaauagacaguuucugucccuuuuuucuuugcauauuuucaacaaauaugagcaucuccuaguuuccagaccuugugcuaggccuugaggauacagcugugaacaaaacaaaguuccugucuucauagaguuuguauaagaaagauaggcaaugaacaaauauaugucaaauacugaugaguacugugauuaaaucaggguaagggauaaaaagugauauaccuaaaauguagcuuuuucauguacaccuucacaaaaaaccguaucagcauagcaugaucucaaauauguaagaaaaaaauaccaggaauaaaggcuguuaaagaaguaugcugaaauauucauaaggguuauuucugauagugagauuuagggaugauuuuuaaauuauacuuuuauauauuuuuccaaagcauucauuaccuuuauucuuuggggaaaggcgguacuaaugaggucauaagugcagcuaaagcccaguucugcuggcucauagccccuguguacaccaagaggaagaaagucaccugcaugguuucucuaaaaguguuucuggaacuccccccagcagguaucuuacgcgugaucugaacaaguugaacucauugaguccugcuuucugaacgggccucugccucaaaucaaccaugaucaguaucugagaaaguuauuugucauucaucuaagauuugucuuucugcaguguuuagacuagugcuaaauaggucauuuaugaggaaaguguagaaaaacucuuuaguaagguacuauauauucuucauauagaaguguccuuuuuaaaauuaauuuuguucacaauauaugcuucacaauauuccagucaaaucugaccuaacugaggcuauugcacacauguugugacuuguaaaggcugugggacaggacagagaaaaggcaugaagcaaauuuucagucccacaagugaaaugagcccaacucuuuuucccuugucagcagucagggagagcaucuucaccccacucaggcugugccuuagcuaccucagcaucagaaauaacaggagccgggcacguggccuauaaucccagcacuuugggaggcuuaggccggcagauugcuugaggucagagguuugagaccagccuggccaacauagugaaaccccgucucuacuaaaaauacaaagaaagaauuagccaggugugguggcacacaccuguauucccagcuacgugggaggcugaggcacgagaaucacuugaaucugggaggcagagguugcagugagccgagaucgugccacugcacuccagccugggugacacaggcgagacuccaucuccaaaaaaaaaaaaaaagaaacaaaaaagaaaaauaacaggaaaaggacagaaagaagggaaacccugaaacuaccuaugaugaggcugggcccuaggcugaggauucagcagauauguaucaaugaaaaggccaucuuuuauagcuagaauuauaggauuuccuauaacccugaacuuccaacauccucuucaggaucagaguugcugguauaucccuaaaggccugauuucucuaugcuuccacccacuccuuuuucccacuugggcuacccuuugccuacagcugucuuggugacgaaauguuuggugacaaagcaaacaaaaauaguguaucuucuuugcuccucuuuuuauguccaagauauacucauuuuuagagauacgggcacacuuuacacauucaaaugggcggauaggcacacuuuuguucuaagaauaguuugaggauaacuuuucuuuuuuuauuuuauuuuauuuuuuuugagacggagucuugcucugucgcccaggcuggagugcaguggcgcaaucucagcuuacugcagccuccaccuuccagguucaagugauucuccugccucagccuccugaguagcugagauuacaggcgugugccaccaugcccgucuaauuuuuguauuuuuaguagagacgggguuucaccguguuggccaggcuggucucaaacuccugaccucaggugaucugcccgccucggccucccaaagugccgggauuacaggcgugagccacugugcccggccugaggagaacuuuucugugccucuuugucuugccuucucuuuugcaguucuuuccuugccuuccuuuccaacuguuugcuuuguuucuuuccaucuuccuguaucaggcagcaauuccuauaaacauucuuugacguuauugguagcccuuacaccugaaugggugaagccuaucucagaguagaucauucauuccagcugaaaauguuagucugcuugguaagugcaaugugauggaagaaacaacuucucaggccugugaaacauugauuaaauauacuuuguuuguuuguuuguuggagacagacacgcucugucgcccaggcuggagugcagugucaugaucucagcucacugcaaccuccgccuccuggguucaagcgauucuccugccucagcuucccaagcagcugauauuacaggcacgcaccaccacgcccagcuaauuuuuuguauuuuuaguagagagaggguuucgcuguguuggccaggcuggucucgaaauccuggccucaagugaucugcccaccuauguuucccaaagugcugggauuacaggcgugagccacugcaccuggccuguuaaauauacuuuuguaguuacuguuccuucugccugguagccugguuucucuuccccguguuuaucuauuugguaaacuccauuucuuacucaaaagauuuuauuuaaaagcugaauguaauggcuucuuugcuccguuuccagauucacccaggcaguuagugacucccacuacagguuuuucauaccucuuucauaacccauauaagacuguuuuauuauuauuuguuuacauaucuuuuacuagacugaacuuuuucaaggguagaaauuuguaucauuuuauuuucucagacuugguauauggucaacaaauguuuguugacuguccauucuuuggauaggacuuauugccuguuuucaaggaccuuaccaucuaauaaaggugaucaauuacagguaaccaugguacaaacuagaaugccauuagugccgcagagaaggaaaaaauuacuucuugcugugggaaguagugacaccuaaguuacuccaggguuuguugaugagguagcauuugaaauaugucuugaaggaugagugugaaauguggcauuaaugguauuauauuagcuuuuuguacuucuugaugucuuuauuagcagugauuuaaguucauaggagcuauauuauuugaaauguguuccaaagccuuaccuauaaaucaucuaguuguuccuuuaccuguacuuuaccuauaaaucauuacuuuauuugcuauuacuuuaccuauaaaucauucaucaguugauuuauacaaaggaauacaucuugugggguuaucaguauacagucugucuuugugggugucagucauaaauucaggaauuaauauuugagauuguauguuuucaacugucugaaugugauuaaccaaaagaaaacaugaaauuugaugccuuggcuggguuugguggcucaugccuauaauuccagcacucugggaggcugaggcaggaggaucacuugaacccaggaguuugggaucagccuggacaacauggcaaaaccccauaucuacaaaaaacacaaaaauuagucaggcaugguggugcauacccguagucccagcuacucaggaggcugaggugggaggaucacuugagccugggagauugaggcugcagugagccaugaucguaccacugcucuugaggcuggguggacagagugagacucugucucaaaaaaaaaaaaugucuuacuguccuguuucauuuauuuucuuuauucauuuuagccacagaccccuuugcuucuguuuuugggaaugaaucauuuggagguggauuugcugacuucagcacauugucaaagguaaucuacaguaauuaaugggaagggaaaacauacuguguuuccaccaaaagaacaauccuccuuucaauuauauaguccucucacaaaguugcaacuugauuucaguaaaucacagcaaauguugauuucagauagaaaugaaagauaacauauaguuaaaguagacauauuucuuuauauaacuagacuguauugaugguagagguaauuauaauuuucuguuggcauguuugcuuaacaacuucauauuuagucuucugucuuuuuaaacauguuucucccaauugaaccacauuuucccccuguugacugucugggucaauagguguaaaaucuggguuuuuauuucguccucucuguauugguuacuugauuuuauguucugagguuguuagggccaguauuaagguaauuaauacacaaaguccaguacuaaauguccacuauuuacuuuccacuguggcugugauauugauucgggcuaagagaaaaggaggauuagauuguugguuccuugguucucaacugaggguuauuuugccaccagaggaacauuuggcaaugucuagagaccuuuuugguuuucacaauugaauaggagaugcuacuuacaucuaguggauagagaugagggaugcuauuuaauacaguccacucucuagccccccacaauaugcaauuacguccagccugaaaugucaauguugagcauuaccuaaauaaauguaaaauugugaagucugauucauuauagaaaaguuaaucuuuuguuacauauuugaaagggucuucagacacacauuaagauuuaucauuccagccaggcgcgguggcucaugccuguuaucccagcacuuugagaggccaaggcagguggauugucugagcucaggaguucaagaccagccugggcaauguggugaaaccucgucuugaccaaaaaacacaaaaaauuggucaggcaugccggcacgcaccuguaaucccagcugcucaggaggcugaggcgggaggaucacaugagcccaagaggcagagguugcagugagccuagauugcgccacuguacuccaaccuuagagugagaccuugucucaaaaaaaaaaauuauccuuuuaugggaucaguuugcuucaaaaaauugacuuucaggcugggugcaguaacucaagccuguaaucccagcaucuugggaggcugagaugggaggauugcuugagcccaggaguucgagaccagccugggcaacauaacgaaacuccaucucuacaaaauaaaaauuaaaaaaauaacuaggcguggugguacacaccuguaguccuagcuauucgagaggcugaggcaggaggaucccuagagcccagggguucaaggcugcagugagcuaugauugugccacugcucuccagcuugggagacuccugccuuuuaaauuaaaaaaaaaaaaaauugacuuucaaguuguccuuauaguuugucaagaugccauuuuccuugcauuaguauuaaaucuuauauuuaaguucauuaggacguauggaauccauuuuuuuuccuuugauuaccauuuagaucagauauucguuugcggaaaggcauacagucccuuuaaaaugggccucaggugguuuuugcauugaauauuuccugaagcuugacaaaccuuuaaucuagauugagcuguuuuugguuugaucuguuaaucuuaauaaguaaugauguuagaaucacuccucauauagaauaacuuuuuuuucagaaauuucucccauuggacccugaaugcaaagguuaaaauuucaguguucucagaauuaaaauaaauaaaacuguauaauacugaaaucauuauucugaaugcuacaugacuaccacaauuugcuugguauagccauguauaaccauuucuuuuuaaacaaaggucaacaaugaagauccuuuucguucagccacaucgagcucugucagcaacguagugauuacaaaaaauguauuugaggaaacaucggucaaaagugaagaugaacccccagcacugccaccaaagaucggaacuccaacaagacccugcccucuaccaccugguaugagaguugguacuuuucuucagucaacugcauggcuuuucucuuucugaaaaguauugugcggaacuuacuuauauaaauggcuuuaagugaaacaagucaaacauaugucagaagccugcugcugucauucauucugaccuaacugcugaauuacagacaugcacuuaagaagucagcauguauaaauuucaugagcugucuuucugcuaagaccuuuuuucuuuucuuuuuuuuaacuuaaucauuucagagaggcaaucaauggaaaagggaaagugucaagaaaaucuuuuugccuuuuggaaacucauugauuauccauuugaauagcaguuuccuguacuuugguguuuuaauuauaauuuauuuaagagaagauuguuucaaaguccuuuuccuguaaaguauaaagucuuccuuaaauccuuuaaugugagaauauauggccucuuuaguauccagaauucagcaauacagugauuugaaacaaaguauugguuuucuugaaggaaaaugguauuuuagcuaacuuaaaauauuccucuuuuuuuuuuuuuuuuuugagauggaaucucgcucuguugcccaggcuggaguacaguggcaugaucucagcucacuguaaccucagccucccggauucaagggauucuccugccucagccucccgaguaguugggauuauaggcaugauccaccaugccuggcuaauuuuuguauuuuuagcagagaugggguuucaccauguuggccacgcuggucucuaccuccugaccucaagugaucuguccaccucggccucccaaagugcugggauuacaggugugagccacugcaccuggccaagacucuuuucuaauagugauuuguuucuuauuuuuguuuguuucuauguauaauuaguauguguguguauguauauguuuagcacuauacaaaggaaaguuuguuuuguuuuuaggucauaauaaguggcuaaaaggauaauuccuugaguaguuguagugcuguugggguauuaugugagaagacacaucuuaguauauuuuuuuuuaaaucauaccucauuccuugggaaauuuucagucucaguaguuacagauuaauauugccuuuucaucauaaccuuuccauggucuugagcagauagguuuuuuuucuuugacugaaagaauugcauguacaauuguaaauauccgauaaucuguugaaaaaucagguaaaugaguuaagugauuccuucuaaggaaagguagcuuaugucauauauuucuagaagugagguuaucagaauauauuuaaaaauaaauaaugguuaauuugcacauuuaaguuuuuacaacuugcaugaugccaauagugagguuguuuuuuuaaaucuuaaguaaaauaauaugcuaguguuuuugcucaaucuaagaaucuucauccaaguaauuguauaucauuguaaaaagauuaaggaaaagacugguuuguuggaaagagcacuaaacugggagucuaaauaucuggguucuguuucuggauguucccugacuaacuaugaucuuaaguguauaauuucauauaucugacccuuggcuauuaaauguuggcaguaauucuaauuuugccuacuuucacaggauuauuggaagaauccauugagauaugagcaucuuuucuaagcagcuacagugauggaaucuguuguuaugauugcuauuaccagcuuaugcauuuuaggaaaaaaauauauuuggagauauuuugaccccuauuuuuauuaucuuuucuucaagaaguacuaaguuuaaguaagacuuagagaacuuguuugaaaaugguaaugaauuagugagugacuaauaggacagaauacuauuguuuggucagagauuauuugaucagcaaccgcaaagauuuaggcccugggcuucaaaacauuuuuucuucauuuugaaauacaguaaauaacaaaaaauuggcagcauuuuacuacgguaauuuaaaaauuuuaugcucuuagguauuguauguagaacuagagaaaaaucagaagaauuuucccaguuuucagaggucauuugcucuuacugccacuaguggauaacuguuaucaggcugagggcuguaacagcagaggcaggccauuucugucuuuauucuuuauuauucuccuucuguuuaauccauucgucucuccuuuugggaacaugcugcuuggguguggcuaggggauggugggauucagucuuuggacaaaaauaugauuccuggcccauccuuacuuugcuauuuguuucauuagcugcacauagcuggaaucuauuugagagaucaugugugaagaauuugaggacaaauuguugguguagcuauuuaagacaauauucagaauguguuuuagguacucaaucauccucuacccacaguacuuuaaugcuaucuguguacauguucuugugugcuuguauuugcuguauuuacugguugaauuaauuguaaugauuuugauccagggaaaagauccaucaacaaauuggauucuccugaucccuuuaaacugaaugauccauuucagccuuucccaggcaacgauagccccaaagaaaaagauccugaaauauuuugugauccauucacuucugcuacuaccacuaccaauaaagaggcugauccaagcaauuuugccaacuucagugcuguaaguacugugaaugagcuguuugggggagaaaucuuuaaagaguuuucagagauuauuuuggagucugccaaguuugcaucauuuuaacuaaauuuaccaagauacuaaaaaugaucuuucauucuucccccaagcaaaaccucuguuugauccuguuuugacaguucuacgguuguuccaucgcacagaugauuuuaguagucccaguucuugucauauacacaaguuguuuuguaaaucuuucucuuagucuugguaauguaaguaaaauccuaacaguuauuauuuuguggaugguuaugggugauggugauuuaaugaacaauuacagagucauugcucucugcccacuagaugaauaaugccaguaauaaguuuguguauuugcagcuguguauguguguuuguguauaaaguuuuaaugauuucuggagaccagucagcaaauauuauaugagaggauagagccagagauucuuugaauagaaaguaaaacuauuaaacuuacacaguagcuuuuuaaaaauguaaaugccaguuuuaugaaauaaauaaauaaaugguugucaggauuuaaacaaucuuuauuuggagggcccuaauucacuaacuucucauguuuacucugcguucuuucagagaugucuaaaauaggaagaucguuagaaacaguggaagggugccaugauaacagcauaagcagggccuauaaaaucacagaaauggggcaaccaaccauggagguaucagucuagagagacauaaagcaaugucauauauuccaucauuauucaguaaaaaaaguuauuuuuuaauaaaauucuuagaccggguaacaaauuuucaguuucacaguuuuuucaggcaaaauaaccuucguuaucauugccuguucuauaaaacagagauuuucuucuauuuaucaccuuaugcccuugagaugauuuuggaaauagaucuaguggccagguaacucugccuaauauuucccuccucaguguagcauugggccauucaaccaauugcuuuauuccugcagcuguuucuaguuagaagggagguagucaagaaucugcaugcaggccgggcgugguggcucacgccuguaaucucagcauuuuaagaggccaaagugcuuuaagcaccuguagucccagcuacuuggggggcugaggugguggagguugcagugagcugugaucaugccacuguacuucagccugggugacagagccagacccugucuccaaaaaaaaaaagaaucugcaugcaacuaagacgacugagcucccagcuuuugaaucuguacucuaaguucugguggcuucucuugacuaugaaggagcaaaauaggaaucaauauuuugaauauuguaaaaauggagugccagaauuauacugauuuuuuuuuuuuuuugagaugaguuuugcucuuauugcccaggcuggaggcgcgaucuuggcucaccacaaccuucaccucccagguucaagcaauucuccugccucagccucccgaguagcugggauugcaggcauacccaccacaccuggcuaauuuuguauuuuuaguagagacgggguuucuccauguuggucaggcuggucuuguacuccugaucucaggcgauccaccggccucagccucucaaaguguugggauuacaggugugagccaucgcgcccagccuuacuuaacuuuccuuuuuuuuuuuuuuuuuuuuaaagacagagucuugcucugucgccaggcuggagugcaguggcguaaucucagcucacugcaaccuccaccucccagguucaagcaauucuccugccucagccucccaaguagcugggacuacaggcacgcaccaccacaccuagccaauuuuuguguuuuuaguagagacgggguuucaccauguuggccgggauggucucgaucccuugaucuugcaaugugcaugccuuggccucccaaagugaugggauuacaggggugagccaccgcauccagcccgacuuaacuuucauuagauggaauuugauuuguuucaagcagagaaucaaaaauuggccuuuuuagaagguuauaauucucuuaguguaaaauaacccucugguaguuuguggcauuuaauaucuuaaguaugguuuuagcaagucaaacucuuguuggggccagacgggguggcucacaccuguaaucccagcacuuuggaaggccgaagcgggcggaucacuugaggucaggagugugagaccagccuggccaacauggugaaaccccgucucuacuaaaaauacaaaaauuagccaggcaugguggcgcaugccuguaaucccagcuagggaggcugaggugggaggaucacuuaagccccagaggcagagguugcgggagcugauauagugccacuguccucaagcugaguuacagagcgagacuccgccucaaaaaaaaaaaaaaaaacaaaaaaaaacaaaucugguuggaaggagucuugaacaacagcugaggcauuuugcuccaaaaucucaauauaguauaauaaaaaacagcuuauaauaagaacaucuucuuuuuucauugugaaagaugugguuaagcauuacacguuucaaaguuuugcuuaauucccuagggaaaaaaacuaccauuucaaaagccugacaguguauuuuauuucauccuuucaugaaggauuuucuauguaacaagacuugaaaccaauuagaauuuuuaauuuaguauuugccaagguugcuguuugggguagauaaaaauauuuccccaacauaauaauuaugaguguuaagauuuuauuuagacuggucuaaaaguucccaaagccuggagaaaucuucauaaugcuuuuuguuuuauuuuuauuuuuuuuggcucacuccgucgaucuggcuggagagcggugguaugaucacagcucacugcagccucaacuucccaggcucaggugauccucccagguagcuggaacuacagaugugcaccaccacaccuggcuaauuuuuuuuguaaaaacagaguuuugccauguugccaagaugaacuucuugaacuucugagcucaagcaauuggcccacacccacagaacuaggauuacagaugucagccaccaugccuggcucaaaaugcuuuuuauaaaauaugauuagguucuugggaggccgagaugggcggaucaccugaggucaggaguucgagaucagccuaaccaacaugaagaaacccuaucucuacuaaaaauacaggauuagccgggcgugguggugcaugcuuguaauuccagcuacucgggaggcugaggcaagagaaucgcuugaacccgggaggcggagguuguggugagccaagauugcuccauagcacccagccugggcaacaagagcgaaaacucugucucaaaaaaaaaaaaaaaagauuagguuuaaaucacaucuugcuuaguauacccaauacuuuaauaugauguauagcaaaaucagcuuuuuuuuuuuuuucuugcuucuuagcuuuuuuacacauuaaggguuaggaaacuaccagugggauuaaauuaaaaaugauuuguugugugagggucucaguaaaguugaagugguaaauauuuuacauuacauuaggucaaaaaggcuagcccuguccuguuuuuaaaucuucuaaucuacuauaagcauuucuacuuuuuuuagugagauauauauauauauauaucacauuuaaaaaaaaaaaauauauauauauauauauauauauauauauauauauuuuuuuuuuuuuuuucagauggaaucucacuuugucacccaggcuggagugcaggggugcauuuucggcucacugcaaccucugccuccuggguucaagugauucaugugccucacccucccaaguagcugggauuacaggcaccaccaccaugcccagcuaauuuuuguauuuuuaguugagagcgaguuuugccauguuggccaagcuggucucgaacuccugaccucaggugauccaccugccucagccuccaaagugcugggauuacaggcaugagccaccacaucuagccuaguggcauuuuuaacauuuaguuuuauagacuuucuaucuauagauugaauuaauuuuuuaaauuaaacuauagcuuaauaacugguuaauauuaaacauguuuucagggggaaaaaaaaaagaauuaacaaguaaccagacuauuuccagaguccuucagguguccuuuuguaaaaacuauuuuuccuucuuuuuacuugcuuuacucauuuauuuauucguuuguucaucgaucuuuuaaauggcaguaucccucugaagaagauaugaucgaaugggccaagagggaaagugagagagaggaagagcagaggcuugcccgacuaaaucagcaggaacaagaagacuuagaacuggcuauugcacucagcaaaucugagauaucagaagcaugaagaauucucuuguucuuuggcaacaauauaguauucuucuuccugaauacugaaacuauuuacaauguguaucaaaacuaccugugagcaugggaauacaaaagguuugagauuccuguaaaugugacaaaauuuuaggauuuuuuuuuuuucuucauuacagauucgucuuuuuuuuuuuuucuuauaaaagccguaacccagucagacaaauucaccuucacuuaggccccuguucugguauacauuuacugugagcuuuugccugccugugcuauuuuacuuguaaagcuagagcacccaagcuucugccuucuggaauauagagaaauaguuucacccugcacuacccuguucuguaguuauucugaugauagccagugagguucuuaaaguuugcaguauucuccccugauuggaaugguugagugaggguaagggaaagaauaucuuauuucuuuuaugauuggugcaaauuggcuaaagugcauuuuuaaauuuccucuacuuaauuuguuuuucagagauaaggaaaaauauuuugcacagauuuacuccacuauggaaaagggaugcuguagguugaaccauuauagccucagauucgaucuuuuccuaacuaaaaauauuaaagccucaugugugaaauaaauuuuuaaaaagauuuaucuggauuuagagaauuuuagaucaacagauaccucucaguguguuugcuaauuaauaaaaaucaguuucuuacaaauaaaguuuguaagaaaauguucauuuuaagugauagauaguggagaaaauuuaucaccuaaaauauacccaucaguauaaggcaagcaaaagucuuaacauggcagccauucugccuuugccguggcccuguccuguuuaguucuuaguggguuaauuuuuguacuuuugcagaagaaacuucagcaagcuagaacuggaagguacuuuaauuuuucauauauauuuguuuuuuuuuuuuuaaugaaggcucauuuacuugaaauguaaaaacuuucacugaauacaaauagaaaaagugauguguuuuauaucauauugcuuuuuguccaucuuugugguuuaguuuauuuacucacuucauguuuuucaccuauaaaauugucaagcuagcaaaaaaacucuuguuuuuuuaauugggagagaagagaccugccagauuaucagaccucuucauguuaaaagaccaucuccuguaaaacugaccuaguggacaagcugaauuugaaauagacugugaaguaagcuguaacuugucauuuuaauuuuguuuaacacgguuacugacuuagaugauguauuaaauaccaagauaaagaaaaaugcaccuaaaaucuaauuagaauucucugggucaacaagucaaggugguauugaucuguguuaaucugaguaacuuauugccuagccuauaaauaaauuccaaaauauccaauucauuucuucuugaaauggugcuuguuuuguuuucuuuccauuacacaauuagacuccuacaguuuaaaacaaacuuuaaaccacuaucuugcacugcuaacuuuuuucuaccuuuguaaauagaaacauuucugcauaaaagucauacauaugaagcaagggcugaaucauaaucacaaggcuuaauuuugauaaacgaauccagugaccuaaggauuuucugcaaaauuugacugggaguugugauaggugguauuuuuguuuauuuucuuccucuuacuccuuaggauaaagguaaguugacuugaacaacuuucuuuugcacugggaaaauaagcaaauguuuaaaugcuucaaaaaaauuuucaauuaaacucaaauauuaaauaucuauaacuuauaaacaccaacuuucaauguaauaaauguauccuaaucuuauguauguuuaacuggauuacauagauuuuuaucuuuuguuaaaauguguauaccccguggaccaacauaauauuaaaguauguauauauuauauaaauauauauguauaugugcucgcuuguguaggaugaaugucuuagagucguuugugguauuuuauguuguugacucuggcuccagggccugugcuugaaaaggacagauaaguauugcccagagcuaaguggcacuacuuacaaaguuuuaaaugucuucuacauacugauucauguuuauuugagcucucuuuauagaauuuucucuuaaaguuucaaaccucuaaguuguagccuguaauuaugagaacaguaaacuuuaaguaauaauaaagaaucccauccauauauccaauuugcaauugaguuuugcaugguucucugauuauguccaugcuguguccaaggaggaguagguacauacaaucagcacagauuaauauauguaaaggguuugggacagcaccugguauagaauaaauaauaaauguaaacuauua

SEQ ID NO: 191394 - RNA, 45043 nt, Homo sapiens
gacagggccgcggacgcccgggcagccacggcggcggggccgcggcgggcgccggcucagcccgccccuuucucccgccgccuccccgccccgccccgcgccgcgccggccgcugucagcucccucagcguccggccgaggcgcgguguaugcugagccgcugccgcagcgggcugcuccacguccugggccuuagcuuccugcugcagacccgccggccgauucuccucugcucuccacgucucaugaagccgcuggucguguucguccucggcggccccggcgccggcaaggggacccagugcgcccgcaucgucgaggugaggcccgggcagcaggcgggcuccuuggggcuugacgggaugcgggccggccugucccgccgccccuaguccgcgccccgcggagucgccgagccgcagacuacgagucccggcggccaccgcgccgcccgcguggcaguggccgagggccgccggcgcgcggcgugccgggacuuguaguccgcgcccgcccgccuugggggccaccgcuugaggucgcuuuguuccugcgccccuucuuuucuuacauuuuggggaccagauucgucucuagagugggcugggagagggaucccggaggccaaccuuugggggucccccagcgcgcagagguuagcgugucgcugaucguguggcaggugaaggcagcaggagcgcggauuuggguuagaggccgugugcgcccacaguugucugaaggagagaccuauuuuucuucuccgcgccuucccucugguucccuaaacuccgcacugucaccgaacgugucuuuacucuagaaaggaggcccguggggcgggguguuauuuuaggcgugcugugggcugccgcuggcacucucgagccccguccccgcaagcuuuagggcggagccagcccugaggcucggcccgggucggggauggggaaagccgggagugcuguucugagaucaagcuucaaccuuuggcccugcugccaacucacgcucggcccucggucacuuccugucucccagccucaguuagcccuuguaauacaguaaaaagagucucugaacccagauuuucucaggauauaaaacaccucccaaauguaaaaugcuguuacuuuuuuuucuuuugcuuugagacagguuaccaguucaauucuuuuaacaauuuuugagcuagauguaugguugguuagcugcauugacacugugggaaaaaaaggcuucauggacaaucuggggaaugcuugggaaagaaggaaaacaggauaucuagaaacagaagaggcgaccauugguggccucuagugaaaucacucugaaacccuguaaccaacaaaaguuuuuuugaccuagaacuuauaauuuccuccucuucuaggauauggccaauauuagcauggggcuuuugcuucucuccuuauauguucauaacaaucaacuccuguccuguauuuuauucccuaaauagcauccagagaaaguuagaugaguucaacaagucauuauguguuggacagauguauuuauaaauauugaucauuuugccaggcgcuguggcucacuccuguaaucccagcacuuugggaggccgaggcuggcggaucacgaggucaggaguucgagaccagccuggcuaacauggcgaaacguugucuuuacuaaaaauacaaaaauuagccuggcgugguggcgggcgccuguaaucccagcuacuccgaaggcugaggcaggagaaucgcuugaaaccggaaggcggagguugcggugagcccauaucgcgccacugcacacuagccugggcgaaagagugaaacuccgucucaaaaaaaaaaaaaaaaaaaaaaucauuuuaggugucaaaguggaacuaguccaacuaaaaaaauacauaacauuuacauccucuuaaaaaaauuuuuuuuuguugguucucuuucuuuuguuguuuuuuuguuuuuguuuuuguuuuugugacagucucacuccgucaccaggcuggagugcgguggugcgaucucagcacacugcaaccuccgccucccagguucaagcgauuuuccugccucagccucugcauagcugggauuacaggcgugcgccaccacgccuggcuaauuuuuguauuuuugguagagacaggguuucaccauguuggccaggcugaucucgaacucuugaccucgugaucugcccgccucagccucccaaagugcugggauuauaggcaugagccaccgugccuggccuugucacuugucuuuuaaaaaguaaagagacuggcugcugcacuccagccugggcgacagagcgagacuccgucucagaaauaaauaaauaaauaaauaaauggcaagugaaaagugggagugauuucaaauuuuuguuuaguauaugugaucuuucuuaaauagcaugaugggggaaggggcaaagacuuuagagucaaagagauauagguucaaacccugacucugccauuuacuguuucucuaggcccagagauguuguugccuuuaguucccugugaaaagggaaaacauagaaauggcuguuuuguaugguauuugugaauauuaaaugagguaaaauaucuggcacacagagacagaugcagauaguuuuuuucuccacuuuaaacuucugaucuuauuaccucuacuuuaaacuuccugaucuuauuauauugguuauuuuuauugguggguuuuguuguuguuguuuguuuugagaucgagucucucugugucacccaggcuggagugcugugguaccaucuuggcccacuccaaccucugccuccugggcucaagccauccucucaccucagucucccaaguagcugggaugacaggugugcacugccacucucugcuaacuuuuuuucagguuuuuguagaaaccagggcucacuauauugcccaggcuggucucgaacucccagacucaagggaucuuacugccuuggcuucucaaaguguuggcauuacaggcaugagccgccaugccuggccugguuauuuuuauugcaaaauaguauuuuucuuuuaaauuacuuuaugcguguuauauuugaaugcauuuaaauacaguaugcuguuucugaaucauaauaugccuuuaaaauaucuguaccuaaauuaauaauacccauacuacuacacugguuaaaaaauaaucuacacauucagggcugggcgcaguagcucacgccuguaaucccagcaguuugggaggcccaggcggguggaucacgaggucaggagauugagaccauccuggcuaacaaggugaaaccccaucucuacuaaaaauacaaaaauuagccgggcgugguggcaggcgccuguagucccagcuacuugggaggcugaggcaggagaauggcaugaaccggggaggcggagcuugcagugagccaagaucacgccacugcagugcagccugggugacauagcgagauuccaucucaaaaaaauaaaauaaauaaauaaauaaauacauaaaugaaauaaucuacacauucugcaauuauucuuuauucuguucaguaauggcaaauaauauuuuaaacuuguuaauuaucaguuacaagauuccaugaugagauauguucuguaauguauuauauuauuaagauuucaacaauuauuugaccuuaaacuguuaucuucuuuaaugaaaaguauucucuugagucuaguugccauaaacuuuauuaagcugucaaucaacuaauuccaaauaguuuauaauuuagcaauugcuauucccuagcuggcuagacagacacuggaauaucuauuuuuuuuuuuuuuuugagacgaagugucacgcugucggccaggcuggugugcaguggggcaaucuuggcucgcugcagccuccaucuucuggauucaagcgauucucugccucagccucccgaguagcuuggacuacaggugcgcgccaccaugcccggcuaauuuuuguauuuuuaguagagacgggguuucacuauguuggccaggcuggucucgaacuccugaccucgugauccacccaccuuggccucccaaagugcugggauuacaggugugagccacugugcccggccuggaauaucuauuguuagugaagucagcgguauguuguuuuuuuccuuugugaaucucuuuauuuugacucaauauuuuuuuauacaggcaauuauaaacuaaauuccaaaauaauguaaguuuuggagguuuuuuuccuguaggaaaaaaauuacauaaauccacgguaaauucuccaauuaaucuggcugaagcuaaugcagcucacagggcaccugaaauuguuacuuuaguauguugauuuccaacucaggcugccagaaguacauauuugaguccuagcuacagaaucuucaguugacaggaagagaagaaaaagagaaaaccaaaaacccuuagggauaucuugcucucuaaggcacugaaauuagugaaguggguauuguuagagggaagcugguauuuuuucucuggaggugaauucugcucugcaaauugcuccuggagaccuagagaagguaaaggcaaaucugauacagugucuucugagaguguucuguacugggaaggaaagauuggagggagguuuugggauugauuuugcacauuuauuuguacugauguuuuucaguuuuguuugcuuuucuccuuccuuccuuccuucccucccucccucccucucuccuucccucccucccucucuccuucccucccucccucucuccuucccucccucccuccuuccuguucuuucuuuuucuucuuuucuuuuuuuuuuaccaaauacccagacuuggagaauuuguuuuauuuucuaauuguuuguaaaucuguauccucuaauacugaauuuguuuuugaaaaugagcuauuuucuaaaucagugugauacuuagaguuaaguuuccagaauggaauuauugugcaauaauuuaguuauaaaaucaugaugggaauacugugucauucuugaauuuuuaaaauuaagcuuuauuuauauuuguuguuuuggcccaaaugaaauuaugucaauguaaccuaaauuuauauuugaaaauaaccaccauuuuacaugcauuaguuggaagaaauauuuaaaccucucuuuuaaagauugugaacauuuugcuuacauaaacaaauuaugacuaaagcuuauaaccaugccaaauugcuuucuguagcacccagaaaacuuuuuuuuuuuuuuuugagagagggucucacucuguugcccaggcugaaguacaguggugugaccucagcucacugcaaccuccgccuccuggguucaagagauucuccugccucagccucccaaguagcugggacuacagacacaugccaccaugaaugccauguuggccaggcuggucucgaacuucugaccucaggugauccaccugccucagcuuccuaaaguacugagauuacaggcaugagccuuugcgccuggccucacccaagaagcauuuuaucaucugugucaacuuccuccagggccuguguggguaacucuuacuuugccuggccauccuacuuacugcacuuagaaaaaguuuuggaugauaauugacuuuaagcauauauaaaucagaaacuugauuucauuuaucuuuguguccccaguguugaacauugugccugacacauaguaacugcuuauuaagcacuuauugaauuauaaguugaauacguuggauucauagaguuuauuguuuguccugaagauguaaaauuuuuaaaaauucgauccccagagggcgcuccaguggcaguuggcucucccauuuuaaggaccagaaguguuugaaugucuuccucugauuucuuuuucuuucuuccuuuccuuuuuuuuuuuuuuuuuuuuuuuuaagacagagccuuacucugucgcccagacgggagugcaguggcaugaucucggcucaccgcagccuccgcuucccggguucaagcgauucuccucccucagccuccugaguagcugcaauuacaggcacccaccacaacgcguggcuaauuuuuguauuuuuaguagagaugggguuucaccauaauggccaggcuggucucaaacuccugacuucaggugauccgccugccucagccucccaaagugcuggaauuacaagcgugagccaccgcauccggcugcccucuucccuccccuccccuucccuucccuccccuccccuccccuccccuccccuuucccuuucuuuccuauuuauuuauuuauuuauuugagaugagcucucccucuguugcccaggcugcagugcaguggcacaaucguggcucauucucacugcagccuccaccucccaggcucaacugaucuuuccaccucagccucccaaguugcuaggucuacaggugcaugccaccaugcccagcuaauuuuuuuuauuuuguagaaauggggucuccccagagcaagacuccgucucaaaaaaaaaaaaaagagaaauggggucucccuauguugcacaggcuagucucaaacuccuggauucaaacgauccucccaccucagucuccaaagugcugggauugcaucguaagccagcguacccagccugucuuccucagauuucucauguaacacuuuuguuuacucucaaugaaugaaucaaugauaugguugugaaaaucugcugagcagauuuccaagcuccucauuacaaauucucaaacagagcagcauucagaagaaacuagauaggaaaauccacuggauauuaagguccaguguuuaagaauaugcuucuuuccuucugguggaauaauaauuuuuuuuuuuucgaggcagaguuugaguugcccaggcuagagugcaguggcacgaucuuggcucaccacaaccucugccuccuggguucaagcgauucuccugccucagccuccugaguaguugggauuacaggcaugcgccaccaugcccggcuaauuuuguauuuuuaguagagacgggguuucuccauguuggucaggcuggucucggacuccugaccucaggugauccgcccgccucagccucccaaaguguugggauuacagguaugaucuaccaugccuggcaaauuuuuucuuuuuuaagaaaguuuacauuaucugguccacaggauacuugacucuucagaagcaccacuguuugauuaagggugcuuaugacaugggauuuuuguuaagaacuuggaggaggggagaucuucagauuauuuacugcccuuaauuuugaaaacuuucauuuuuugccuuuccauuuuaaguuauaagaguaacacaugcccauagggaaaauguuacaucuuuucuaauccugagaucaccaguaguaacugcuuguuaugaacugcuuucccaucucuuucucaauguucuugugaacaaaaaugcaaauauuuauauuuuuuaccuucaagugagauuaguguauuuuuugcugacuguaucauagauauccuuucaguucuuuaccuauagauuuaauucauuuguguuuuuuuguuuguuuguuuguuuugagacagagacucacucagucugucacccccaggcuagagaaccuuggcacucucuugucucacugcagccucugccuuccagguucaagagauucuccugccucagccucccaaguagcugagauuacaggugugugcuaccacgccuggcuaauuuuuguguuuuuagcagagacaguguuucauuagguauuucuuuauagcagugugagaauggacuaauagagucuacuuuaagauuuuuauuuuuauuuuuuauuauuuauuuauuuauuuggacagagucuugcucugucgcccagguuggagugcaauggugugaucucggcucacugcaaccuuugccucccagguucaagcgauucucaugucucagccucccgaguagcugggauuacgcccagcuaauuuuuuaguauuuuuaguagagacaguuucaccguguuagccaggauggucucgcucuccugaccucaugauccacccaccucagucucccaaagugcugggauuacaggugugaaccacugauccuggccaauuuuuauuuuuuggggacagggucuugcucagucccccaggcuggaguauaguggcucuaucacugcucacugcagccacuuggcucaagcgauccuccugccuuauccuucagaguagcugggacuacaggcucacaccaccaggccuggcuaauuauuuuuuauuuuauuuuuuugagauggagucuugcucugccacccaggcuagagugcaguggggugaucucggcucacugcaaccuccgccuccuggguucaggcaauucucuugccucagccucccgaguagcugggauuacaggugccugccaccacaccuggcuaauuuuuguauuuuuaguagagacaggguuucaccauguuggccaggcuggucuugaauucuugaccucaggugaucugcccgccucggccucccaauuagccaggccuggcuaauuauuuuuuguaaagacaaggucucacuguguugcccaggcugguacucacucgacugcuucaaaugcuaaucucuuccggaaauacccucacagaugauaauguuuaccagcuaucuggguaucccuuaauccagucaaguugacaccaaaaauuaaccaucacaaacauuauuauauuucuaucaaaaguauaugaauaucaucuuggaagauuauuuuaauuuuuacaaauuuguuaaucuauuuucugagauuuuugagaaucuuuuccuuuuucucuuuuuucuuuuuuuuuuuuuuuuuugagacagggucucacucuguugcccagccuggagugcaauggugccaucucagcucacugcagcuucugccucccggguucaagaaauucuccugccucagccucccaaguagcugggauuacaggcacuugccaccaugcccagcuaauuuuuguauuuuuaguagagaugggguuucaccauguuggccagguuggucucaaacuccuggcuuugugauucacccgccucagccucccaaagugcuaggauuacaggcauaagccacugcgcccggcaauucuuuuuuuaaagugaaauggcauaauuaaccauuuguauuuuuuuuuuuuuuuugaaacggaaucuugcucugucgcccaggcuagagugcaauggcgugaucucugcucacugcaaccuccgccucccggauucaagcaauucuugugccuccacuucccgaguagcugagaauacaggcacaugccaccacacccaguuaauuuuuguauuuuuaguagagaugagguuucaccauguuggucaggcuggucuugaacuccagaccucaagugauccaccugccuuggccucccaaagugcugggauuacaggcaugagccacaaugcccggcccucuguguauuuuuaaaaaauauuuuccuggccgggcgcaguggcucacaccuguaaucccagcauuuugggagccaaggcggguggaucaggaggcuguaaucccagcuacuccggaggcugagguaggagaaucgcuugaaccugggaggaggacgucguagugagccaagaccacaccauugcacuccagccugggcaacagagugagacuccgucucaaaaaaaaaaaagucucaaaaaaacccacaaaacuucccuguacuugucauuuauucagaaaacauuuuuugagagccaggcacugugauauugguuguugaguugagucagaagacgcagauuggccaguugcaguggcucaugccuguaaucccagcacuuugggaagccagggugcaagaauuacuugagccaaggaguucaagaccagccugggaaacaucaaaagcccaucccugcaugguggcgggcgccuguaguccagcuacucaggaggcugaggcaggagcauggcgugaacccaggaggcggagcuugcggugagccgagaucgcgccacugcacuccagccuggaugacagagagagacuccgucucaaaaaaaaaaaaaagcccaucucuacaaaaaauuagcugggccugguggugcgugccuguggucccaguuacuugagaggcugaggugagagaaucaccugagaaagagaauucaaggcugcaauaagacaugaucacgccacugcgcuucagccugugcaacagagcaagaccaugucuuaaaaaaaaaaaaaagacgacagacccugcugccaaaaguuuacaauguagugaggaaacaaggaaauuaauuggugaugacuacaggauagaaugauaaauccuaugauauaaauauaccaaauaucccauuuagggacguuuagggaagggacaucuaaaugucaauuuaaugagucagggagggcuucccagaggaggugauguguaugagcucaauuuugaaggacagugggaaagaagcaguugggagauggaaaaacgcuuagagcaguuauccuuguauaggguuacugaaggauucaauucugaguaaagugugagaggguaaaccgacauacgugaggcugacucaaaaaacacucccuugaaugcaaacagauaugaaagaacuuugcagguauuaaaguucaacuguaaauuauuauuauuuuuucuuuuuuuuuuuuugagauggagucucacucugucacccaggcuggaaugcaguagcacagucuuggcucacugcaaccuccacuucccggguucaagcgauucuccugccucagccucccaaguagcugggauuacaggcacacaccaccauaccuggcuaauuuuuguauuuuuaguagagaugggguuuuaccauguuggccaggcuggucucgaacuccugaccucaggugaucugccugccucaccuuccacagugcugggauuacaggugugaaccaccaugcccggccuaacuguaaauuauuucaaaauuguuuaucuuuuaguuuugccucccuaacuagaguguaaugucuuuaaggguggggacccugucuuuucccucucauuucacuacacguuuuucauuuauuuauuuauuuauuuuuacaaggacucuggcucuguugcucaggcuggagugcaguggugcgauauuggcacauugcaaccuuugccuccuggguucacgcgauucuccugccucagccuccugaguagcugggauuacaagcgugcaccaccaugcccggcuaauuuauuauauuuuuagcagagaugggguuucaccauguugcucaggcuggucucaaacuccugaccucaggugauccgccugcuucagccucccaaagugcugggauuacaggcgugagccaccacgccuggccuucauucuacuacaugguuuuugaaaugccuuagucauccuucagaucuuagcuuaaagacucucaaacguucucaguuuaugaugcccuuagugucucaguuuuuuuuuuucauagaaacucuagugcaaaagaaauaccuaacagcuauauuaaguaaguaauuaggucuaaacaauacuuaagaaguauuuucuaacaaguuaguagcuguuugaagaaaugauacauagaaauuaggauaaaaaauuaggagaaaaaaaguagcaauuuaauuucuuuuuuuuuuuuuuugagacagagucucacucuguugcccaggcuggagugcaguggcacgaucuuggcucacugcaagcuccaccuccuggguucacaccguucuccugccucagccuccuaaguagcugggacuacaggugcccaccaccacgcccggcuaauuuuuuguauuuuuagucaaucuccugaccucgugauccccccaccucggccucccaaagugcugggauuauaggcaugagccacugcaccuggccuuuuuuuuuuucuuuugagauggaguuucccucuuguuguccaggcuggagugcaauggcuugaucuuggcucacugcaaccuccaccucccagguucaagcaauucuccugccucagccuccuaagcaguugggauuacaggcaugugccaccaugcccagcuaauuuuguauuuuugguagagauggggauucaccauguugguuggacuccugaccucaggugauccacccaccuuggccuacuaaagugcugggauuagaggugugagccacaaugccuggccuuuuuuuuguuuuguuuuguuuuugagacagagucucacucugucacccaggcuggagugcaguggcuccaucuuggcucacugcaaccucugccucccggguucaagagauucuccugccucagccuccugaguagcugggacuacaggugcccgccaccacgcccggcuaauuuuuguuuuguuaguagagacgggguuuuaccauguuggccaggcuggucucgaacucaugaccucgugauccgccagccucagccucccaaagugcuggccucccaaaguggcucccaggcaugagcuacugcgcccagccuaauuucauucuuaaguaaccacacuuacuaaugaaauguauaugccuguuguguacuguuucucauacgcuggaaucauauuggacacuuccaccugcauuucuuauuaauuuuaucucccugucucuuuucuuucucucucucuuuuuuuuuucuuuuuugagucggaguuucacucuggcgcccaggcuugagugcaauggugcgaucucaacucacugcaaccucggccuccuggguucaagcaauuguccugccucauccucccaaguaacuggcacuacaggugugcgccaccaugccuggcuacuuuuuauauuuuuaguagagacgggguuucaccauguuggccaggcuggucucgaaccucagaccucaggugauugccugccuuggccucccaaaaugcugggauuacaggcaugagccaccgugcccggcccguuuguuugccuuccucucccccuccccaucucuccuccucacuccucuccccucuccuccccuucccuucccuuccccaagugauucuccugccuuagccucccaaauaacugggauuacaggcgcccgccaccauacccggcuaauuuuuguauuuuuaguagagacggguuucaccgcguuggccaggcuggucuugaacuccuaaccucagaugauccacccgccucggccucccaaagucuugggauuauaggcaugagccauugugcccggccuauuuuauuuuuuuauuuucuuucuuucccuuccuccuucuguuccuccuuucuucccuccuucccucccucccucccuuucuuccuuccuuucuucuuuccuuccuuccuucuuuccuuuuuuccuuccuucuauucauucauucucucauucauucacuuuguugcccaggcuggagugcaguggcacaaucauagcucauugcagccuccaacuccuggacucaggccauccucccaccucagccucaugaguagcugggacuacaggcacaucacaccauaccucucuaauguuuaaaauucuuguagagagagguuucauuauguugcccaggcuggucuugaacuccuggccucaagccauccuccugccucggccuccccaaaugccgagauuacgggcaugagcugcugugccugucccacauuaauuuucaugugauacuuguuuuuaucacagcaauagcccauaaaaucagccucacaaagauaugauguaauugaaaggaaugugccaugaucuuuuuguuguuguuguuuuugguuuuuguuguuguugagacagagugucacucugucauccaggcuggagugcaguggugcaaucucagcucacugcaaccugugucucccagguucaagcgaaucuccugccucagccucccgaguagcuaggacuacaggcaugcgccguuaccaugccuggcuaauuuuuguuuauuauuaguagagacggcauuucaccauguuggccaggguggucucgagcaucugacuucaagugaucugccugucucagucucccacagugcugggauuacaggugugagccaucgugcccgguccaugaucuuaaguugaaaauuaacuaucuuguguucacuuagugucacauugacuauugcuguguuuccuuuaaaaaauuaaacccagggcacuauugugaauuugcuguaccacauuccaguuuagaugcuaaugcaaaaggauuguaaucacugaagaccuccaaaagucacguaggaguacaguauuuuaacggguagcuuucugaauugaaauccagaggauuagagaaaucaaucuaguagugggacuuuuuguccagguaagagagagaaaggauggggacucugcugggaguauagagacagcacauauauuuugaugucuuauuuuuuuguuucauguuggccuagucacacugauucuuacuaccuuaaagcuaauacuuuuagcccaauugccauaugaaaauguguuugcucuuacauuuuaguugcuuuaaucugacaaauuaagaacauuuuuacagacuaaacaugugauaagagcauuuagaacuuuaauagggaacaggugugacagacauacuguuugcugacaguuuuaugcugccuggugcguaaaguuaacaaaccaucacuuugguaaaggaaaaagcaccaguuguuacuuacuagucucagaggccuucacuuugagggacuggguccuaugaaacauguucuuccaugccugguuuccaucagucuucuccagaagacccauaagcugguuccauuccccguuggaauguauccuaugucaacaagcaauugaauaugccuaauuuggggcuacacaaaagucuguuuccauacccacuuuguguuuggagcuuccagaauguguuagucauugauugguauuggaaaauguuacauguuuaauuuaacccacaagcuuuaccuguauaauuauguaugauuuaguuagguaauaacaugaauuuucauuuucuuggugccuacugggaguauagagacagcaaagauguuuugauuguauaauuggguguugacuuaaugguuaauuuagguuuucaaauagaguuuuuccuugcuauguaucauuugaagggcaagggaagugaaaaguggaaaugguaauguuucagaaguggggaaaggcaaggaggaagcaaaggaagcaagaaggauggucagaaucaggcugaaucaaggugggucaaauaugccuagcuuucuguguguggauaaaguuucugaucucaucugcaagccaggacauaacaaaaugaucaacuuugaguuucuucuuuaacucccaccaguagauucuguuauucaauggccauaguagcuugaagacgaaagacugcaucuccauaugggucaccuaggaauuaccucagaggccuguuguggaauaauagaguuauugagagugaggagaccuggauucaagugccagauuucuuuccaguaacuggcaagucagcuuaucucaauuuccccuuuuguaaaacgaagcguauagaggaguagauggucuuaccagcuccaaaacagaucuguaccucaaaacuucuguguuagauagcauauaacccaauauagucacacccaaaaggcaaaauauccaguuacuaugaauaugugugccuucuuugcuauucuguagcguacgaguuggagcaccaaggaauuauguuuaauaaauuccuuuauuucauguucaucuagaacuucacagugguaacauugcaccuauaaaguugagaaaaggaaagcuuuuugaaauguaacaguugcuuguguguauuuuuaauuaaaaaauuuuaagaaaugugcuauuagggccaacuuucuaaauguucuuguuuguuuguuuguuuguuuguuuuggagacagggucuuguucuguugcccaacuuucuaauuuuucuuuuuuugagacagggucucgcucuguugaccaggcuggagugcaguggcgcaaucucggcucacugcaaucuccgccucccgguucaagugauucuccugucucagcuuccuaaguagcugggauuacaggcacgcgccaccacgcccagcuaauuuuuuguauuuuuaguauagauggaguuucgccauguuggccaggcuggucuaaaacuccugaccucaagugauccgcccaccucggccucccaaagugcugggauuauaggcaugagccaucuugcucagccuuauuauuauuuauauagaaacagggucucacugucuugcccgggauggucucgaacuacuggguucaaacagucugccugccucagccucccaaagugcuggaauuacaggugugagccaccaugcuccaccuacuguuuuuuuuucuugagacaggaccuugcgcugucaccaggcuggagugcagugacaugaucauggcucauugaagccucuacuuuucgggcucaggugauucucccaccucagccuacaggcacaagcuuguagucccagcuacuuggggccaauuuauggguugagguuggggaggggguguuguuuugguagaggugggguuucaccauguuaccuaggcuggucuugaacucuugggcucaagugaucugccugucuuagccucucaaagugcugagauuacaggcaugagccacugugcccagcuauuuugguugcucuuauuuaaaguagagugugcguacauuauagaaaaauuggaaaauacaggccaggugccguggcuuaugcccguaaucccagcacuuugggaggcugaggugggcgaaucacgaggucaggaguucgagaccagccugaucaacauggugaaacaccgucucuacuaaaaaugcaaaaaaagaaaagaaaaaauuagccaggcgugguggcacgcaccuguaauccuagcuacucaggaggcugaggcaggagaauugccugaacccgggagggcagagguugcauugagccgagaucacgccacugcacuccagccugggcgacaaagugagacugucucaaaaaaaaaaaaagaaaagaaaaauuggaaaauacagaucccccacccuucccuagcuccugguaaguucuaaucuacugucucuacgaguuugccuauuuuagguaccucauauaaguagaauuauaugauacuugucauuuugugucuggcuuauuuuacuuaacauaauuuuuguuuguuuguuuguuuguuugugacggagucucgcuuuguugcccaggguggaguucaguggcacgaucucagcucacugcaaccuccgccucccagauucaaugauucugccucagccucccaaguagcugggacuacaagcacaugccaccacgccuggcuaaauuuuuguauuuuuauuagagaugggguuucacuguguuagccaggguggucucgaucuccugaccuugugauccaccugccucgagcucccaaagugcugggauuacaggugugagccacugcgccuggcccauaauguuuuuaagcuuccuccauguuagcauguaucagaacuuccuuuuuauggcucaauaauguuccauuauauguaugcagcacauugugcuuagucauucaucuguugauggacacuuagguuguuuccaccuuugguuacugugaauaauacugcagugauugguguucaaguaucuguuugagucuguuuucaguucuuugggguauauacauagaaauggaauugcugagucacaugguaauuuuguguuuaacuuguuaaggaaccacuaaacuauuuuccacaggagcugcaccauuuuacauauccaccagcaguauacaaagguuccaguuucuccacaucuucaccaauguuuauuuuuuuuguuuuuguuguuguuuuuaaaauuauagccauucuaguaggugugaaggguuuuuuguuuuuuuuucuccucagaauagugcauuuaaaaaauugucuuuggccggguguaauggcuuacaccuguaaucccagcacuuugggaggcuaaggcagguggaucauuugaggucaggaguugaugaccagccugaccaacguagugaaacccugucucuacuaaaaauacaaaaaaugagcugggcaugguguugcacauccguaaucccagcuacuagggaggcugaggcaggagaauugcuugaacccaggaggcggagguugcagugagcugagauugcgccacugcacuccagccugggcaacagagugagauuucaucucaaaaaaguaaauaaauaaaaauaaaaagaugucuuuuaauuggguuauauaucuucuuaucgagcuguaagaguuuauauauuucaaagauaagccccuaauccagauguaugauuuauaaacauuuucucccauccugugggcugucuuuuauuuucuugguagugguauuucuuuaaaguaaaauguuuuaaauuuugaggagaucuuacaucuuguacaauagaacauccaguaugcuuucuauugccuauggugcagagauuaaaaaggcugauaagcuaguccaaaacuacaaaaauaaagauguaacugguaucuauauagugccacgaguugggagugggaaagagacgggguagugguaaauggaaaggaagguggggagggauagggggucacagauucucauuacuucuuugaccaguucaagggcauaauugaguucaaguuaauuaaaucagauuagugggaugcccauuaagcaaaaagucaccuauuuuguaaaugguuuucagugcuuuuucuauuguguagucaugacaggaaaaaaauauggaaaaauuuuccauaagauuaccacuucuuaggucauuuuccuugaugaaguuaggcucuaaucaagaaccaagaggcccauguagucugcuguacauuauagaaauggguacaguuauuuauggucaucauuaaaucccaugcugggcugugguuugauugcgauauuguuuaaaaauguauuaucacuaaacugacuuuaauuuuagauugagcaaaauauacuuaugaagguaaauuuuauaccaaaauuuaaaaaaaauuacuacuuuucaagccaaaugaugauuucucucacacuucuauuagcacagguuauuggaguaacaaugaaggugauucuuuguuaucuaagcagugauugauguuuuucuaaaaagucaauuaagagagguuacuuggcacaauaaaguuaugaaagugcuccaauggguuauuuuggagacuaagaguaguaugcuuauauugucuaugccauagaaguggcauuucuagaauaucuugcuuauaauuuuaaacucaaaugucuggaguagagcuucauugaaauauguuuccuuuuaaacuuuugcugcuguaccuuauggauccucucaacugaguaugucucuaaauuuccuucuguuucuaggcuauaaaacuggacuguuuucuguccccuguaacucuucaugcccaugcaguguguuucuguguuacuauauuauacuuuuguuucuccuuuguuuaaggaguggaucacuuuccagaaaaauuuuuaucuaaacacuugaauugauuuuuguauuuagagcaguucaccaauaugucuccagagcugcuauucucuaucaugauuuaguuuuaaauuuuagauaaguuuuugauugugcagguacuguuucccuuuuuuuuaauaccauauggugguuuuuauauugggauucuuauccuuacuucaugugagacaacugaauuuuauuuugcugugcucuuaggauuugauguuaauaaaacauuuaaaucaucagucuuuccuugugauauuuaccuuuuguuuugagauggagucucacucugucacccaggcuggagugcaguggcgugaucuuggcucacuucaacuucggucucccagguucaagcaauucuccugccucagccuccugaguagcugggauuacaggcacccgcccccaugccuggcuaauuuuuguauuuuuaguagagauggcguuucaccauguuguccaggcugggcucgaauuccugaccucgggugauccuccucccuuggccuccuaaagugcugggauuacaggcgugagccacugcgccucgccugauauuuacuuuuuaaagauguauagguugggcaugguggcucagucuuguaaacccagcacuuugggaggcuaagguggaaggauugcuugagcccggaguuugagaccaguuuagacaacauagugaaccccaucucuacaaaaaauaaaaaaaugaaaaaauuagccaggcaugauggcaugcucguagucccagcuacucgggaggcuaaggcggcaggaucacuugagcccaggagguaaaggcugcagugagcugugauugugccacuguauuccagccugggcagcagagcaagacacugccucaauagauagauaaagauguauggauagugcauacuuuuuuaaaacuaaaauuuuuaaaguuuauauguauauguguauauuguaaaaaaaauucaaacaauuuuggaaguacacaaaguaaaaaaugaaaguucucuuuaaucucauccuacccuccuuauguaaucacuugucagguuuuugcgugcgugccuuucuggauguauuuguacucagauauaaugcacauguguaugcacauacacauagugcuuauuguuuugugacuugcuuuuuuuuuuuuuuuuuuugcuuagcaguguaucuuggagagcguuccauaucggaacauacagauaguucuacuucauaauaugcacaauaguuuacuuagccauuccuauauugguggaaguuuagauuuguuuugguggacauagacauuuguuuacaaaagacacugcuguaaacauucauguacauaugucuuugugcacaugugcaacagugccauaacuccuagaaauggaauuacugagucaaaguuugagcaaacuuaaacuuggauugaauaaacuuaaauaauuugcccaagacugaacugauuuauacuucuaugaaguaugaagauacugguuucuccauauucuuaccauugcugaauauaacauuuuauuuuauauuaauuuuaugaacauuaguuuuauaaaauuuuuacuuuuaauccaguggaaaauggaaucacauugucuuuuuuuuuugagauggaaucuuugucgcucagguuggagugcaauggcaugaucucagcucacugcaaccucugccugcuggguucaagcaauucucccgccucagccucccaaguagcugggauuacagacacacacugucaugcccagcuaauuuuuguauuuuuguggagacaggguuucgcuauguuggccaggcuggucuugaacuccugaccucaggugauccgccugccuuggccucccaaagugcugagauuacaagcaugagccaccaugcccagucuuuuuuuuuuuuuuuuuuuugagacagagucucacucugucacccaggcuggagucagugaugugaucucugcucacuucugccucagccucccaagcagcugggacuacaggcaugcaccacuaugcccagcuaauuuuuguauuuuuaguagagacgggguuuuagcauaucggccaggcuggucugaaacuccugaccucguaauccacccgcuucagcuucccaaagugcugggauuacaggugugagccaucaugcccggccuuuuuuucuggggggacagagucucgcucuguugcccaggcuggagugcaguggugcaaucuuggcucacugcaaucucugcuucccgaguucaaaugauucucaugccucagccccgcaaguagcugggacuacaggcauguaccaccacaccuggcuaauuuuuguauuuuuaguagagacaggguuucacuauguuggccaggcuggucuugaauuugaccucgggugauuagcccaccucagccucccaaagugcugggauuacaggugugagccaccgcgcccagccagaaucucuuuauaugcaauauauaguaucccaucaccuuuguauagugaaaauauuuuccuccaggcuguuacuuauuaucugauuauacuuaugaugccuuucuuuguucaaaaguuuuuauuauuaauguggucaaacauaaauccuagcuguuuugguucuuguuuagugccaagcaagaugucuuuuccuaucucaguuuauuuuccucuaguacugucauaggguuuuuacuuguuuuguguuuuagaacuuuaauucaccuggcguuuaguuuuguuguaguguaaugcagagaucuaauuuuauuuuuucccagauggauagccaguugcacaaguaucauuuacuaaauagaaauaaauaaaagcaccuauuuuaggugcuuuuauuacuuguugaauucuuauuuauacuugggucuauuucuggagucccuugaguuucauuguucuauuugucuauuuuuauaccaguaccacccuguuuuacuugcuguaguuuuauaaaaucuuaugucacaaaagggacaaguccucauuuguaguuauuaauauuauuucaguuuuggccauucacucacauuuacucuuucugauaaguuugagagucaacuuaccaaguuucauuuaaaacaaaccaaaaagacaaaugccaaucaaaguuugcuuaaaguugccauaaguuuauagauuaauuuguggaaaacugaauaauuacaguaugaauuuuucuaucuaguaauacagaaugccuucuauuuauuuauuugagacagggucuugcucugucacccaggcugaagugcaguggugcaaucaaggcucacggcagccuccaccucccagguucaagcaauucuugugccucagccuccuaacuagcugggaucugagaugugugccaccacgccaggcuaauuuuuguauuuuuaguagagaugggauuucaccauguuagccaggcuggucuugaacucuuggccucaagugauccgcaugccuucaucucccaaagugcugggauuacaggcaugagccaccgcaccuggucugccuuuuuuuuuuuuuuuuugagaccgagucuugcccugucgcccaggcuggagugcaguggcacgaucucggcucacuauaagcuccgccuccuggguucacgccauucuccugccucagccuccugaguagcugggacuacaggcacccgccaccacaccuggcuaauuuuuuguauuuuuaguggagaugggguuucaccguguuagccaggauggucucgaucuucugaccuggugaucugccugccucggccucccaaacaaagugcugagauuacaggcgugagccaccgcgcccagcccugccuucuuuuuaugauauugauuuuauuugucuuacacuaaaguguuuuuaauuucuucauauaauucuuacacauuuaguuuuacauuuauuccuaaaugucaccagcaucuggugagggccuucucacuguaucaucccaugaugggagccaaacucauccuuuuacaaggaaaccacucugugauaacgugauaauggcauuaauggauucuuuuuuuuuuuuuuucuuuugagacggaguuucgcucuauugccuuggcugaagugcgguggugugaucucagcucacugcaaccucugccucccggguucaagcgauucuucugccucagucuccugaguagcugggauuacaggcacccgccgucaugcguggcugauuuuuguguuuuuaguagagacaggguuucgccauguuggucaggcugauuuucaacaccuaaccucaggugauccaccugccucagccucccaaagugcugggguuaaagaugugagccacugcaccggccaaucuguuguuuuuuaugucaaauacaauccaagcagaaauccauucuugaggguggggcuuccaugauccaaacaccucucauuaggccccacgucccaacacugccacauuagggaucaaguuuccaacacaggaacuuggggcacguucaaaccauagcacauaauauugauauugagccaguuugguauuucuguuccucuaucggcguguaauuuguaguuaagccacugauuauuuuggacuuuggucuaggaguaaccuguaugaguuugucuaucucuucucugaccuaucuugagugcugucauaguaggucuuuuuuuuuuuuuuuuuuuuuuuaagggacagagucucauucuguuuccuaggcuagagugcagugguacaguuauagcuuacugccgccucuaacuccuggggcucaagcuacccacuuggcugagccuuccgaguagccaggacuacaggugcacgucaccaugacaggcuaauuuuuccauuuuuuguagggaugacaucuugcuauggugcauaggcugaucucaaacuccuggccucgagcaacccucucgucuugaccuuccaaagugcugagauuacaggcaugagccacagugcguagucccuguuuuuagaaguuuguucuucaagagauucuucuaguuguaacaucuaauaaugauauuuugcuguggcuguuaguauaguauaguauguguagaugucauuuuugguagcauacauauuauuucuguuuuauaaauaaacagaucuaagaaagauuaaacaaauuacccacugucacacuggguugugacagaguuauaaaacuuuaguuuuaguuauaaaaccuuaagcacucuaguucaguguucugagugugugauuucauguaagguucagguucuugugaucuuugcugaguucuuuguguuucuccaaauuuauuuccccauuaguuugauaauuuugcaaaugcucaaauguuauguuugcuuaauauuauuauuuaggauucugucuccuuuguacauuuuucugguguugauucuuaaauucaaauaaauucuaguuccuaaagagcaccugagauacuaaaaugugauuauuucaugaagaggaucuuuacauguugcauuuucaagcaguugaaucuuuugggccaacuuucuugcuuuugaaauuccuuaggcaaaugauauucucauuuuaauguuauuuaccuuuuuauaauaagaaagaaguacaggccaggcgcgguggcucacaccuguaauccgugcacuuugggaggccgaggugggcggaucacgaggucaggagaucgagaccauccuggcuaacauggugagacccugccuguacuaaaaauacaaaaauuagccuggcauguuggcgggcgccuguagucccagcuacucgggaggcugaggcaggagaauggcgugaaccugggaggcagagcuugcagugagccaagaucgcgccaccgcacuccagccugggcaacagagggagacuccaucucuaaaaaaaaauaaaaaauaagaaagaaguacaguguggccuguuuagugguuguuaagaaaccuuuuuucuuuuuuuuuuuuuuuuuuugagauaaagucuugcucugucacccaggcuggagugcaaaggcaugaucucagcucacugcaaccucugccuccuggguucaagugauucuccuguuucagccuccugaguagcugggauuacaggugcccgccaccacgccuggcuaauuuuuuuguauuuuuguaaagaugggguuucaccauguuggccaggcuggugucgaacuccugaccucaagugauccacccgucucagccucccaaagugcugggauuacagaccugagcccccacaccuggccugaaaccuuucuuuuauaaggagaaauaggagaggcuggucuugaacuccugaccucaaguguuccaccugccucagccucccaaagggcugagauuacaggugugagccaccacacccagccugaaaccuuuaucuuauaaggagaaguaggagaggcuaggccuucaucugagugauuugauguauacaaagauccauguuaccuuugcugugugccuuucuccagguauucucuuaagaacugaauuaacugauuccuaggcuuuuagaccaccugcaacaauaucuagguuguagugauacaugagagacuucuuaagauauugcuucuuccuagaaauaagaugaguauguaacuuguauguucuacagugacaauaagaauuuaucauuuaauuaacaagacuaagugagcguuuccuaagaguaacaagaccccugugccuauccauuaaugcuggaaguuuucaaauuauugccucugagcuccuggacucccugaaggugucuaagccuggucuccaucuuugaccauuuuccauuccuucuaauguagggaaugcaaauugauucaaaauggcugagaugaauuaaaagaaauaaaaauacuggaauugaccaauuacagaauaaaauuaaagugugaaaauuccaguuuacguuuccuauaggguccauuuggcauauaaaucagaugcuauaauccucuauuaucugagaagccauccguaaaauguuagagggacauccaggccuuacauagaugaggaaacaaucuguuuaguggcuucuaacucacucuuaaguuuuauuuauucuauuuucuugccauugcuucugaagaaucagcuuccccaagcagacaaucaucaagucauuaaagucauaaagacuuuaaguuaugcaaauauggagaauuacuuuuauuaauuaguagugaggcucaagucauuuuauagaugcaagucacuauugcauccuuuguuaauauaacccuuuuccuuccucugugucagcacauugcuuggcacuuuguagacagcaaauauuuauggauuuacaguaagucgaaguguugccugaauuaagguuuuguuacaugaauauugucauccaaaagaccaccaggauggcuacauaguagaaagaagagcuuuauuggugauaucaguuugcauacuggggagagagucccuggcauagauugugcuccaucuuugaggaggagaugggcagguuggguuuuaugcuucacagggcuuaauauuauauaguagucuuaaauaugaagcugguuugggagaaaagcuauacauauuuaugaggggaauugggcacaugugcaauggguaaacauauguaacauacaucccauguucauuuuggggugggcuuuuagcauuaaaauaagguggacuuguugggcgugguggcucacaccuguaaucccagcacuuugggaggccgaggccaguggaucaugaggucaagugaucaagaccauccaggccaauauggugaaacccugucuuuacuaaaaauacaaaacuuagcugggcaugguggugcgcaccuguaaucccagcuacucuggaggcugagacaggagaaucacuugaacccaggaggcggagguugcagugagccgagaucgcgccacugcacuccagccugggcgacagagcaagacucuaucucaaaaauaaauacauaaauaaaauaagguggaauuuggcucuuuaggucaaaggcgaacuauaggacacaaagacaaguuugugugcaaccucuauaaaguggcugaaacuggcuuaagaucugcaacugcauaucagaaaagaauguuucugaggcugguccucuguccaaucacaguuacaguggucuggguuguaaaucagaguuaggaggggucugauaauuugcaagagugugauuuuuucuuguagccguaggaauuuagaaauuugccaugucagccaggcccugagccccggaccuguaagcaacuuuuguuuccuuaaccuuaggguccaucuuaguugauaaagggaugucuauuuuggucuuucagaucacaagggaaaaacauugaggaaaauguuguaauugucugcaauugaauggauuauauccuuccuuuuucuccuuucuaggauauaagcuuuuaaaauacuacucuuuuuuuuuuuuuuuuuugacggaguuuugcucuuauugcccaggcuggagugcaauggcgcgaucuuggcucaccacaaccuccgccucccagguucaagcaauuuuccugucucagccuccugaauaccugggauuacaggcaugcgccacuaugccuggcuaauuuuguauuuuuaguagaaaugggguuucuccauguuggucaggcuggucuugaacuccugaccucaggugauucgccugccuuggccucccaaauuguugggauuauaggcgugagccacagcacccggccuuuuuuuuuuuuuuuucgagacggaguuuggcucuuguugccuaggcuggacggcaguggcacgaucuuggcucacugcaaccuccgccuucuggguucaagcgauucuccugccucagccuccccaguagcugggauuacaggcacacaccaccacgcccggcuaauuuuuuguauuuuuaguagagacaggguuucaccauggccaggcuggucuugaacuccugaccucaggugauccgcccgacuuggccucccagaguguugggaucacaggcauaaaccaccacgcccagccuggagauggaguuucacucuuguugcucaagcuggagugcaguggcacgaucucggcucacugcaaccuccgccucccggguucaagcaauucuccugccucagccuccugaguagcugggauuacaggcacaugccaccacgccuggcuaauuuaaaauauuacucuuuauuagaaaaagaaacaugcuucaugcuaauuuggagguuaucugcaaaagcuuucuacuuaagaaaauauuuagcuucguugagaacuuccauacuuuaauauguggauuugcgaugaaauaugcauggucaaaugcaaugcacacauuuacaaauacugugagagcaaacuaaaaaugagauuaggaauccacuagcaauuuaagucagauauuauacucagcuuucucccacuagauauuuuuuucuuaaugauaagcuuccuuuaagagugauuauaggaaaaacccuuuuuuccaaccucuaugggugggacuggaaggaauucuaaaaaguuggccaguaaauaucugggcaguguauucuuacagucaaaggaaaguaaguuccccagggauggcaaguauuuuuucuggaaaauccuuaucauaugucuuauuuauauuacagauguuccucaacuuaaaaugugguugugucccagaaaacccauuguaaguugaaaauguaguaagucaaagugugcuuuaaacuuacaauacaguauuuucaguuuacgauggauuuggagguaacccccaucauaaaugaggaguguacugaauguguaugcuuucacaccauuguaaagucgaaaaauccuaaauugaaccauccgaaguuagagauugucuguaacugguaaaaguacuauuagaacuguuuugagguuggguguggugccucaggccuguaaucccagcacuuugggaggccgaggcggguggaucauuugaggucaggaguucaagaccagccugaccaacauggugaaacugucuacuaaacauacaaaaaaauuugcugcgcaugguggcggcugcaguggugggcgccuguaguaccagcuacuugggaggcugaggcaggagaaucgcuugaacccuggagguggagguugcagugagccgagauuguaccacugcacuccagccugggcaacagagugagacuccgccucaaaaacaaauaaacaaacaaacaaaaaacaggcacgguggcucacgcuuguaaucccaacacuuuggaaggccgaggcugacggaucaugagaucaggaguucaagaccagccuggacaacauggugaaaccccaucucugcuaaaaauacaaauauuagccaggugugguggcgggcaccuauagucccagcuccucgggacguugaggcaggagaaucgcuugaaccugggaggcagagguugcagugagccaggauugcgccacugcacuccaggcuaggugaucgaccgagauuccgucuaaaaggaaaaaaaauguuuugaaacagauaauagacuuacauaaaguguugcugggauguugugggcucuaaagcuguuguuugcagcagguaccagacuggugcaucuggaugaccuccccccauaguaccugcagcauuuugggguguuugggugaagguggauuguugacagcacauaaccagcauuuagauuuuaaggaucugccuuuagauauggguucauggccaaaagaaaaaaaaagauucuaagguuuaguagucuuauggagaaugcaacauaaccuuagucuucgaugcuucauagauguaaaucuaaaggacgccuaauaguuuuauauauauauuuuuuguuuguuuguuuuguuuugguuugguuuuuuuguuuguuuguuugagacagucuugcucugucacccaggcuggcgugcaguggcgcaaucucagcucacugcaagcuccgccucccggguucacgccauucuccugccucagccucccaaguagcaggacuacaggcgccugccaccacgccuggcuaauuuuuuguauuuuuaguagagacggggguuucaccauguuagccaggauggucuugaucuccugaccuggugauccacccgccucagccucccaaagugcugggauuauaggugugagccaccaugcccagccauauauuuauauuuuuaauauauaauaauauaaauuauauacuauauuacauauaaauuuuauauauuauaugccauaaguuaugauauaaauuguauaauauauaauauaugaaaauguaauuuauauauuauacauuaugugaauuuauauauguuuuguuuuguuuuuuagagacagagucuugcucugucucccaggcuggagggcaguggcaugaucauagcucacuacauccugggcucaaguuuuccuccugccucaaacuccuaaguagcugggacuacaggugcacauagccuugcccagcaaauguuuuuauuuuuuguagaaacauguucacuguguugcgcaugcuggucuugagcgucugaccucaagcaauccucucaccuuggcuucccaaagugcuagaauuacaggugugagccacuguaccuggccguacccaauaguuuuaauucacuucaguugcuuuaaaaauacauuuguauuuaauaucucugcuauguucccucuauaaugcaagagaagcucaguagcaguucaguggcaauuucuaauugccacauuaaugggaggaagugccuggcaucuggaucucuuccugccuucaaagacuugccauuugugcaucauuuguacccugaagaucuuuuuuuuuuuuuuugucuuguguuuucguuguuuucugaauuuaggagagaugcaguugcuaagaaaugagauaaguuaggccaguugggauggcucaugccuguaaucucagcacuuugagaagcugaggcagguggauugcuugagcccaggaguuugagaccagccuggguaacauggcaaaaccccaucucuacaaaaaguacaaaaauuagcuggaugcaguggcauguaccacuagucccagcuacucgggaggcugaggugggagaauugcuuaagccuaggagguggagguuauagugagcugagaucgugccacugcacuccaaucugggugacagagugagacccugucucaaaaaaaaaaaaaaaaagugagagaaauugaacaagaugguuugauauuugaccccauaaaguugucaacauuugccuaguuguaguaaaauagaguaccauuuuguacuuguugugaacauggugcuuuuuucucccuccaaaucuuagugcaugauccguaaagguuauugaauuguuuuucaacuucuuaaaggaaaaauuucaguuaaaauuuuaggcacuuauucuaaaugaauugaguuuauauauuugucacuagaaaauuacuaucuuuaggucaggcaugguggcucaugccuguaaucccagcacuuugggaggccgagguggguagaucaccugagguuaggaguucgagaccagccuggccaacaugguaaaaccccaucucuacugaaaauacagaaauuagccaggcaugguggugcacgccuguaaucccagcugcuugggaggcugaggcacgcgaauugcuugaaccugggaagcagagguugcagugagcagagauggugcuccagccuaggcgacagagcaagacccugucugaacaacaacaacaaaaagccacgauuuuuaguucaauaguagcuuguaauuguaguuauaguauuuguaaguugcuaugguuuugaguguugcuuuuaagacuguuguuaguuacccacuaaguuuuaauugcaaggaaauuucagagaaugugaaaaaguuuugguuaagacuggaaaauaucuauucuugcuuuccucaaaacuggcuucagugauuacuuaaugacagcagaaugcuuugaaaauaugcucuuuaaagucuagcuguuacuaaaauaccauaauaacuuauauguaagugauaguugcuuuuuuguuguugcugcaacugugguaagaggaaagcauuauuagcaaaauccuuaagaaaaauauaguauaaaaaacugguaaauagagaauuuacaaaaauggaaugugggugagaacaugagacacauguguauagguuugacaucuuuauauucauuugaauucuuuguuuccuuggacuuugcagguaagguuguuuuuucuuuuugacaaacuguauaauaauaauaauuauuuuuauuugagauggagucucacucugucacccaggcuggagugcaguggugugaucuuggcucacugcaacuucugcugccugaguucaagugauucuccugccucagccuccugaguagcugggauuacaggcaccugcaaccacaccuggcuaauuuuuuguauuuuuaguagagacaggguuucgccauguuggccaggcuggucucaaacuccugaccucaggugauccacccgccuuggccucccaaagugcugggauuauaggugugagccaccgcacccagccuuuuuuucuuucuuuuaaaaaaaaaguuuaauagagaugaggucuguguugcuuaggcuggucuugaacuccugggcucaagccauccuucugcaucagccucccaaagugcuaggauuacaagcaugaucuaccuugcccagccugaccauuucuucuaauggaagguccuauaugacagagagacauggaugauauuaggaucuuguuuauucucaucaaacuuuauacucaauuauagucagcaaauaaacuauuuagaguuuucuuuucauuugcugacuaccuuaccguuaacuuauuauuuaguaagcaagaacaaauuuaaccagcaauuucgggaaugagaaaaggaguaaagaauauauauggcuucuguaauccgaaaacagaaaacucaccauaaccuggguaauugaaagaguugcuuuuguaaaaugugccguugaaauacucuuuaaaaaggggguugggagugugggcugccucaaaucuuaacaucgaagcuaaagauaacauuuaauuuaucacauauuuauuguauacuuggauaaaaugaaaacuccauugagggagucuuaagaauuugggaugauaugguuguuguaacugagcgauaaauauaguuaucuuggugucuuuaauauuugagaguaaaagcauuuuuaaaaucaauuguaugauucuuuuaauaaaaaggaacuugcaaguuuauguggaagaagaagcuuuucuuuuuguuuuucuuuuuucacuuuuugagacaaugucuugcucugucacccaggcuggagggcaguggugcaaucacgguucacugcaaccuuaaacucccagacucaaacaguccuuuugcaucagccuuacaaguagcuaggacuacaggcaugaaucaccauacccagcuaauuuuuaaauuuauuuuuuauuuuuuauuuuuauuugagauggagucucgcugucgcccaggcuggagugcgguggcacgaucucagcucacugcaaccuccgccucccggguucaagcgauucuccugccucagccuccugaguagcugggauuacaggcaugcaccaccaugccuggcuaauuuuuguguuuuuagagagaugggguuucaccauguucaggcuggucucaaacuccugaccucaugauccacccaccucagccucccaaauuguugggauuacaggugugagccacuacgcccagccaggauauauuuaucugaacauuauagcuaugaagaauaaagauauccauuaagcaaacuggauuaugggaaauaucuuaaauuuuucuuuauuauuuaauauacaagcaaaacuucuuuauuguagaaaaauuagaauauagaaauuaacacaaaggaaaaaaaguauaguccuaccacuggguugaaugaauucugauauuuuuccuaugugugcuucuuucagaaauauggcuacacacaccuuucugcaggagagcugcuucgugaugaaaggaagaacccagauucacaguauggugaacuuauugaaaaguacauuaaagaaggaaagauuguaccaguugagauaaccaucaguuuauuaaagaggguaaggagugugaaugccaaccaguucaaaccagcgaggaaagaagaaauuaaauucaccuuuuggccaggcaguugcucaugcuugugaucccagcauuuugggaagccaaagcaagaggaucacuugaggccaggaauucaagaccagccuggacaaccuagugaaaccccaucucuacaaaaaaauuuuuuaaaaagccaugcgugguggcauaugccuguagucccagcugcuugugagacagaggcagaaggauugcuugaccccagaaguucaaguccagccugggaaacauagugagaccuccucucaaaaauaaauaaauaaacaacaauaauaauaaaaauaaauccaccuuucauauguguaaugaaaaauaucaaagauuuuuuguuuuguuuuguuuugagacagugucuuugucacccacgcuggugugcaguguccugaucacagcuugcugcagccucaaccuuccaggcuuaagccaucuucccaccucagccuccugaauagcugggacuacaggugcaugccaccacaccuagcuaauuuuuuucuauuuuuuguggagacagggucucacuauguuguguaggcuaggcuggaacuccugggcucaagugauccucucaccucggccucccaaagugcugggauuacaggagagagccaccacaccuagcucagaguauugaauuucuugcuuguggaaggugguuaugcuugagaauggcagaacuggaaacuuugcuuucaccugggaagaaagcggacaguggcaaggauucucugcuuugauuuaggaucaccuauagcucaacuuaacauccauuuaugugcacuugguccuuucuucccaacauucagacaguuauucucuuccauuucuguuucaucuuuuuuccucccucuccugcucccuuuccuuuuuucuuuuuugcuugcuuucuuuuuuuuuugagauagagucucgcucugucgccaggcuggaguguaguggcgcgaucucggcucacugcaaccucugccucccggguucaagagauucuccugucucagccucccgaguagcugggacuacaggcgugcaccaccaugcccagcuaauuuuuguauuuuuaauagagauaggguuucaccauguuggccaugauggucucgaucucuugaccucaugaucugccugccucagccucccaaagugcugggauuagaggugugagccaccgugcccggcccccaauuuuuuuuuuuuuaaauaaaccucuuucuuucuucuuucucucucuuuuuuuuuuuuuuuuuggcggggagacggaguuucgcucugucgcccaggcuggagugcaguggcgugaacucggcucacugcaagcuccgccuccuggguucacgccauucuccugucucagccuuccgaguagcugggaguacaggcgcccgccaucaagccuggauaauuuuuuguguauuuuuuaguagagacgggguuucaccguguuagccaggauggucuccaucuccugaccucacgauccacccgcuugggccucccaaagugcugggauuacaggcgugagacaccaugcccagcccuuucucuguuuuuuaacccacgucccucucaucauugauguucgcucagccauggugucuacuuuucugguguaucaccaucuucaaugugaaaugcuaagacuuaagaacuuuuaaaacuaaaauaugucacaucugaggcugggcgcaguggcucacgccuguaaucccagcacuuugggaggccgaggcagggggaucacuugaggucaggaguucgagaccagucuggccaacauggugaaaccccgucucuaccaaaaaauauaaaaaauuagccaagugugguggcacacaccuguaaucccaguuacuugggaggcugaggcagaagaaucgcaugaaccugggaggcagagguuuuggugagccaagaucaugcuacugcacuccagguugggugacagagugaaacucuguuucuuaaaaaaaaaaaaauguccgggugugguggcucacgccuguaaucccagaacuuuaagaggccaaggugggugaauuacgaggucaggaguucaagaccaacauggccaacauggugaaaccccaucucuacuaaaaauacaaaaaaaaaaaaaaaaaaauuagucggccgugguggcaggcaccuguaaucccagcugcucgggaggcugaggcaggagaauugcuugaaccaaggaggcagaggcggagguugcagugagccaggaucgcaccauuguacuccagccugggcaacagggugagauuccgccucaaaaaauaaauaaauaaauaaauaaaugucacaucugaaaaacagacacccuguauuuacuagguaacucuucauucuagauuccuagaacuauaaucauuaacagguauuuucacauagaagaacagugagggagaaaaagaaaugcaauauugggaacaacaagaaauggcugaagccugauggaaaagagcuauguaagcaucugguuggaacuaaagacauuggggaugaaaaguggcuuguacacacauucuuaccucuugucucagagguuggaguaaccugcuuccauuccaaaauaaacaaaucucucucccuauucacucuuucuaauguccuuucucugcucuauaaagcagagaaaguauuaugaaagagcauaugguuuuuacuuuuucacucucuacuuuuccacucucuacuuuucaacccuuugcagucagauucuguuuccaucuccauugcagcugcucuugcauguuaccaaugaugaucucuaucaaauaauacuuuugucauuauuuuucuuguaguauuuaacuuuaaucagucuguuugaaaaucauuccuccuuuguucuuuaugacagcgucucuuuuucuucucucccuacugagugacugcuauuucucuauccucuuuaauaguuauucuuuugcaaguuuccaaaaccaugaugcuucucaggguuuuauacuuggucuuauucagcucucauuucauauguuucuuucuggaugguuuuagccauacccaaagcuuucacuaugcucaugcugcuaaagucuauagcucuaaaacaaaauguuuguuuugaauuccagacauauauuuuuaacuaccuaacuacuaggccuuuauuugaaugucucacaagugucucaaaaucaacaugucagaggcugaguguauugucuaaaaugugaucuuccuuuacuuccugucuugguuaaugguucugccaucuaccuagcuacucaaggcauaaaucugggaaucauccuauauucuccugccucuuccucacuuucccaaauccauucagugagcauaucuuuccaguuauuuuucuuuuaauccucuucuguuagucucuucucugucaucaccuuaguucacauccucuuuuuuccuauuuuuuuuuuuuuuugagacagagucucucacucuguccgccaggcuggagugcuguggcacgaucucggcuuacugaaaccuccaccuccuggguucaagcauuucucugccucagccuccccaguagcugggauuacaggugccagccaccacgcccagcuaauuuuuguauuuuuaguagagacgggguuucaccaucuuggccgggcugguucuuuuguugccuuuguuuuggggcagccagugacauuuggguuuaauuagcuuccguuaaaaaguauuuuauccuacauuaauaauuaaugcuaauggucuuuuauauuuguccaaagcuuuguguuguuggacuugaauuauaugaauagcagaguugagcaccuguagaaguaauauacuuuccacuauagcaaaacgacuugggaagagcaaagggaauaaagagagggucuccaguugcuggagcaaagauaaugguuaaugguuauuuuccucuuauugccgcucuuauuguuuauuuauaacuuugugaauguguaugugaaaguaacauauacuuaacuguagaaaauuuggaaaccacagaaaaaaauuguguguauaaaaugaggugguuuugagaggggcauauacccauaaccacaccaacuugaggcaaccaucuuaauacauugauagauuuccuucuagucuuuuuucuuucuuucuuuuuuucuuuucuuuuuuuuuuuugcuauguacccuccacccuuuacuuaugguuuaaauaauaauaauaaaacacccauguauacacuaccaugcuugagaaauuucauuuuguuaauguuguauugaaccuaaaucuucuuuuuccuuuaggaaauggaucagacaauggcugccaaugcucagaagaauaaauucuugauugauggguuuccaagaaaucaagacaaccuucaaggauggaacaagaccauggaugggaaggcagauguaucuuucguucucuuuuuugacuguaauaaugagguaaugaaaaucuucaucugcccacauaggcuuuaagcaacuguuagucaacuauuagaaaaaacaaaggauuuuuuaacuuauauuuuauauuggcagcaguguuuuuugaauugguagauuggauggacggaacagcacugucuugcuguuggaguauuaaaaacuauuuggcauuagcagccuuguggagcuaaauuuuccuuuauuuucaaaauaacaagaaucaguuuugauuuuuaaaaaauaagaauugacauacauaauaauauuagguaaugaagcugaacuacuuucuuagguagacauuauuaucaaagaguauuuugccuuaggguguuguuuacuggaagagaaacacguuucugagaaguugggaaaacuuucuguuuuaaagaaacauacagggcugggugcgguggcucacgcuuguaauccuagcaguuugggaagccaaggugggcgaucaccuuaugucaggaguucaagaccggccuggccaacauggugaaaccccuucucuacuaaaaauacaaaaauuagccuggcaugguggcauaugccuguaaucccagcuacuugggaggcugaggcaggagaauugcuugaaccugggaggcagagguugcagugagccaagauggcaccacugcacuccagccugggcgacagagcaagacugucucaaaaaaaagaaaaaaaaaaagaaacauacaggauagccugauuugucuuaagagugaaaugaucuugaaaaaaguaaaaaaauguacuuuucuuucugguaguucuaauaaugaagccagacauacuuuugaauaacuaaauacauuucucagaaucauuuaauuaaaaagccugaaguaguuaguaccuugaaagaaguuggcuguucuuagguugaauuguaaaugugccccugguggagaaucuugcugcagccuuuguguuguuuuauuuuauuuuauuuuuuugagacagagucucacucuguugcccaggcuggaguacaguggcacgaucuuagcucacugcaaccucccagguucaagcaguucuccugccucagccucccaaguagcugggauuacaggcaugugcaccaugccuaguuaauuuuuguauuuuuaguagagacgggguuuugccauguuggccaggcuggucucgaacuccugaccucaggugauccacccgccuuagccuuccagaguguuggaauugcaggccugagccaccaugccuggccuuuugcauuguuuuaaaacguaacucucuucuuccaaccccccaaaauauguuuucauuuacccuucaaaguuaacuuuagaauguuaccacagcuuuauaacaaggaauguuuauucacaauuaacaaaggaugcuuuauucaaaugcaaauauguugacucaaauauuuucaaauuuauggaauuaucaaaaagcagccaaaaaugaaacaaaguuugaggcauguaauucauaccuaauaaguuaauaauauaucugagauggaaucauacacauacagaucuuuuuauuacaguuugaaaaaaaauaagcaggaaaaacugagucaugaaugaauucuuauuaugcucuguacuuauuuaaccuaguuuauauaaauugaaccacauguuuacguuuaaaaggacuuugcauguugauuaaugaauuagacacauuggguuuauugcaggguuuuuuuggucaucucuuuaaacucuuguuuucuuugcagguuaaaagaauggcaaauucauaucuauauuuuuaauaacuuuguaucucuuuuuagauuuguauugaacgaugucuugagaggggaaagaguagugguaggagugaugacaacagagagagcuuggaaaagagguacuuggcaguuuuuacauacaaccacuucaaucccagaccugccuuauuugguacaggaauaaaagagucacauuuaaacauguaaaauggcuuguuuaagauguuaggucaaucagucggggcagauccaguguucugugagcucuccuauaacauguagaagaaaggauagauaccuagaaccuugcaauauuuacuucuuuugcagaauucagaccuaccuucagucaacaaagccaauuauugacuuauaugaagaaauggggaaagucaagaaaauagaugcuucuaaaucuguugaugaaguaaguguuccuagccugucuuuaaaaaaauaugucaaauaaaaaugugauuauuuguuuugggguaagcaggaaaaaaagaaauacuaucacagauuaguuaguuuuucaagacacuggaagccagucaugguggcucaugcuuguaaucccagcacaaguguucaagaccagccugggcaacauacugggacucugucucuuaaaaaaaaaagaagacacuggggacuaaaugaaaaauuaggguuuuuuuccuuucugaguaaaaccuaaaaugagguuuauaacuucaaacuuguucuucaugagaaaugggugguuuaugaauucuaaauuugcucccaagcacuagaaaacugguauuuuaagaaaugugaguuggaucacaugaauggcaagucaucuagcucaagagcuccaggcuucuuucuucugccacagaacaaguagcaccacaggugaagguuuccaugacuuaucacuucucuuucuuuuucauaaauagcgaucucuaaauugugguuugcaagcgcaacaaaauuucuagugucucuuaaggaaccuaaccucccuuuccccgauucccugaaucuucauccucuuauagucauaagauaaaaaagaaaggcccaggggaagaagauucagggaaucuuuuuuuaauccauugacacuuuguauagaggugagguaauacaugagaaaacuguguuuuagaaucagaacuaagaagauaagccacuucaguuauauuuuauauuuuauuuuacauuuuauuuacaguuuauauuuuaucaaauuauugguagccucucaagaauauuuuguccuaaaagcacuaaucgaauguaauauagucauaauuuuauauguauuauuuauauaauauuacugucuaaaguaaaauagaugaaacuaaguaugugauucaaaaaaaugauucauuuugaaaauuaauguaaauuugauuuuuuugugugugacccuguuuggagauggagucuuuauuuuuuauauuauuuuauuuauauauauuuuuugagacagugucucacucuguugcccaggcuggagugcaauggugugaucucagcucacugcaaccuccgucuccuggguucaaguaauucuccugccucagccuccuggguagcugggauuacaggugcccgccaccacgccuggcugauuuuuguauuuuuaguagagacgggguuuugccauguuggccaggcuggucuugaacuccugaacucaagugaucugcccgccucgaccucccaaagugcugggauuacagaugugagccaccgcgccccgccaaauuugauuauuuuuaauaagaacuuagcuguaugguauuuuaacaguaccugcuuuuaaaauuauuaucaucuuuuuccuuuacagguuuuugaugaaguugugcagauuuuugacaaggaaggcuaauucuaaaccugaaggcauccuugaaaucaugcuugaauauugcuuugauagcugcuaucaugaccccuuuuuaaggcaauucuaaucuuucauaacuacaucucaauuaguggcuggaaaguacaugguaaaacaaaguaaauuuuuuuauguucuuuuuuuuggucacaggaguagacagugaauucagguuuaacuucaccuuaguuauggugcucaccaaacgaaggguaucagcuauuuuuuuuaaaauucaaaaagaauaucccuuuuauaguuugugccuucugugagcaaaacuuuuuaguacgcguauauaucccucuaguaaucacaacauuuuaggauuuagggauacccgcuuccucuuuuucuugcaaguuuuaaauuuccaaccuuaagugaauuuguggaccaaauuucaaaggaacuuuuuguguagucaguucuugcacaauguguuugguaaacaaacucaaaauggauucuuaggagcauuuuaguguuuauuaaauaacugaccauuugcuguagaaagaugagaaaacuuaagcuuuguuuuacuacaacuuguacaaaguuguaugacagggcauauucuuugcuuccaagauuuggguugggggcacuagggguucagagccuggcagaauugucagcuuuagucugacauaaucuaaggguauggggcaaggaucacaucuaaugcuuguguuccuuauacucuauuauauaguguuauucaugauucagcugaucuuaacaaaauucguagcaguggaaccuugaaaugcauguggcuagauuuaugcuaaaaugauucucaguuagcauuuuaguaacacuucaaagguuuuuuuuuguuuguuuucuagacuuaauaaaagcuuaggauuaauuagaagaagcaaucuaguuaaauuucccauuuguauuuuauuuucuugaauacuuuuuucauaguuauuuguuuaaaaagauuuaaaaaucauugcacuuuggucagaaaaauaauaaauauaucuuauaaauguuugauucccuuccuugcuauuuuuauucaguagauuuuuguuuggcaucauguugaagcaccgaaagauaaaugauuuuuaaaaggcuauagaguccaaaggaauauucuuuuacaccaauucuuccuuuaaaaaucucugaggaauuuguuuucgccuuacuuuuuuuucuucugucacaaugcuaagugguauccgagguucuuaauaugagauuuaaaaucuuaaaauguuucuuauuuucagcacuuacaucauuugguacacagggucaaauagggcaaauaauuuugucuuuguauaauagauuugauauuuaaagucacuggaaauaggacaaguuaauggauguuuuuauauuuuaauagaaucauuuauuucuauguguuaugaaauucacuuaaugauaaauuuuucaacauacuugccauuagaaaacaaaguauugcuaaguacuauaacauauuggccacuaaaauucauauugagauuaucuugguuucuuggaagagauaggaaugaguucuuaucuaguguugcaggccagcaaauacagaggugguuuaaucaaacagcucuaguaugaagcaagaguaaagacuaagguuucgagagcauuccuacucacauaagugaagaaaucugucagauaggaaucuaaauauuuauagugagauugugaaagcaaccuuaaaguuuugaagaagacugaugagacuaggugcuuugcuuccuuucaucagguaucuuucuguggcauuugagaacagaaaccaagaaacaugguaauuacuaaauuaugaggcuuugcuuuuuguuugcuuuuaaguagaaaaacauguuggcaacauugaguuuuggaguugauugagauaauaugacuuaacuaguuuugucauuccauuuguuaaagauacagucaccaagaauguuuugaguuuuuugaaagaccccaauuuaagccuugcuuauuuuuaaauuauuuccauucagugauguuggauguauaucaguuauuuaguaaauaaucucaauaaauuuugugcuguggccuuugcua

SEQ ID NO: 191395 - RNA, 64009 nt, Homo sapiens
aguucccgcgaccccaacgucccagaggcggggccggagucggcgguggcgcuccuuggagccggcucccgcuccuacccugcaaacagaccucagcuccgcggaaguugcgguaaguggagcuuugugcuccugguuuccccuugagaggcggcagcggggcccugggaagguugguggguaacauucaaagcccuguaguggguuccgcccuccaggagccuggagcagaugacgagaaggggagcuagugggagaaauuaagcaguccaugaaauccuuggguaucaucugagcuaagguaugugaaagagguuugcagucgauaacgugccauuuaaaguuguuuuuacggugggaauuucuugaggacugaaaccuugaaugcucgcucuugcauuccucacaauuucuggcucacacucugcuacguaguaagggaucaguuaauguuugaaguucauggacuacuggaaguaaaguguaaacagcaaagugcgagaaugcuaugcgugugaguacagacaguauaguaccaucgccacggugucugggagaagguuucacagaggaagugacauucgaguuggauugugagggauggcggggguuuacuagggcauuccaaguuaagggaggcauccugugcagauauugaaaccggggcacugcaaguaguucaguuugacuggaauguaggaugaguggauggggggguuaagguuggaauaauagaguggggcuggauugugaagauccuuuauucuguauguaaagaagagccaucggcuuuuuaaaaaaaauuuauuuuuauguuuauuuuugagacgcaguuucacucuuuggcccaggcuggagugaaguggagugaucucggcucacugcaaccuccgucccccggguucaagcgauucuccugccucagccucccuaguagcugggauuacaggcaaacgccaccacgcucggcugauuuuuguauuuuuaguagagacgggguuucaccauguuggucgggcuggucuggaaauccugacuucaggugauccacccgccucggccucccaaaaugcugggauuacaagcgugagccaccgccccugacaugagccauugacuuuuaaagcaggagaauaauuugaucagauuuauauggaaacacucuucuagcagcauuauggggacuuuuccauaagucuggugaguugaugaaguuagcaacuaaggugguggguauggaaagauaauuuauauggaagaaggggugaggaugauuugaacguuucuauuguacacgauaaugacuuuaccugagaauauguuuugcuagguguagauguugugugguuuuaguuuuauuaccuuuaguggcuuguacaacacugacagaaugaaaguaccuuauguauauuguuuuaaaauaagaaaucaacauuauccaucuuuucacccaaaugaauaaaggaauaaaacacaaauagcgcauuuuaagacacuucuguuuaaugaagaaaaaauuggcacuuuuuauacuuuguagaguuacaguuauccaugugaauacuguuauccaugacaaccaaguacuaaggaaggguuuuaggauuuaaagccugcauucuguggaagcugcauuaaaccuuuuaaguccagauauuucuaagaaggacuguuuagucaccuuuuuuuuuuuuugagacggagucucgcucuguugcccaggcuggagggcagugacgaaaucuccacucgcugcaagcuccgccucccggguucacuacaggugcccgccaccacaccccacuaauuuuuuguauuuuuaguagagacgggguuucaucguguuagccaggauggucucgaucuccugaccucgugauccacccaccucggccucccaaagugcugggauuacaggcgugagcuaccguguccggccuagucaauuuuauuagaagcacguuuuucucugucuugaacaagguauaagagcauuuucaauaggauuuucagccucugacuuuaucuaaaaagucucuucuaaauaaucucugcaucuggauuaauaauccuuuucuccuuuaucuugcuucacacagagugagacagaggcucauucucuugcccaggcuggagugcagugggaugauaucagcucacugcaaccuccccucccagguucaagugauucuccugucccagccuccugacuagcugggauuacaggugugcaccaccaugcccagcuaauuuuuguauuuuuaguagagacgggguuucaccauguugacccggcuggucucgaacuccucaccucaggugauccacccaccucggccucccaaaguggugggauuacaggaaugagcucccacaccuggccuuagacaguuucuuuuuccuagaauugauacagaaugugcaggaccuaaggaacucuaaggcuugaaagaauauaggacauacugaacucuaaagaaaggacuacgaggucuguguuuagcuucaauaauacuuagauggaacuguccagugggcaguuagaaauauggauuugaaacaucugggcaugguggcucaugccuguaaucccagcacuuuuugaggcaaaggcugauggauugcuuuaauccaagaguucgagaccagccugggcaacgugaugaaaccccaucucuacaaaaaauccaaaaaaauuagccgggugcaguggugaaugccuguggucccagcuauucaggaggcugaggugggaggaucaccugagcucaggugguggagguugcagugagcugagauugcaccacuguacuacuucagccugggcuacagagugagacccuguuucaaaaaaaaaaaaaaaagaaaaaaagaaaagaaaauggauuugaaacucagaagagagguggagcuaaagguuugcuauagauaaguagguguagaagcaaugggaguggaggauaguacccagagagagcauguggaguuaaaaaagaauacugggcugggcaugguggcucacaccuguaauccuagcacuuugggaggccaaggugggcggaucacgaggucaagagauugagaccauccuggccaacauggugaaaccccgucucuacuaaaaauacaaaaauuagcugggcaugguggugcgcaccugcagucucagcuacucaggaggcugaggcaggagaaucgcuugaacccaggaggcggaggugcagugagcugagaucgcacugcugcacuccagccuagcaacagaacaagacuccaucucaaaaaaaaagaacacugauuuuucacugacacaagucaguuugugggaaugcaugcaguacuguuuuuuuuccaaugaagauucuuuaaugacuucauuauaggccccaaauaaauaucuagcccaaaucauuuuuuucugcugcuucaugguuuuaugaggguuguaagguuuuuggucaaaaucucauacauuugauacuaccugccuuaccgagcucacuaaguugauacaaagguuuuggggcagaauccgagcuuuccuuaagggauagauauauugguagauuuugcugccuagaauaaauauuaacaguaauuuauuggcagaaugacucuaacguaugaaaaugauuggcagaaucuacaagcauuuaaucuuauuaaucuauagucacacuucauauaaguaaucuaauuuugccuguaauuuuaauaugugguuaaaucauauuuuucuucuuuguuuuuaucauucauuaguaauauucucuuuaauucuuuaggauacugaggauuuggaauuaaagaaaucauucaccagacaucauggagccuauauauccuuuugcacggccccagaugaauaccagguauagaaguauauuuacaaauauuugucuuacagcuuuucacauaacuugggaagguagguuggaagagaaaaaagaauauaaucuuuagaaucaggaaauucuggguucauauccuagcucuaccacuuguuaggugggugaccgugaucaaguuaauuaacuaagccucaguucuucaucuguaaaaugaggaugguaaucucugucucacagaagauuauugugugggguugaauaagauuacuaaacuaaagggucuaguauguaauaggcacucaguaaauacuaguuccgucccuccuucaauuauuuucguaauauagaucuuuauugaugggaaauaguaccugaacuuaggaggcuaaaaauuauaucgguguuuguuuacuuucuagacaagugggaaauugguuggguuccuucccucuuacaaauacugauuccuugaugggaauaauuucacauuagguauaccaaguuuccucagauguuccuaagccuuugucaagugaaguaggagcuugccaccugucuuccauuuuucucagucuguuacuauggggacugggcaaaucagcuuguauuauuuggcucuuuggaucauuuauugcucuuuuuuccccuagggaacgacaguuaaugcugacaugugaauuuuuuuuucuuccaaaccagaauugcauucaugggucgccuuuauucucuguaaugucuuucuuugugccagauguucuugaugaagauagugggaaacaugacccaaggaggcuaucguauuccuuuugcuuuaauuuuggcccuuguguucuaccccccugccaucucuuauuugaaaauuugucggugggcaagguggcuuaugccuguaauccuagcacuuugggaggcugaggugggcagaucgcuugagcucaggaguucaaaaucagccugggcaacauggggaaaccccauguugacagaaaaauuuugucuucuauucuuagaaggguacaguuguguaacaaguucaguguauucuguuuuuaauuaaaaaaauuuaaauuuuuguggguacaugguguauguauuuaugggguauaugacauauuuuuauaaggcaugcaauguguaauaaucacauaugggaaauaggguauccauccccuuaagcauuuaucuuuuguguuagagacaauccaacuguacacuuuuaauuauuauuauuuuuuuuuuuuuuuggagacagagucucacuuugucacuuaugcuggagggcaguggcgccaucucggcucacugcaaucuuugcuuccuggguucaagugauucucgugucucagccacucgaguagcugggauuacaggcgugcgccaccaugcccagcuaacuuguauuuuuaguagagacgggguuucaccauguuggccaggcuggucuugaaauccugaccucaagugaucugcccaccucagccucccaaagugcuaggauuauaggugugagccacugugcccagccuaauuauuuuuaaauguuauuauuuauuacuuuuaaguuguuauugacuauagucacccugcugugcuaucaaauaauaggucuuaaucauucuuucugguuuuuuuuuuuuaaacccauuaacugugucuaccucucacccaaccccuacuacucuucccagccucugguaaccauccuucuacucucuguguccaugaguuccauuguuuugauuuuuagaucccacaaauaagcgaaaacgugaaguuuguauuucugcuccuggcuuauuucacuuaacauggugaucuccaguucuaaccauguuguugcaaaugacaggaauuuauucuuuuuuuuuuccauuuucuuuuucuuuuuucuuuuuuuuuguuuuuugagacaguaucgggggaccugccccgauaaucacguagguucuuuucuguuuuccuaagcguccgcugccuugagaaauaaaaggacagaguacaaaagagagaaauuuuaaagcugggcuuccgggggagacaucacacguugguaggauucgugaugccccacaagccacaaaaaccagcaaguuuuuauuagggaguuucaaaaggggagggagugugcgaauaggugugggugacagacaucaaguacuuaacaggguaauagaauaucacaaggcaaguggaggcagggcgagaucacaggaccacaggacugaggcgaaauuaaaauugcuaaugagguuuugggcaccacugucauugauaacaucuuaucaggagacaggguuuucagaucaaccggucugacuacaauuuauuaggugggaauuuccucuuccuaauaagccugggagcgcuaugggagacuggaguuuauuucaccucugcaaucucgaccauaagagacagguacgccccgggggggccaguucagagaccuaccccuaggugcgcauuuucuuucucagggacauuccaugcugagaaaaagaauucagugauauuucucccauuugcuuuugaaagaagagaaauauggcucuguucugccuggcucaccggcggucagaguuuaagguuaucucucuuauucccugaacaauugcuguuauccuguucuuuuuucaggugcccacauuucauauugcucaaacacacaugcuguacaauuuguguaguuaacgcaauuauuacaggguccugagacgauauacauccuucucggcugacaggauuaagagauuaaagcaaagacaggcauaggaaaucacaaggguauugauuggggaagugauaaguguccaugaaaucuuuacaauuuauguuuagagauugcaguaaagacaggcauaagaaauuacaaaaguauuaauuuggggaacuaauaaauguccauaaaaucuucacaauccacguccuucagucauggcuucggccggucccuccauuuggggucccugacuucccgcaacaagacagagucucacucugucacucaggcuggagugcaguggugcggucucagcucacugcaaccucaacugauucaagcaauucucaugccucagccuccugaguaacugggauuacaggcgugugccaccauguccagcuaauuuuuuguuuuuuguuuuuugagauggaguuuugcucuugucacccaagcuguagugggguggcgugaucuuggcucacugaaaccucuucccccuggguucaagugauucucgugccucagccucugaacuagcugggaccagaggcgcguggcaccacaccuggcuaauuuuguauuucuaguggagaugggguuucaccauguuggccaggcuggucucgaacugcaggccucaagugauccaccugccuuggccucccaaagugcugacauaggugugagccaccaggccuggccccauuaguggucuuuuucuuauugugguuuucucguguuauacacucauguaaaaugaaaaguuuuugaugguacccuauaugauuuaauaucacaaccuugcuuuacacugccccuggcaucuuuguugaggaauuauuuauaauuauguccuuuugacgcuucaauaauuaaacuugugcuguauuuugguauuccagaauaccaaauuuggaaacacuggaaaauaauuaagaauuuauuaaguuuuuuugcuuuucauaacuguuggguauuaucuaacaauuaucuggaaaucaguucagaaagacagauuuuaggccaggagccauggcucaugccuauaaucccagugcuuugggaggccaaggugggaagauugcuuaaaaccaugaguucaagaccagccugggaaacauagcaggacccugugucuacaaaaauuacaaaaguaaaucucacgugguggugcacauuuguggucuuagcugcuugagaggcucccuugagcccaggaguuuaaggcugcagugagguaugauugagccccugcauuccagcuugggcaacagagcaaggcccugcucuuuaaaaaaaaaaaaaaaaaaggaaagaaaagaaagauuuuaguuuaaauuuaaauguaaauguaugauuuauacucauuuuucuguuacuuaaaagggauuuuguaggauugucuuguucuuuuuuuaaaagcuuguguauacauaaauuuacauaugcauagauaaaaaaggacaaauaagccaaauuuugagugccuauucuccugguaguagaguuacaagugaauuuucuuuuuuaaaaaauauuuuuugggccgggcgcgguggcuuacgccuguaaucccagcacuuugggaggcugaggcggguagaucaugacgucaggaguuugagaccagcuuggccaacauggugaaaccccgucucuacuaaagauacaaaaaauuaccugcgugugguggcaggcgccuguaauccuagcuacucgggaggcugaggugggaggaucacuugaacccagaggcggagguugcagugagcugagaucacgccauugcacuccagccugggcaacaggguaagacuccgucugaaaaaaaaaaaaaaaaaaaaaaaaaggccaggcgugguggcucacgccuguaaucccagcacuuugggaggcugaggcaggcugaucaugaggucagcagaucaggaccauccugauuaacagugaaacccugucucuacuaaaaauacaaaaaauuagccaggcauggugguaugugccuguagucccagcuacuugggaggcuaaggcuggagaaucgcuucaaccuggaaggcggagguugcaguaagcugagauugcaccacaguacuccagccugggcgacagagugagaauccgucucaaaaaauaaaaaaguauuuuuuggccaggcacaguggcuaaugccuguaauccuagcacuuugggaggccgaggcagguggaugacuugaggucaggaguucgagaccagcuugcccacauggcgaaaccccgucucuacuaaaaauacaaaaaguagccgggugugguggugcacuccuguaaucucagcuacucaggaagcucaggcaggggaauugcuugaacccaggaggcagagguugcagugagcugagaucacgccacugcacuccagccugggugauggagugagacuuugucucaaaaaaaauauauauauauaaacucuuugaaaauuacaaaaguagucugaaaauaccaucaccuuaaagauaguuaguuguuuccuaccaaaugucuaccaaguuugcuauuccuugugcuuuaauuuuacauuguuuuuucaaaagguuuccuucaagcaggaugguaccuuuccacuuuccuccaucaaaaugugcacuuuggaacccaacgccaacuggagauuucaucuacuuacaucucaguuacuacagguauaacauguuucuuuuuuucaaaucaagccaguauaaacaagaguaauacaaagauguauaaggcaaaguugauuacuaugaccaauuauucauuuuucuuuacuuuucuuuuagaaucuccccucaggcaaaauuuuccuucugcuucuuaacaucuguuccuuguacuuuugagagauaaucuuaucuucccaguuuucugcaaauucugcauauuguaggaauucaaaagaggugaaauauaguaaaaacugaaaguguuuuuuauuaugucagcauggugucuuuguggaacguugagaagcuugaaccaauuuuugaguggaucagauuagaaggaauauaaaaucuuguaguuacaucuaggaccuugacagacaagaaaguuuagguguaaaguaauagaaaauagaucuauugagguuuuguacauaagaguuacuuguuaaaaguaguauucuaagaaggauagauuauggcggggagagccuugagucagccuagcuucaagaugcuuuucuguaaucacacagguguauauuguaaugguuuaaggugcuauaacugggcugggugcaguggcucacaccuguaaccccagcacuuugggagguugaggcaggaggauugcuugaagucaggaguuugaaaccagccugggcaacaaagugagaccuugucucaauaaaaaauuaaaauaaaaaguaaaaaaaaaaacaaaauaaggaaaaaaaaacggugcaauaauuggagcagacugccuagggaaucaaauccugauucuaguacuuauuuaugcaaccucaguaaaguagccaaggaucaguuuccuuauuuauaaaaugacuauaauaauaccaguuucacaguucucuuguagggguuaaauaagacucuguaaagcaauugucacagugccuggaauagaaaguauuucauaaauggcaucuauuauacauuauaaggacuuagagcaauguagcaguauucagaucaagaggaaagaaugaaacaagguguuuugaauaaauaauuuguaguauuugaugauugacugaauagaggaacugaaggaaagauacaagaaagaaaguauucggguucaacacuaguuggcagagaagggugguaccauugacaaaaauagggagagucuuauggaaguucaacuaaauaaugguuaguccuguuuuuauuuuuuuuauuguugucuuucuguacauuuugaguaguuuccuuuguuuuucaagucugcuuauuuucucuuuagcugugcuuagcugccaucuaaccuauucauuuaaguuugguuguuuuuuuugagaggaguuuugcuguuguuguccaggcuggagugcaguggcgugauguuggcucacugcaaccuccgccucccauguacaagcgauucuccugucucagccucccaaguagcucgaauuacagacaugugccaccacgccuggcuaauuuuuuuguauuugguagagaugggguuucaccauguuagucaggcuggucacgaacuccugaccucaggugauccaccugccucauccucccaaagugcugggauuacaggcaugugccaccacgccuggcccucauuuagguuuuuuaaaacguggcgguguaccauauauaugagaggauacuuauaguauauaugcauaguuaauagaauaacaauacacauuuguguaccuauccccaguuaauuauauaacuuauugaauuuuugcaaauuauauuuuuuauuucuuuaaguucuguauggcuuuuuuauucaaauuugccuggucuuuuuucguaguaucuuauuccuggcuuauauuuugguuuuccuuuuacauuuuuuaaagcauuuaaaucauacuauauuuuguauucaauacaguaguuuccccccuuuaugcaugguuucacuuuccaugguuucaguuacccacaguauaauacaauaagguauuuugagagacagaccauauucacacaacuuuuuuacaguauacuguuaaaauuaugcuacuauuaauuauuguuguuaaucauuuacugugccuaauuuauaaauuaaacuuuaucauagauacguauguauaggaagaaacauaguauauauaggauuuguuacuaucugugguuucagacauccacugggggucuggaacaugucucccagagauaagggggcacuacuguaaugcugauuauaucugaagcccauacacaguauguaaagaaacagaugugacuguuucaaucaaaauuuacuuacaaaaacaggagaccuaccugcugagguucauaaaguuaacaaaaugccuggagaacaacuauaguuucagugucuguuuauugccauucuaguuuccaaguggcccuccguauccccugccuuugacccugggauuuccugacaaugaucuuucuguacauuuuuaaaaauguguguuauaauuuagacagcauuuuauggcaggagguuuuuuuaagauaugaggucuaccauauucauaaaagacuuguuguuuuucagaaauccaaagcuuguggugacugagaagaccauccgacuugcuuaucgucaugcuaagcagaauaaaaaaaauucgucaugcuuuuuacuugguucucugacagcagacgaagguaauacacuuuuaaaaauggaccagugcucacgccuguaaucccagcacguugggaggcuggagugggaggaucacuugaaccuaggaguuuaagaccagcuugcauaacauaguaagacuccaucaguacaagaaaacauuuuuuuaaauuacuuguaugacugcaauagaauuuauugauucggccaacuauuguauuugcuuugcgcuaauuuucuuugcuguguaccaaggauaugaagaugaguaaaacuauuaauuacagaguucacugucuggucagauggaucaauauauauaagcaaguaagacuuuaguauacgcuuauaagaguuuaguuuacuguaagaguuuaguuuaguauuuaagaguuuaguguacuauugguaugaacaaagugcuuugcuauaauguagucuugcuugguugauuuuauguuuuuaauuaguaugcuguauaauagcuguuauuuuuguucuacagaugaagaagguguaacauugacaguagaucgcuuugauccuggucgagaaguaccugaaugccuagaaauaaccccuacugcuucucuuccuggggacuuuuugauuccaugcaaaguucauacucaagaacuuuguucaagagaaaugauaguucacaguguagaugacuucaguucagcuuuaaaggugcgauucauugacaacuugauaguuaauucaacacaagaaucaaacuauguuuaguaugcuguauuuuaguaaaaccauauuugagaaugauuuacaauaauuugguugaauuauugugaaccuaaaauccaacuaaauguguuugugagggcaaaaacucuagguaagcgauaugaguagccuuucagaagaagcaguguaaccgagauaagaaaguucaagauguacuuaggguaguguuuagaguauacauuuuugcugaauuugugggcagucagacuggaguauuaauuuggucagauuauagagaggcuuggcugggcaugguggcuccugucuuuaaucccaacacuucgggaagcugaggcagguggauugcuugagcccgggagguugagccgugaucacaccacugcacuccagccuuggugggagcaagacccugucucaagaaagaagagccuugucugccagccugaugaauuugaacuuugucauaugggccauguagaaauugaagguucuugaaaaaagaaaacacugucaaaucagaaauaguuaaucugauaggguaggcugaccgaaguuagaguagccauuguagaaguugggcagguguguauuauagagggauguauuaaccuauaguacaaugguagcagugaaacuaggaaggacacagugggcaugggcaaauacagagggagaacuaacuugacaauuugugguaacaagaaaggaaucaaagaggaauggacuuuagauucucugaggcucaaucggaauuauuuuaugaggccaggcacgguggcuuacgccuguaaucccagcacuuugagaggcugaggugggcugaucaggaggaguucaagaccagccuggccaacauggugaaaccuugucucuacuaaaaauauaaaaaauuagcugggugugguggcacacaccuguaaucccagcuacuugggagguugaggcaggagaaucgcuugaaccgggagguggaguuuguggugagcugagaucgcaccacugcacuccagccugggcaaaaagaacgagacuccuucucaaaaaaaaaaaaauuauuuuauguccauuuuuucccaugugguaaauauuuauugggggugacuccccaauaagacugaagugcugcugggauaucuacauugaaaauguguaguggagcuugggacaguaaaucuuacuugcuuugauauaauuauucacauaaucuuuuggucacauggaauaaacgagaacugaaaugcuguaaaucagaacucauuuaauuuuauuugugcaagauauuauauauguauauguaucaguauaaaauaaacuuuggcgauaugggcacauuucaaaguuuuaaaauaauuauuuaauauugauuucucaggcucuacagugccauauauguagcaaagauuccuuggacugugguaagcugcuuucccuaagaguucauaucacuuccagggagaguuuggacaguguggaauuugacuugcauugggcagcaguaacucuagcaaauaacuuuaaaugcacaccugugaagcccauccccauuauuccaacagcucuggcaagaaacuugagcaguaaucugaauauuucucaaguucaagggacuuauaaauauggguaaguaaaagauacauuaaucuaaauguuaguugcauuaguauauuuucagaauguccauguaaugugaaagaauuguccagucaauuuauaugccagagauaugguggcuugguuaauaaccagggaaaguaaaaaaugaaaugguuuauuuucguugaauaugaaauuuucuuuaaguugugccaccaccuacaaaaaauuggugguagggccuggcgcaguggcucacaccuguaaucccaguacuuugggaggccuaggcgggcagaucaccugaggucaggaguugcagaucagucuggccaacauggugaaaccccaucucuacuaaaaauauaaaaauuagcugagcgugguggugcaugccuguagucccaguuacucgggagguugaggcaggaggaucacuugaaccugggagguggagguugcaaugagcugagaucgcaccacagcacucuagccugggcaacagagacuccguuucaaaaaaaaaaaaaagacaaaacugaguggccauaaaguauaaugucuggauaacucaguucuuuuuuugagauggugucuuguucugucacccagacuggagugcaguggugggaucuuggcucacuguaaccuccaccucccugguucaagugauccucccacuucagccuccugaguagcugugauuacaggugcaugccacuacaccggcuaauuuuuguauuuuuaauagagaugagguuucaccauguuggccaggcuggacuucaacuccagacuucaggugauccuccugccucagccucccaaagugcugagauuacaggggugagcuaccaugcccagccccagagaccucaguucuaaaaaaaaaaaaaaaguggugguaaaaauuauauuaaaauuggaggccgaggcggguggaucacgaggucaggaguucaagacuagccucaccaacauggugaaacuccaucucuacuaaaaauaacaaacaaacaaaaaagcugggcaugguggcacgugccuguaaucccagcuacucaggagguugaggcaggagaaucgcuugaaccugggaggcagagguugcagugagcugagaucacaccauugcacuucagugugggcggcagagcgagacucugucucaaaaaaaccaaaaaacaaaaaaaaacaaauugguugauaauuuauuauuugaaaauguaagaggaaauuguguucuauauuguauauucuguauuauucuuuguauuuuauuuagguuuuaggccuuuuuuuuuucuuaacuauaaccuaauuaugaacccaagggaggcuagagaauucauuuauaguaugugguuuuaacugugaauaaugagcauugcagauagagaaaggagauaauuaaauaaaaaguuacaguacucuugcuuaccaaauugccaacuacuugaggguggaguuuccucacagagcuggaguagaauccucuccagcuuccuaucuccacucuuaauuucuuaggaaauguaagccaaaaugcaugcuuucuaaucuucagcaaggcugcuucccugaaucuucaucuauuuucuuuaucuauuauuuauaaaacuagguuagacaauauaacuacucuacuuuaaaguuugaccagagacugcuccaaguauuacacuucugguuuccuuucccagugacuccacccuaguuccuguuaggccauucaaucuaaaaauguuugccaaaguacacucaauuccaagucuuauucucuaaaaauaccucuucagaaccagauucugaccagagcugugcuuucugauuggaguggcccaaaggaaaaauugguauauuccaaaaucauggaguggucaaaagugagcaaaaauuguuugaauuaaaugaaacauuuaauccucuuaauuaauaaaguacuucucaaguggagcaugggauuuuuuguuuaaauuaacaaaaaaauuaauuuguuuucuuuaguacccauccccauuuacuuguauagcaugaauuuaccuuucuuggaauuauccaucugugacugcugggcgggcaugcugguaauaaccaggauguucaguauucugucaaucaccuauucuccuugccacuuccuaucuagaaucgucuauuaaauuggugacauuugccaugccagguacauugacacacaccuguaaucccagcugcuugggagagugaggcaggaggguggcuugagcuuaggauuucaaggcugcaguaagcuacaauagugccugugaauagccacugcucuccagcuaggacaauguagugagaccccaucauuaaaaaaaaauuugacauuugcccuuuauauacccuaauauuuacuagggcccauuauggcauaggcauuauguuagacauuggaaauaaauagauuaaaaacuauacuuacuaucuauugaauauguugacauguaaacaugauguguuauaauggagguuuauauacagugcugggaaaguagggggagggauguccaaaaugccuggggaaaucauggaaagccugaacuaauucuuuuuuuuuuuuugagauggagucuugcucuguugccaggcuggagugcaguggcacgaucucagcucacugcagcaaccuccaccuccuggguucaagugauucuccugccucagccucccaaguagcugggauuacaggcgcccgucaccaugccuggcuaauuuuuguauuuuuaguagagaugggguuucaccaucuuggccaggcuugucuugaacuccugaccucaugaugcacccaucucagccuuccaaaguguuggaauuacaggcaugagccacugggcccagccagccugaacuaauucuuuuaaggaguagaaauuuaucagaugggcaagacaugagggagaacuuuuaaagcagcugugucauuguugauuuguaaaucuuacgccaacucaggcuuaauauucuugucacaagaccugacaaauguauugucuuuguguuuuaguguuauuagagcaauaaaauauaucaucagugguacugccaaggcuuuauaucacuaauggcauuguuuuuguuuucuguuuuugagacggagucucacucuguugcccaggcugaagugcaguggugcaaucucggcucacugcaaccucugcuuccuggguucaagugauucauucuccugccucagccucccgaguagcugggauuacaggcgugugccacaaugccuggcuaauuuuuuuuuuuguauauucaguagagaugggguuuugccauguuggccaugcuggucucgaacuccucaccucaagugauuugcccaccucggccucccaaagugcugggauuacaguaagcgugagccaccaugccugacccacuaauggcauuguuuuugaagaaagacauaacaauaaaauuaacaauucuacuuugguuuuuuguauucuuauaacuugcugucaauaauaaauauaauaaaauauaaauauaguauaauguccuuuuaggaaagagugagcuuuuguguuuuaugaugguuccaaaguccuuugacagugguuggaggaauauggcacauggaagguugaucauacuucuccuaauucagucuccuucacuuagaagucacaucuguugcagucuugucaaaucacuuggaugcaugaacauuuucuagugauagggaauucaguucuuccaaggaaaccuauuugguucugaaacugccuaccuuaauguuaacacucuugauuaaaguaaauuguaaguaaaguuauagagcaaaacuuuuaaaaaagguguauaaucuucaaugucuuuuaauugauagauggaaguuuuaagguauuaaaucucuuuaaucucuuccucuuaccagagucuuuuuacugagucaguaaaaaguuucuguuucuuuugugugugcaagacaacguucauuugaauuaucuccccuuucuaaaguaugcuucagcauuuagauuaugucuuuuagguaaaaaguacauaauuucaguuauuuucacaugaaugucuucuguuuagauaucuuaccauggaugaaacacgcaaauuguuacuuuuguuggaaucugaucccaagguuuauucucuaccauuggugggaauguaaguauuacauuauuuaugaaaaccuuaucagccaaauguucaaauguauaugauaagcaugugacucaguuguacuauaaauauuuagaucauuuuauaaagccacaaagauaagugguugucagguuuucuuauuuuacuaguagaaucagcuaaaauaagauuuuacccaaucuuuuuuuugagauggagucuugcucugugcccagacuggagugcaguggagagaucucggcucacugcaaucuccaucccccagguucaagugauucucgugcuucagccuccuaaguagcugggauuacaggcgugcaucaccaugccuggcuaauuuuugcuuuuuuaguagagacgggguuuuaccauguuggccaggcucgucucgaacccguggccucaagugauuuacccgccucagccucccaaagugcuuggauuacaggugugaaccaucaugcucagccagauuuuguccaauauuaggaagaacucuaacauauaaaacagauaaaagcuuaauucuauggccaggcgcaguggcucacgccuguaaucccagcacuuuuggaggcugaggugggcggaucaccugaggucaggaguucgaggucaggaguucaaggccagccuggauaacauggugaaaccccauuucuacuaaaaauacaaaaaauuagccaggcaugguggugcgugccuguaaucccagcuacuuggcaggcugaggcaggagaaucacuugagcccaggagguggagguugcagugagcugagauugcgccauugcacuccagcuugggcaacaagagugaaacuccuucucaaaaaaaaauaaaaaauauaaguugaauucuccugguugaaggugaaggcuuagagcccuguuucuucaguauucucucacuaccacucauccuuaagucacccuaaagaacucagggcucauaauaauaccauuuaaaauccacugucagucaaucuugcagaaaucuccuuuaguguuaauggccuucucuuuagaguaguaauuaaugauauuuauguguuuacuuuuuuuuauauauguauacauguuuugagacagggucucacuuugucacacaggcuggagugcaguggcacaaucauggcucacugcagccucaaucucugggguucaggugauccucccaccucagccuccugaauagcuaggacuacaggcaccggccaucacgccuggcuagguuuuguauauuuuguagaggcgggcuuucgccauguugcccaggcuggucuggaacuccugggcucaagccaucugaguuaaugauauuuagacagaauauuuagaaauuuauauucauucaguauugaguacuuauuauauacaguguuaugcuugauaauguguugagguuuaaagcuucuuaaagaauuuaaaaucaaagugaggugauaaaacauucaaauauucauacacagaaaaauaaaguauaugauuuacuauaaagugaccaguauggaaagugaacacuuaguauuuguaagaaagauaugauagggagcauuuuccuagagaagacaaacuugagcuagacuuucaauuguuuagauaguagaagggaagauuguuggggaagggaacccauguaagggaauggcacaugcaaagugaaugagaaugcaugaauguucucuggaccaugaaaucuacuuauaguuugcuacaguccuaauauaggcaauggauuguugaugcuuaaguaaauauuaagagccuucucucuuucugacuaccuguauauauuacagcauuuaauccucagcaacucugugaaguaguuuuaggcugcaaauuagucuguacuaccuuagcccauucuuuccaguccaagcuaauucauucuaguauacugcuuucaucucuguuaaccauuuucuuucccacaucucagguaaaagaggacagagauacgcgugcuugcucucuuucucucucucucucucgauauauaucuauaugucugucuauauauaucaauauaguuauauauauacaaaugucuauauauucuuccuuuuaauuaucagcacguuuuuagauuucuuauuacuaaggcuuuuuaauguauggcugauaaaagccauacgucuacuuuguuaucuuaggaagaauguaaauuaugcuauauauguaagugacuaugguuuuuaauuucuaucuuuuucuuuuaguuggcugucuggaauuacacauaucuauaguccucagguaugggcuugcuguuugcgauacauauucaauucuucuguucaagaaaggcaagugauauuuuauucuguaguacuuuauuucgauccuuucccccauucauaguuuauggucccauuuaaaauucauguaaugccguaaccuuuuacaauacuuauaaauaaacacguacauuaagaaaaaacaaaccuuauauuaaaugagaauaaaaccagauuaaaaaaagaugagguugcaguauaccuggaaauaccaaggaauucacuugccuaaccacagaacacaaaccuuuuggggguggaaaaaaacuguggagauugucuacuguagcauccuauuuaauaauuaaggagguuaacuuucagugaaaugacugcaaaugaguuuggauuuguuaccuuacagauguuuuauuaaguuacacaguguuacuacuaauacacaaagaaauacuugagacaagauuuuuaauuucuuccugaaacugaagccuaaacauuggaauuaauaguuagggaaacuuuacuuuuaaccucaacucauuuaauagauaaagaaggugacaucuuugucaguauuugucucucaccuucuuuaucuauuaaaugagaaggucuauuuuuaucuaccuuggguggcuguaaaggacuuaaacuauauugaaaaggcaguacaagcacauaguaauaaauugacauauguaaauaucuacaauaaaaguagaucucucuuccuccccauuucccuagaccccauucucagaggcaaucacuguaaagugauaucuugugcuuccuuccugaaauagucaauauuucaauacucaacauagacaaguaucaccuuuuccuggccuguaaaaauuaaaccauagcauccuuucuuuucuuuauguugcuuuuuucuguauaaauuauaccuuggagaucauuaccucuuggcauauacagauuuaauauacauauuuuacaacugaagaguuuauaauacauacuguauuuuaaaaacuggcccuuuugucuugcagauagugguagacugaacauuuuaugcauacaucuuugugugcauaugcuaguauauuuguaggauaaguuucuaaaaguguuuuuuucuaggccaaagaguauguaauuuaaaauuugguagauauugccaaauugcccuucaaaaagacugcaccaauuuauaauuuuuccagcaguacacgagagugccuuuuucucuaccugcacuaacacugugaaagaaauauuuauuuauuuauuuauugagcaccuauuauaucuauuauguucacaguacuggggaucagaguaaacaaaauaaagguccccagaccaggcauggugucuuaugucuguaaucccagcacuuugggacuuugggaggcugaggcaggaggaucgcuugaggccaggaguuccagaccagccuggguaccauagcaagacucugucucuaacaaaaaaaaaaaacaaaaaacaaguuagcuggguguaaugacacaugccuguagucccagcaggagacugauaugggaagaucgcuugagcccaggaguucaggcugcaguaagccaugauugugccacuguacuccagccugaacaauacagacccugucuuaaaaaaauaaaauaggccaggcaugguggcucacaucuguaaucccaacacuuugggaggccaaggcggguggaucacuugaggccaggaauuagagaccagcuuggccaacauggugaaaccccaucucuacuaaaaaugcaaaaauuagcccggugugguagagcaugccgguaaucccagcugcucgggagguugaggcaggagaaucacuugcacccaggaggcagagguuacagugagcugagaucgcaccacuacacuccagccugggcaacaaaaaauaaauaaauaaauaaaaaauaaaauaguccugcagagacaggcaauaaacagaauaaauaaaauaaauaguauguuaaaaggcgaugaguacuguggagaaaaauaaagccugagaggaggauguugugugucugaaugauaguggcaaguaaagaguugccguuuauuuauuuauuuauuuaauuuuuaauuuuuaaauuuuuauuuauuuauuuuauuuuacuuauuuuuuuugagauggagucuugcucugucgcccaggcuggagugcaauggcucaaucucagcucacagaaaccuccaccuccuggguucaagcguuucuccugccucagccuccugaguagcugggauuacaggcaugugccaccaugcccggcuaauuuuguauuuuuucaguagagacaggguuucuccauguuggucaggcugaucucgaacuccugaccucaggugaucugccugccuuggccucccaaagugcugcgauuacaggcgugagccacugcacccggccaagaguugcaauuuaaauagguggucagggaggccgacuuaaggugaggaaguaagccuuguggcugucuggggcacuguccuaggcaaaggauguguuaaguguaagggcucugggugaaacaacacguuacaucuucaaggagcagcaaagaggccacuguagcuagagaggagugaaggaaggggagaguagcuggagaugagcucagagaggugaguggagggcuguuguuaaacuuuugaccucugcuaaccugauagaugaaaaauaaacuuuuccaaugauuuauaaccucaucuuccaggaacugccuagucaugucuuuagccauuuuucucuuagauuguguaucuuuucuuuuuuuuuuuuuuugagacggagucuugcucuguugcccgggcuggagugcuguggcgcgaucucggcucacugcaagcuccaccucccggguucacgccauucuccugccucagccucccgaguagcugggacuacaggugcccgccaccaugccuggcugauguuuuguauuuuuaguagacaggguuucacugugguagccaggauggucucgaucuccuggccucgugauccgccugccucggccucccgaagugcugggauuacaggcgugagccacugcgcccggccugugcaucuuuucauauugcuugugcuagcaagcucucucucuauauauauaauguaaaauacauagagaaacacauauugaugauauauaguaacgguuuuccccccagauugucauuuaaguuuaacaauauuuuucccaaacagacuuacuguuuuuuagucauauuuauuaaucuuuuucauaucguguuuagaaaagauucacccacuccagguguauuuacugaaguaaaaaaaucacuuguauuuucuucagaugcuuuuggaguucuacuuuuaacauuuuguuuuaacuuuucaagauaauuaguuauauuuagauagcagaaauuaaauguuaguuuuagauccuuugcuaugauuuaguacaauuauguuuuauuaucaauuacugaucaugcuuuaaguucauauugacaguaaauccucaguaaaauuaauuuugaauugcucucuuauuccuuuuuuuuuuuuuuuuuuuuggagacggagucuugcucugucgcccaggcuggagugcaguggcgcgaucuuggcucauuacaagcuccgccucccggguucacgccauucuccugccucagccuccugaauaaaauaaaauuuuguuuuguagagaggaagggucucacuauguugacaaggcuggucucaaacuccuggccucaagcgauccucccaccuuuugccuuccuaagugguggaccccaguuuuugaacaaaaauugcaccuuuuagucauuuuguuaacuagauugggagacucacaugaaguuauuugagugucaucauguuauccucauuaaauuuuaauuaaaugacuuuuuuugugcaggguuuuuucagaaucuggaaauuucaucauaguucucuauucuaugacacauaaggaaccugaguuuuaugaaugcuucccuugugauggcaagauaccugacuuucgguuucaguugcuaaccaguaaggaaacauuacaucuuuucaaaguaagugauuucauugucuaguacauuagugacuguuuaggguuuugcacuuuggcaguuuaaacccaacagcuuuuacccuuuaaaauaguaauccaaacuauuaugcuuuguuuacuuauaaauaaucuuauuaaauauuaacuuuauucauuuaugguuaaauuuuuuuaguaaaucugagaucauaucuucaaccaaauuacaauagagaaccagagguuacucacagaauaacuugcccauguuuuucuaaaaucuuugaagaauauaucaguuguucauauaucauuuuauacuugugaagguuaacuuugugggaucucaguacuuuucuuuguccugauguuuuuuuuuuuuuuuuuuuuuuuuugagauggaaucucacucaguugcccaggcuggagugcaguggcgugaucucggcucacugcaaccucugccucccagguucaagugauucuccugccucaaccuccagaauagcugggauuacaggagcccaccaucacaccuggcuauuuuuuuuuuuuuuuuuuuuuguauuuucauuagagagggaguuucaccauguuggccaugcuggucucgaacuccugaccuuaggugauccaccugccuaagccucccaaagugcugggauuauaggugugagccacugcaccugaccaugacuguauuauuuuuaaaaugugugggaauaagaaaugguuuuuuauacuuaaaggccauuauuuauauuauguaucuaaggaaucagaauagauuguuacuauaucaucuaauaaaauaccuagaaacacaacuagaugaugaucauagaaaaaguagaucuuuaggccaggcguggcggcucacaccucgaaucccagcacuuugggaggccgaggugggcggaucaccugaggucaggaguuugagaccagccuggccaacauggugaaacucugucucuacuaaaaauacaaaaauuagccaggcauagugccaggugccuguaauccuagcuacuugggagacugaggcaggagaaucacuugaaccugggagguagagguugcagugaacugagaucgugccgcugcacucuagccugggcaacaagaaggaaacucugucucaaaaaaaaaaagaggaaguagaucuuugaaacuaggugucauuauaugaaaauauucaaaugcuacuuuucaauaaaauuauugguuauuuuaggucucagacuaauaaaaguacauucuuuauuagaaaaauauugaauacuuuuaaauaaccacguguccacucagaucguauuuaguaccuucuuugagaucauguauauguuauacaucuauauauuuuauauaaauauauauuuuaauauuauaauauauacauuauauuacauauauguuauauauaaaauaccuuuauauuauauauuauauacauuuuauauuuuauagguuauguaagcuauaaaguuuuuguauuuuauaccuaucauuuuaacugagaucuaauauuucuguuuuagagacauauuugucauuuuauucuuuagaugguauucucauuucauaguuauauucacugaaucugugauuauaacacaagugauuaacuuuuucacuuauguagcagggaacuggacaguuuacaaaagaggguuacagaaaucagaagucugccacuccaucaucuaguguuucagagcuacuuuucaucuaaauagaauucucugguguucuuauuuaagucagaucucaaaauaugaccuacuucauuucagaauguugaaccuccugacaaaaauccaauccguugugaacugagcgcugaaagccaaaaugcagaaacagaguuuuucaguaaggcuuccaagaauuuuucaauuaagagguaaaagaucuuuuuguuauuauguguguguuuuuuuaaaaauuauauuuauuaguuuuuggugaguaaaauaacuaaauuauuucugaugaaaugauuuuuuaaaucuuauguaccauaaaugucuuuguuuuaaaugcauuccuucauauucacuaggaaguuggauaguaauuuuaaugaaguggcaacucuaauaugguuuucauuuggguugauguauuauacaggaaaaauacaaaaguauuugucaaaaaauuaucuugcuuagcaagaaucugcucccuguuuuguuuagugcuuucuauuuguucuucccuuccuuauaaguuucuuauuuuaauauuuaaauuaaagguggggucucgcuguauuggccagguuggucucgagcuccuagccucaagugauccuucugccuuggccucccaaagugcugggaucacgugugugaaccaucguccccaacccuuccuuauaguuuuaaaucuggaccuaucagauaaacuacuauaaaauuaacuacuagcuggagugugauggcucacgccuauaaucccagcacuuugggaguccaaggcgagcagaucacuugaggucaggaguuugagaccagccuggccaacauccuuaaaucuacauauaauacuggucauuucucccauuuuauaggugagaaaagugaaguguagagaaaucacauaggaaauguacaguaaaagacauuacacacacucagguccugaaauugaucacccaguguuuuuaaaacauuaaucacuagaauucuauagugcauuuuaacauuugaaacagcuaauauucuuucuuucucagaacuuuucuuuuuuuucuuugagacagagccucgcucugucgcccaggcuggagugcaguggcguaucucagcucacugcaagcuccgccucccggguccacgccauucuccugccucagccucccgaguagcugggacuacgccaggcuaauuuuuuguauuuuuuuuaguagagacggaguuucacuauguuagccaggauggucucgaucucuugaccucgugauccacccaccucagccucccaaagugcugggauuacaggcgugagccaccacacccggccucuuucucagaacuuuuagggaucauuuggcaggucuucaguguuauuuuuuaaaguuccucuccucaagcugcaucuucuccauuuaaaaaaaaaagccauugaaguuggaauauugaaauauaaagcugugggugauuaaaucaaacgguaacuagugguggggggcaggcagauauguggagcagacuauaguucagaaauagaugcaaacauaugauacuuucauuauacaauaaaaaaugcaucucuugcugggugcaguggcucacgccuguaauccuagcacuuugggaggcugaggcgggcggaucaguugaggucaggaguuugagaccagccuggccaacauggugaaaccccgucucaacuaaaaauacaaaaauuagccggacgcacuggagcgugccuguaaucccagcuacucgguacgcugaagugggagaaucgcuugaacccgggaggcagagguugcagugagcugagauugcgccacugcacuucagccugggcaacagaguaagacccugucucaaaacaaacuccuaccuaaaaaaaaaaaauuguuuuaaaacuucuaaaacacacuugaagaauauuaauuaaauaaagucuugugacuucuugggucagcauauucuaccuuuugugguaaagaagauauucucggccaggcccgguggcucacgccuguaaucccagcacuuugggaggcagaagcaggcagaucaccugagucucgggacuuggagaccagccuggccaacguggugaaaccccgucuuuacuaaaaauacaagaauuagccgggccugguggugcaugccuguaaucccagcuacucaggaggcugaagcaagagaaucacuugaacccaagaggcacagguuguagugagccgagaucaugccacuacacuccauccugggugauacagugagacuccaucucaaaaaaaauaaaaaagauauuaucuuguauuaggguucuccagauuaacagaaacaacaagauguguguauguagagauauuuguuuuaaggaauuggcuucuguguuugugaagguuuggcaaauccaaagucuacagguagaggcugagcacaguggcucaucccuuuaauuccaguacuuuggaaggcugaggcgggaggauugcuugagcucaggaguucgagaccagccugggcaauguggcgaaacccugccucuacaaaaacagaaaagaaguacagaauuuagcugguugugguggcacaugccuauagucccagcuacuugcagggcugaggugggaggaucacuugcccaggaggucaaggcuucagugagccauguucguggcacugcacugcagccugggugauaaaaugagacccugucucaaagaaaaaaaaaaaaaaaaagacaaaaaaugucuacagguaggcugguaggcuggacacccagggaagaauugcaauuugaguccaaaggcagccugcuggcagaauuccuuuucccuccaggaagucagucuuuaucuuuuuuuuuuuuugagauagggucucacucugucacccaggcuggaguacaguggugugaucucagcucacugcaaccuccacuucgcagguucaaggaauucuccugcuucagccucccaaguagcugggauuacaggugugcaucaccacgcccggcuaauuuuuguauuuuuaguagagaugggguuucaccauguuggccaggcuggccucgaacuccugaccucaaaugauccacccaccuuggccucccaaagugcugggauuacaggcuugugucaccucacccagccaggaacaucuuuacugucuuaaauuuuaagaccuuauucaacauuuuauugaauauuuauggaagaaauagccaaacuaaggagacaauagcaauuucuuuaagauuguuauuaaaagcuacucagaaggcugagguaggaggaucacuugggcccaagaagucgaguuggggagccaugaucaugcuaugccaacugcacucuagccuaaguaauagagugaaacccggcuucaaaaaaagugauguuaaaaaaccuuguuuauuuuccauucuggccuaagcuuuaaugaggaacagucauuuuaaauguuaucaaaauguuugucucuccuaaaguacuguuguuauaacuauacaaccugaaguuuuuccuuuuuucccuuggguacuaaaaaagcuaagaaaugaggccaggcacaguggcucacacuuguaaucccagugcuucgggaggcagagguggguggaucaccugaggucaggaguucaagaccagccugaccaacauggugaaacccugugucuacuaaaaauauaaaaauuagcugggcgugcuggcacaugccuguagucugagcuccucggacgcugaggcucaagaaucacuugaaccuuggaggcggagguugcugugaacugaagucaugcuacuguacuccagccugggcgacagagggagacucuauccaccccccacccccccgcaaaaaaaaaagcuaagaaauggguuuuauugcucagugucaacgguuuuguguguauauucaucuuaaguacaaaacagauauuaauuccaugccacaacucagguauacaaaagaauguaacuuaaaaaaguuaguaauugaacuuaauaucuauuuuaagccccuauuuguucuacugaauuauagacaccaaauuucaccuaauucaagguuucuuuauucccuuuucucugggguuauauguaauguagaggggacuaaugguaugccaguacuggugauauggggugacgugauucucauccaucugugcuacaaucugcugagguguuuucauuugcaucuggucuuugucagauuugugcaaguuccugcugcaacuuuugacccuguucaggccacuggcucucuuguuuccuguccaugcugcacugagcgcuuuggaauaucauuauguaucucaagcugccuuggguguuggagaagagcuuugugggacugaagacccauuucugcuuaaacauaaucaugcagacauucugauugcuucauuguaauaccuuguacagaaagaacucugugaaggucuaccucuucagacaaucaggguuuagggcaaaaggucucuucugcuguuugauuuucaaaccugccuuggaguuucuuuuguucuuccugcuagggaggauucaacuugcaugaaacagaaugcagggugcuuuuuuagggaucccauuaauccugagcgcuguuagcuuucauucuggcuuuucuuuucccuaaugcauccuauugagacuuugucuaguguaggauguaaaaaagccugaugcauauaguauuccaaaucuuuagucuuaaacacuaauuucagcuuuuaaaacuugguaccagcacucagaaauuuucuguuuugcugggcaugccaucugugauacaaugaguauuccugacuaaaugggaggguaguacuuugauuuuucaaaguauuuucccaucauagauauaaguacauaggaaaauauaauuccuuauuugguuuuccuuuuuaauacagaggguuuguaauauaguguguuuaauaaccuuuaauacuagauuauaaauuuuuugacagcaaguacuaagucuuacuuguuucuauauuuaucgaagugaucaacuagagggugcccagugacuugauuuauugugacauuaacaauacaagguuaaacuugcuaucaucagguaaauaggguaguuuauuaaggcuggcugguccagcuucccuggucaacuaacacuggccugaaaaauaaaauaauuugugguugucagauacuaaauuaaaugaucugaguacuacugcaacuuauuaaaggacuuuauucaauuucuagaagaaagaaaacacuggauuaccaaaggcuuuucuggucuccccuucuauucuuuaggucuucccaaaaguuaucuucugggaagaugccaauacaugaucacgacucugguguugaagaugaagauuuuucuccaagaccaauuccuaguccucauccagugagucagaagguaucacugauuuuaaaaugcauucacuuuugugguuagagaccuaagucucuucaugguuaaaacacuaaauaauacuaccugaaaccuaaguaucauucuuagauauaucuagcuauuucuaucucuaugguuauaucuauauauagagauauaaguauuucacaguuauauauaauaauucauauuauauguaaugauauauacauauguguaauaucuauguaauaagcauguaugguuauuccuagaguaaacugagacauagauugguuaaguuaccuacccaagacacacaacuaguaaguaguaaagcugggauucuauuucaggagguuugguuuuagaaucugguacuuuuaauaaccauauagacucaacauuauauacuaucacuagagcuugacauugguuuuuaucacuauauucugagaaaacauuauacuugcuuucagagguuaauugcuaaaauucuugucauaauuuuuuuauugcuaccaaccugugggucauuuuagaauuguuuaauucuuauuuuagaagaaaaaggaaugggaaggauuuuuuaaagcuaauaucaaauuauaaccaaauucaucacagcgaguauuuuguuuacucuuuuuugcuuuccaccucuuaguugauaucaauagaaggaauaacagugagugacuucuuaguggagaaauauuuugaaacauuuauuggaagauuuuacuauuuaagguacauaaacauuugcuacuagaucugugaaaacauucugcuugugacaauuuuauuuuuugcagagaggauuuaaaaaguuauauaaaacaguuucucauauuguguucugugaucuuagcaguguuaguguuuuaauaaaaagaguuccauuauuaaauaaguuugggaaguguuuaguuuuauucuuuuagggcaaggaccuuguuuauuuagcuuacaauugcauuccuagugcuuagcacauaaaacaugcccagaaaaaauuaacugauggucuaaauaaagaaugaacacuuguuaauauguaauuagauauaauuugggaaauacuggucugaggaaaguaaaguauacaguuucuccaaaaaaauacuuuuuuuuucuauuucuuucuuauuuguagauuucuaagauccaaccaucaguuccugaacuuucacuuguguuggauggcaauuucauagaaucaaacccucugccuacuccauuggaaauggugaauaaugaaaauccuccuuugauuaaccacuuggaacacuugaagccauugcaaccccagcuuuaugaugagaaacacaguccagaaguugaagcuggagagccuuccuugagaggaauaccaaaucaguuaaaccaggauaaaccagcucuuuugagacacugcaaaguaagacagccaccugccuauaagaaagggaacccccauaccaggaacaguauuaaaccaucuucucauaaugggccaucucaugauauauuugaaaagcuccaaacaguuucugcuggaaauguacaaaacgaagaguauccuauaagacccuccacacuuaauucuaggcagucuucucuugccccgcagucccaaccacacgauuuuguuuuuucaccccauaauucaggaagaccaauggaacuucagauaccuacucccccacugccaucuuacuguuccacaaacguuugcagguguugucagcaucauagucauauucaauauaguccgcuaaauucuuggcaaggagcaaacacaguuggauccauucaagauguccagucugaagcccuucaaaagcauucauuauuucacccaaguggauguccagcccuguacuguaaugcauucuguucuucaaguaguccuauagccuugagaccucagggagauaugggcaguuguucuccccacagcaauauugaaccaucgccuguggcaagaccgccuucacauauggacuuauguaacccacagccuugcacagugugcaugcacacacccaagacugagucagauaauggaaugaugggacuaucuccagaugcauaucgguuccucacagaacaagacagacagcuaagacuacuucaggcacagguuugcuuggugcuuuccuaguucuauuaauuucuugguauuaagauuucuuaaaaacuggcaccucuccucaguaaugauguuuuauagaaguauagaaugucagaauuaggagggaccuuggaaacugaauucuaggcccucuuguuuuacagguaaguaaaaugaggauuagagagaauaauuuaacccaaugccacguugcuaguuaguaguagaaccaucuuaugcauauccuaaccuacaauagaauuguauuuuuauuuuuugccucuaaugaaaagucuguuauaauuaacuaagccuuuauauacagcuaaauauaaagucuggacaguggcuuauacuucaucucuaguuugucagcccuauauaaugccuaucuauauaguuagagccuuucugcauaucuauacuggacuuauucuacuucuuguuuucugaaauguucccuuuuuucagaaccucuguugcagaguucuuaguuuuuuguuguuuuuuuuuuuuuuuuuugagacggagucucuucuguugcgcaggcuggagugcaggggcaugaucuuggcucacugcaaccuccgccucccaaguucaagugaucuuccugccucagcccugcuaggagcugggauuacaggcacgcgccaccaugccuggcuaguuuuuguauuuuuaguagagacgggguuucgccauguuggccagcauagucucgacggaguucuuugucuuaauuauauccuugcgcaguguuuaguguguaaguguugucuuuuuucuucuuuccucacugacguccuuccuccacauaccuaccccaaaacaguguuccucucuuucuccccagcaccaaugggaacaaccugaaauguaguuuuaaauauuuuucaugauccuauaacuaugcaaauauauguguaaugugcauauauacguaugauuuuuuuuuuuuuuuuuugagacggaguauuucucugucgcccaggcuggagugcagugccacgaucucggcucacugcaagcuccgccucccggguucacgccauucuccugccucagccgccggaguagcugggacuaugcccggcuaauuuuuuguauuuuuuuaguagagacggaguuucacuauguuagccaggauggucucgaucuccugaccuugugauccucccaccucggccucccaaaguguugggauuacaggcgugagccuccgcgcccggccauacauaugauuuuuuaaaaaaucuuuguuuuauaaaauuggaguuauaguguuugcauuuuaucagaaaaaagacaaugacauuuuucaaaucagugaaaacgcuuuggauaggaacaccugagaaaaauuuagcucugcuguuuuuuuaaaccuagguaaauucuuugaaauuguaaaguauaguuuuuuuuaaaauuuuuacuuuuuuuuuuagagaaaaggucuuccuauauugcccagacuggucuugaacuccucagcucaagugaucuuucugcuuugaccucccagagugcugggauuauaggugugagucaccacucccacauaauguaaaauauaaauuggauuuuaacauuauaaacacuuagcaaaaauuugaauauaccuaaauauuuuuacauugaaaauaauuauuucucacuuauuuccugucuuguucuaaagaagacuaauuagaggcuaaaaggacccauuauacuauuuagaaaucuuaguuacuuggaauuuguauacuuaaaauauaauauuauagaucacaggccguggucuagacuaucugaaucauuauauuuagaaaauaugaaauauacaaaaaaaugcuucuguguguaaauacauauaguauuuuccuuauauauauaugaacuuaaauuuuuagguaccacuuuuuaaaaaguaucuuauacauuuuuuauauaaguauauauagaacucccuuacccugcauggguuucuaucauaaugauagacaacaaauuuucuaauuguucuccuauugauuauuucaaccauuuaaagcuucugcuauugcaaacaaugcagcagugaacauuccuauauuugcaucuuacuaccuaugugcaaguaucucuauacuauagauuccuagaaguaaaacugugaagccaaauggaauaaacauuuuaaauguucaaagauacccaaauuuguuccuguucuaguauugcaaaucucauuuugguguaaggguuaagagagugggcugugguaccagacuccuuggauucugaucuaguuuguggguacuguagguuacaagaucauggacaaguuaccuuaccucauugacuucaguuuucucacauacaaaauagggauauacauaaguuguauggaguucuuuuguuuuuuguuuuaauuuuuuuuucaguuguucacauguauggcaaaguuguauggaguucuaaggaucugaaugaguuacuagauaaagguguagaauauugcugacauauaguuagugcucaguauauguuaacuauuacuauuauuucacuauuauuaucuuaguuaaugguaucaccucucaucucgucacucaggcaaaauucucaggagucacaaacccaggcucugcuuuguagauauauacugaacuuaacuacucuuuacuaucuuuccugcuaccaaccuaauucaaaccacugaugacacccuuacauaccacuuccauccaguacuauccccucauguuuccuauacuuggaaacaccauaccgucguuguuuguuuguuuuccccacaccaucuuuaaagcccaggucagauuguagcacucuugcuuaaaauccuccaguggauuuccauugcaauuagaauaaaauccaaaugcuuuaccuuggcccuuaaagcccuuuaugacuuggcuugucuuucucugcaaacucaucucuuaucacugucuucuguguucacuacacuucagcuguagugcuuuuuucuuuaacuuuuuguacuuuaaaaaugccaaaacauguuuauacuuuagguucuucagcuuuugguucccuuugccugaaauauuccuccuuggacccuucuaauggcuauuuccuucucaucauucaggcccuuaaucacguuuuuuuguucuauuugugauagaaagcuccagggaaggagcucacauucaucacuguuuucuuagcaccuugaauaguacuugauguguaaucguugcuuaauacauaguuuguuacuugaaugagugaaaauggcugcuggaaaggcuauaucuauuuauuuauuuauuuuucuagaugagaugaaugaugccagauuauaccaauuuaguauccccaaaccauuuuuccacaucuacauguccaacauuaggcaaacuuaaauuauuaccagucuuagaagaugguuuuuuuuuuuuuuuuuuuuuuuuuuuaggcagaguuuuacucuuucacccaggcuagagugaaauggcaugaucugggcucacugcaaccucuaucugccccccgggguugaagcaauucuccugccucagcuucccaaguagcugggauuauaggcacccaccaccacaccugguuaauuuuuguauuuuuaguagagacagggguuucaccauguuggccaggcugaucucgaacuccugaccucaggugauccaccugccucggccucccagagugcuaggauuacaggugugagccaccaugccuggccuagaaguuguuuuaauuuacauuauauuaacauauguaauugauuauuauuuauaagagcucauuguauaugaaggaaauugguccuuuaucauucauauauauauauauguauauguauaugcauaugcgugugguauuucuuacaguuagucuuaaguguuuugcauuuuaaccauuuguuuuguacagaauauuccaguuuagauacaguuaaauaauguagaccaggugcgguggcucacaccuguagucccagcacuuugggagaccuaggcggcuggaucaccugaggucaggaguuugagaccagccuggccaacauggugaaaucccgucucuacuaaaaauacaaaaauuaccugggcgugguagugggcgccuguaaucccgcuacuuaggaggcugaggcaugagaaucgcuugaaccucagaggcggaaauugcagugagccaagaucacaccacugcacuccagccugggcgacagagcuagacucugucucaaaaagaaaaaaaaaaaaguaugagucauucucuuucuggguuuuauguuuagaaaagccuucuuccuuucaagauuauaaaaaauuuauucuuggcugggcccacuggcucaugccuguaaucccagcauuuugggaggccaaggugguuggaucacuugagcccaggaauaugagaccagccagggcaacauagugagacuccaucucuacaaaaaauaaaaaagaaauaacuggccauaguguugcgcaccuguaaucccagcuccuugggagacugaagcaggaggauugcuucagccuaggaagcugaggcugcagugagccaagaccgugccacuguacucuggccuaggcgacagaguaagauccugucuuaaaaaaaaaaaaucuuauuuauuuauuuauuuauugagauggagucucacugugucacccaggcuggagugcaguggcgcgaucucagcucacugcaagcucugccucccggguucacaccauucuccugccucagccuccugaguagcugggacuacaggcguuggccaccaagccgggcuaauuuuuuguauuuuuaguagagacgggguuuuaccauguuagccaggauggucuugaucuccugaccuugugauccgcccgccucagccucccaaagugcugggauuacaggagugagccaccgcgcccagcaaaaaaaaaaucuuuuuaaaaaauucucccucucccuucaggauuauauuuguugcuucuuuuuuauuuaaguaaguuuuuuuuuuuaaaucagaugacuggacucacauauuuauuuaauaaauacauaucuuuuuacgaaugauuuagagaugcuuuuuguuguuguuguuguuguugaugagacagagucuugcucuguaacccaggcuggagggcacuggcucagcucacugcaaccucugccuuccaggugcaagugauucuccugccuuuaucaccugaguagcugggauugcagccgugugccaccaugcccggcuaauuuuugugguuuuaguagagacaggguuuuaccauguuggcuaggcuggucuugaacuccugaccucaggugauccaccugccucggccucccaaagugcugggauuucaggugugagccacugcacccagcaagagaugcauuuuuuauuguauaaugaaaguaucauauguuugcaucuauuucugaacuauagucugcuccacauaucugccugccccccaccacuaguuaccauuugauuuaaucacccacagcuuuauauuucaauauuccaacuuuaauggcuuuuuuuuuuuuaauggagaagaugcagcuugaggagaggaacuuuaaaaaauaacacugaaguccugccaaaugaucccuaaaaguucugagaaagaggcugggugugguggcucacgccuguaaucccagcacuuugggaggcugagguggguggaucacgaggucaagagaucgagaccauccuggcuaacauagugaaacuccgucucuacuaaaaaaaauacaaaaaauuagccuggcguagucccagcuacucgggaggcugaggcaggagaauggcguggacccgggaggcggagcuugcagugagcugagauacgccacugcacuccagccugggcgacagagcgaggcucugucucaaagaaaaaaaagaaaaguucugagaaagaaagaauauuagcuguuucaaauguuaaaaugcacuauagaauucuagugauuaauguuuuaaaaacacugagugaucaauuuuaggaccugaguguguguaaugucuuuuacuguacauuuccuaugugauuucucuacacuucacuuuucucaccuauaaaaugggagaaaugaucaguauuauauguagauuuaaagauuaaaugaguguguguguguguguaaagugcuuacuuaguaugggaccuggcuagaggaaguacgcaacaaauuacaacuguuuuauuuaucucuuuuaacaaccuuaguuuuaggugauauugaagcucauagugguuaaguaacuuuuccaaaagguagcaggguaggauuuaaacuuauagccacaugauaccaaagcuguacuccaaaccacuauaaauacacaugccauuuuauacuauuagcgcaguuuauauuucuacugaccuuaauaauugauugaugauacuuauuuuccuauauuaauaagguuaauccacuaaaauuauauugagcacaguaguaccauuuguagagaagcagaaaaucauaguguuuacaaagggaggcucuuccacuccuaguuacauacccaagagaagugaaaaaaauauguccacacaaaaagcuguauguaaauguccaaguagcauuauuccuaauagcccaaagugaaaacaaccuaaaugucugucagcugaugaguggaaaagcacaaugugauauauccauacaagggaauguuauucagcaaucagaagcaauaaaguauuaguaaaugcugcaacaugguugaaccuucaaaacauuaugccaagugaaagaagccagauacaaggccacaguaugguacuguuuauaugaaauguccagaauaggcaaauucagagauagaaaucauguuagaccgucaggggcuccggagaagggcaauaggguguggcugcuaauggguacagaguuuuggggguuugaugaaaauguucuggaaucagauaguggugauuauugcacacuuugugaguauaccaaaaaccacugaauuguacacuuuaaagcagcuaauuucaugguacaugaauuauaucucaauuuaaaauggaagaggggaggcuuuugguguuugaaccucagcuuucagauuugcuacuuguuaguuauauguccuauacaaguaacuuaacuuuuuccuugccgcagguuuucuuacuuguaaaaaaaauguuuaauuguaauauagucuucagaggauugcuguaaaaauuauacauaaaagccuauaguaauagggucuugcaaacaacaggcgcucaguaacuguuagccauuguuauuaauauauccaauuucaacaugggcaaacaugggcaauucugauuuaccuuuauaauaaucuugugugauauguucaguauuugguauauggagucagagagucagaguauaccuccaaucuaacuuuugauuuauaagugaaauaggaauauaauguuaguuugaaguauuaaccauucacacuuuuuuacaugaguaucaacuuacgaauacuaagcuaaacaccuuuauguauugcuuuuaaauguauacuuaaaggcugaggugggcagauugcuugagcccaggaguuugagaacagccugggcaacauggcaaaaccccaucucuacaaaacaugugaaaauuaaccaggcaugguggugcauggcugucaucccagccaccccaggaggcugaggugggaggaucgauugagcccaggagguugaggcugcaauaagccaugauugcaccacggcugggugacagccugggugacagagcaagaccuugucucaaaaaaaaaaaaaaauaguauacuuaaagugcuucuuaauaacuagugauaauggcuuucuauauugaauaaguuucaugguauggucuaguugaaauuugagaaaauagacuuaaaagucaguuucuuauaauuagggcgcuuuguaauucauuauuaaacugcugccaguuuuguugauuacuucccugucaguuuaaaguauguuuuuaauugauacagauucagcguuuguuggaagcacagucucugaugcccuguuccccuaagacaacugcuguugaagacacagugcaagcuggaagacaaauggaguugguuucuguggaagcacagucuuccccuggcuugcacaugagaaaagguguaagcauugcugugagcacagguaauuucaguuuuuuuuuaauuuguaaggaaauuguuaaaaaugcuuuucauaucugguuuuugaauuuuauguucaaauuggugcauggugcaguaggaccaaaaccaaggugaugagaguaugacuuaaguuuuugugugauuuuagucuuugugaaauaaaacuacaccugcaaacugcauaacaugauaaaguguuugauuuugcuacuuuucuaggcuggacccaauucugguuuuuuuuuuguuuuuuguuuuuuuuuuugaaauggagucucgcuguguugcccaagcuagagugcaguguggugcacucucagcucacugcaaccuccaccauccuagguucaagcaauccuccugucucagccucccaaaguguugggauuacaggcgugagccaccgcguccagccagucuuguuuguauuaauuuauuuucauaaaaucacccaaguauauccucagaguagaaaccauuuugacuaugauuuacuuuuuuuuuuuuuuuuuuuugagacggagucucacuccgucacacaggcuggagugcaauggcauagucucggcucacugcaaccuccgccuccuggguucaagugauuuuccugaguagcugggacuacaagcgccugccaccacaccuggcuaauuuuuguauuuuuaguagagaugggguuucacuauguuggucaggcuggucuccaacuccugaccgcaugauccacccaccucagccucccaaagggcugggauuguauuacaggcaugagccacugugcccaggcuacuuuuugguuuuaaccaucuguuuaaaccauuauguauuagcaauauuccccaaauuauagaaugccuauggcucgugguacaaaagaugauuuaggguguuauacagauuaauauuuauauuuuguaaauauaucuuuuccaauacucauagguauaaauacaauaagcauaucaaaucugugauuuuagagaaauaaugaggcucaguaaaaaaagaguuaauuuaaagaaagaguaaguaaacaauauuacaugcaaauagcucugaagauagguguaagugcuucauaaagauugagaaauuggcugggcgcaguggcucaugccuauaauguuugcacuuugggaggucaaggcagguggauugccugaugcuaggaguucgagaccagccuggucaaaaugaugaagccccaucuuuaaaaaaaauacaaaaauuagccacauaugguggcgcacaccugcagucccagcuacucgggaagcugaggugggaggaucaccugagcccagggacguugaggcugcagugagcugugauugugucacugcacuccagccugagcaacaaagugacacccugucuuaaaaaaaaaaaaaaaaaaaaaaaaagauugggaaacacuugauuuuuuuuaauaccugccugauauuacagauauuacagaugucugaugcaucaccaauguagucuuuuaaauauugcauuuaagugucaaaaccagagaaccuagggauuuguauuuuauauauuaucucauauuauucagagcagcaguuuucaacauacacaccccaucccacggaucauauucagaaucuuaauauguaaagcaaaucauuucagagccacccuucuugaaaaagcagaacccagaaugugcccuuccacccgacccguccccuaguguuuugucuuucugucuuccaccuaccucuuccuggcauuucugaggaaauauaaucuaaaaacuuaguucuaaguaauuguguguguguguguguguguguguguguguguguguguauauauauauauauuuuuuuuuuuuuuugagccagaguugcccaggcuggaaugcaguagcacaaucacagcucauugcagcaucgaccuccugggcucaagugaucuuacaccucugccuccugaguagaugggacuacaggcacaccaccacaccuggcuaauuuuuuuguauuuuuuuuguagagacaggauuucuccauguugcccaggcuggucucgaacuccugagcucaagugauccucccgccucugccucucaaaguguugggauuauaggcgugagccauugcacccagccaauauggcuauucuuaacaaagguuuggcagaguauuauuuuuaaaguugaauguuuguuucaguaucuuaaauuauuuaaccuccaggugcuagcuuguuuuggaaugcagcaggugaggaucaagagccugacucucaaaugaagcaagaugauaccaaaauuuccagugaggacaugaauuuuucugucgauauuaauaaugaagucacaagucuuccagguagugcaucuucauuaaaagcaguugauauucccaguuuugaagagagcaacauugcuguggaagaagaauuuaaccagccacuuucuguauccaaguaaggucucuuugauuuagucuuucauccuacuuucaaaaaaaauuuuuuuugauagacaaauaauaauuguauauauuuguggggcacaauguuuagaugcauguuuacaguauggaaugauuaaaucagaccaacaaaucuaucacuucacauacuuaacuuuuucugugguaaaaacauuugaagucuacuauuagcaauuuugaaauauacaauguauuauuauucauuacaguugcuguucuguucagguuuuuuuuuguuuuuaauucuaauuucuuuaaagucuucuaacucagaaaugauauauuuucuaacugguauuuucuuuuaugucuuuacuugauaugauuucuauguaacugacaacucugagccuucuagaaccauuuccagaugucagucuuuggcuauauuaacagucuggaugaaucagaaaucggaagaaaacuucaaaaauacacaagcucaggccucacccuagaggaucugauaauauuagguuccagauacagauggagaaauuuuuuuuuuuuuuuuuuugacggagucccgcucuguugcccaggcuggagugcaguggugcaaucucggcucacugcaaucuccaccucccggguucacgccauucuccugccucccguguagcugggacuacaggcuccugccaccaugcccggcuaauuccguguuuguauuuuuaguagagaugggguuucaccauguuagccaggauggccucgaucuccugaccucgugaucugccugccucggccucccaaagugcugggauuacaggcgugagccaccacaccuggcggagaaauuucuuuuauuuaauuuauuuauuuauuuauuuauuuauuuauuuaugagauggaguuucucucuuguugcucagucuagagugcaauggugcgaucuugacucacugcaaucccugccuccuggguucaagugauucuccugccucagccuccugaguagcugggauuacagacaccugccaccaugcugggcuaauuuuguuuguauuuuuuuuagagaugggguuucgccguguuggccaggcuggucgugaacuccugaccucaggugauccacccaccuugaccuccuaaagugcuggaauuacaggcaugagccacugugcccagccuauuuuauuuuauguauuuauuuuuugagacaagagucucgcuuuuucacccaggcuggagugcaauggcacugucuuggcucacugcaaccucugccucccagguucaaggcauucuugagccucagccucccaagcagcugggauuacaggcgugcgccaccacgcccagcuaauuuuuguauuuuuaguagagauggggcuucccauguuggccaggcugaucuggaacuccucaccugaggugauccgccugccucagccuuccaaagugcugggauuauaggcaugagccacugugagauggcgagauuucuaaagauucuccguauugccauuauauauaaaagagucuauuuuugagugauagaaccuuaauauuuauauaugaaauguuaucugagauuugcuucaaauuaauucugugggagaaugaaauggcuaggaguauaaaugaaauaagauuggcuauuugguaauuuuugaaacugauuguauauggugauuuguaaaauaauucucucauguuugaaauuuuucauuaugaaauuuuccauuaaauaaggaucguaggcuaggcucagugacucuuaccuguaacugggcacgguggugcacacauguagucccagguacuugggaggcugaggcaggagaauugccugaaccugggagguggagguugcagugagccgagauugcgccacugcauuccagccugggugacagagcaagacuaagucucaaaacaaaacaaaacaaaaaacggauucuaaaguaaauuuuuuuuuuuuuuuuuuuuuuuagauacucgcucugucgcccuggcuggaguacgguggcgugaucuuggcucacugcaaccucagccucccaaguagcugggacuacaggcacgggccaccacaccuggcuaauuuuuguguuuuuaguagagacaggguuuugccauguuagccaggguggucuugaacuccugaccucagguuagccaccugccucggccuuucaaauuguugggauuacugguaugagccacugcaccuggccuaaaguaauuuauauccucagcaaauuuggaaacaaacucagcaaauauuugaguuucugguacgugcuaccacaaaacuagacacuaaauaucaaauacuagguuaggcaaagcuccuaacuuuauggaauuuaaccacaugagcagcaaauaacauaguuucagauagugacaacugcucugaaaaaguaaacuagagugaucaaguggaguguaacugggaugguaaccugggaacaagguguuauauuaaguagagugguaaaggaaaccaucucugugagggggugacauuugaguagugaccugaaugaugagaaggagccagucaugauaauaucuggggaugaguauuccaaguggaggaaaaagcaaguguaauggcaaguguggguuuaaaaguuacagaaaaaagcaugaaagccaguguggcuggacauagugauugagagggagaguauaggaaaugaagucugagauacaggcaggagccaaguuauauggggcuuuguaggauauagaaaagauuuuuuaauuuauugcaugcucauuaaagcuaguggaggauuuuagauaauggaguguuaugaucugauuuucauuuuuugaagaccauucuaauuguuucguggagaacugaaggauguuaagaguggaaguuaagauacuaacugauuaauaaacuaaagaccaagugagaugaagaugucuuggacuuguggaauucguggaagggaucagguguaggauaaauuuugaagguaaaagaaaaauguagguauaaaacaucccaggauaauagcacaugaaacaguuuaaagagguuaauuugaaauucaagaccaggcuaggcaaaauagugagacccugucucuauaaaaaaauauuuuaacuuagcuggguguggugguaugugccuguaguaguuccaccuacucaggaggcugaaacaggaggaucgcuugagaccagaaguuugagguugcagugaucuaugauaagugccauuguacucuggcuucaauaacagagugagacuccauuucuaaaaauaaaaaaaggugaacugguaaggugacauggggcaggcaguggauuacuuuuuagaaauuaauaagccuugugauauuugacauuuuaaaucauugugauuacaauaaugguuaagacaauaaacaugucccuucagaaaacuacagagaaacaucuccuuuuaguauaguauauguuuuaaucauaugauaaaauuaagcacucauugugugugccacaguauacagaaaagcucuuuuguguauguuagauugaguuccugcaggguaaggaucauaguaauuuccauauuuuuagaauuugcugggcuugguggcucaugccuguaaucuuagcacuuugggaggccaaagugaaccgauugcuugugcuaagguauuugagaccagccuggguaacauggcgaaacccugucucuaccaaaauuacagaaauuagcccuuggucccagcuguucgggaggcuaaggugggaggauugcuggagccugggaaguugagucugcagugagcugugaucacgccacugcacuccagccugggugacagagagagacuguuucuuuuuuuuuuuuuuuuuuuuuuugagacagucuugcucugucauccagguuggagugcaguggcgcaaucucagcucagcucacugcacccuccgccucccggguacaagcaguucuccugccucagccugccaaguagcuaggauuacaggcacuugccacuaugcccggcuaaguuuuguauuuuuaguagagacgggguuucuccauguuggccaggcuggucuccaacuccugaccucagaugaucugcccgccucagccucccaaagugcugggauuacaggugugagucaccaugcccggccaacucuguuucaaaaaaaguaauuaaaaaaaacuacaguuugacccagugucugguuccccauggggugagccccaaaguaggucugcaguuuauuuagaauaauuauagaaacugaggacaaagaggagcaaaccaugggaucuuuauuuauucuccuuaacucuguaaacugcagacuacuuucuagaauaauggggguuuucagauuggaauuuuaaaaaauauccaaucuuguguuuuuuuuuuuuuuuuuuuuuuugggagauggaguguugcucuguugcucaggcuggagugcaguggugugaucuugguucacugcaaccuccaccuccuggguuccggagauccuucugccucagccucucaaguagcugggauuacaaguguacgccaccacacccagcuaauuuuuguauuuuuagugaagacgguguuucaccguguuggccaggcuggucucgaacuccugaccucaagugaucugcuugucucggccucccaaagugcugggauuaaagaugugagccaccaugcccuuguuuuggcuuuuuuuuuuuuuuuuuaacuuuagaaacagaucugaguuaauugauagaaugaaguuaauugcuuuuucagagcaauuaauuaacucugucgaucccaacacauaacuagauguaaaucuaaucuuugcucagcauugauuuggguuguugauuuggauuaaauacuuucuccaguguugucuaugaugguuuuggugcuucucugggauccuucucgcacuuuuggucugauucgugcucugguucccacugcugaguauucauagaugacacgcaacuccagggcuuccagucccccuuagaugucuuguuggaccaguguuucugauguugaaguagucugugaaagauaaauuuauuugccuugcagcuucauugguuauugauuacuuuuucccagcagugaguagugguauguaguauuuauagagacuuucuuuuaaaaugauccauauuuuucuuuagaagcugugcuuugggcauaccuaauaauacuuggcauauuagaagcauuuuaaaauuuuuuauuuaaucuuaaaucuuuuguugagauuugacauuuuuauuuauuccuuuuucuucccccuaaagaguguagacauuuauuuauuuauuuuggcuuauaaacaacagaaauuuguuucucauuguucugaggacuggaaacuccaagauugaggcgccagcagauguaauguuuugugaggacccauuuccugguucauaguugaugccucuuccuuguguccucacguggugaaaggagcuaucuagcucuugguguuauuuuauuaaggacccuuguaaucuuuaaugauuuggguuuguucuuuuucaguuuuaguuuuugcuuccuagguuagacaccaagacagauauuuuuaaauccuugaggccaggugcaguggcucacgccuguaaucccagcacuuggggaggcugaggcaggcagaucaccugaggucaggaguucgagaccagccuggccaacauggugaaaccccaucucuacuaaaaauacagaaacuagcugagcaugguggugcaugccuguaaucccagcuacucaggaggcugaggcaggagaaucgcuugaacccagaaggcagagguuacagucagccgagaugacgccacuacauuccagccugggugacauggugagacucugucucaaaaaaaaaaaaaaaaaaaaaaaaaacuuggaaugaacaaauaacauaccuaaaauauuuaaaugcucuaaaaauuuccauugccaucaaguucaggagaaaucaacagcuuguuuuccaggcuucaaagaaaguugucuuaaauauaaguaacacaaguuaaaagguaccaugguuuaguuuauaugcagccuguuaaaacgagguguuuucguuuuuguuucuuauagaaauagggucuugcucugaugccuaggcugagugcagugguacaaucauagcucacugcagccucgaauuccugggcuaagugauccucuugcucagccuccugagcagcuaggauuacaggugcauggugucacacccagcuaauuaaaacaaauuuuuuguggagauggggucucgauauauuccccagucugaucuugaacuucuuaccucaaacuucucuugccuugcucucccaaaacacagauuacaggcaugagccacugcaccuggcuaagaugggguguuuauguagcaucaucacuaagagcuaaaaauacaaccaggugcugcuugagucuuaacccuuuuuucuaaaguuacuacauuucaauuauauguuaaagguaccucaaugacuaacacauuauauauccuucccagcagcucuucucuaguugugagaaaagaaccugauguaccuguguucuuuccaaguggccagcuggcagaaaguguaagcauguguuuacagacuggaccaacagggggugccaguaacaauucugaaacaucagaggaaccaaaaauugagcauguaaugcaacccuugcuucaucaaccaucagauaaccagaaaauuuaccaggauuuauugguaagaaaauguagagcauuucaucuuuuugagaagguuauuuaguauaggauauacuaguuaagcuuuuccuagguuuaaacugauugagaccuuaagauaaaaagauuuuuugucuaauuaacaauguaauuuuucuuuuagcuuuucauaaauuauaacuuaaauucacuaauuuaccauaaacauacuuaaguacuuagaaaaacacagcuuuauuuuuaaaguauaaauauugauauuaugccuaauucaaaccaaaauuaguauuagaaaauaagcaagaguuucucggaaauuugaaaauuggaaaguagugggauauuuaugauaacauuuacugauuuuaguucagguaagccaauguuuauuaaauacuuagcuuagucuaagacaguaggcuaagugaaaucgauaauauaaaggugaauaugacacucugugcccuugagagccuaggggaaacaacagcacaugcagacuaguaacaauuauaagacaggcuguugaggaguaguaguguaaagcaaagagaacacagaauaaagggguaauucugguuggaggaacuaguauuauaaaacuuaaaaugugaucugggacuuaaaggauagagaaacccugacugucacuuucauccaaauuguagaacauuugauuuguccauuugcgagaaggcaacauacuucacagggcccuauguauucaucaaugaacacauauuuguuauuugcuugcuagguccuaggcuggugcuagcagcuuguaugcucagggaaugaaauaugcagaaauaguaucacaggucauucuuacuuugagaaagugagaagaaaaggagccuaacucugugaacaucauaaaggccuaauuuauaacugaaacauuaucacuuugcaaacgaaagcauuauuuaaaacuuguuuauaaaaaauuuagcauaaguccucgaaaauacuuggagaauuacucaaaagauuuuuuuuuuuuuuuuugagacagagucucugucacccaggcuagagugcagugacaugaucucagcucacuguaaccucugccucccagguucaagcgauucuugugccucagccuuccaaguagcugggacuacaggcaccugccaccaugccuggcuaauuuuuuuuuuuuuuuuugagacagagucucacuguguuucuguugcccaggcuggaaugcagugacaugaucucagcuuacugcagcuucugccucccagguucaagugauucuccugcaucagccuuucaaguagcugggaccacaggugcacgccaccacacccggcuaauuuuuguauuuuuagcagagaugggguuucaccauguuagccaggcuggucuugaacuccuggccucaagugaucugcccgccuuggccucccaaagugcugggauuacagguuugagccacacgccuguacucaaaugauuuuuaaauacguugguuuuuauuuuuauuuguuuauuuucuauuuuauuuauuuauuuuuuuuagacagagucucacucugucacccaggcuggaguacaguggcgccaucucagcucucugcaaccugggccuucuggguucaagugauucucaugccucagccucccaaauagccgggaccacagguacgugccaccacacccggcuaauuuuuguauuuuuauuagagacaggguuucaccauguuggcuaggcuggucuugaacuccugaccuaaagugauccgcccaccuuggccucccaaagugcugggauuacaggugugagccaccacgcccagcuuauguugguuuuuaagugaaugaagucugaacaagcauucuguuuucucuagggucugaugaaauuguucauuaggaugugcuucuauaaaaacuucauaauaccugcaaauaauaccauaauaccugccuacuugauacuuuguggaauuugacaagauacugauuuucccuggccuuguuguaucauuaaggucuuacuguaaaauuguuuuuuaacuuuuuuuuaauuuuaauuuuuuuagagacagagucucacuuugucacgcaggauauaguggcacaaucacggcuaacugcagccucagccucguggcucaagugguccuccuacuucagccuccuaaguagcuggaacuacaggcgugugccaccgugcccagcuaauuuuuaguuuuuuguagagacaggaucucgcuguguugcccagggucuuaaacuccugggcucaagcgaucuuccugccuuggcuucccaaagugcugggauuauaggugugaaccaccacacccagcccuaacauuguuaauagugauuuuucaaaaaaauuuuuuuucuuuuugucagggucaaguaaaccaccuauuaaauaguuccuccaaggaaacugagcagccgucuaccaaagcaguaauuaucagucaugaaugcaccagaacccaaaacguuuaccauacaaagaaaaaaacacaucauucaagacugguggacaaagauuguguccuuaaugcaacucuuaagcaacuaagaagccuuggaguaaaaauugauucucccacuaaagugaagaaaaaugcacauaacguggaucacgccagguaacuuuuaaaauuuuguuuuaaagagugaauaaauuuuauuuuuuaaaaauuuuuauuuauuuuugcccaucauuggcuagaugaauaaauuuuagauguauuguggcaaucucaucagaaaaguuacguuugugccucaauugaguugauucacgauuuauucagggccuaccauaugcaugaugaauaagagauucuucauuuuagugggagagaggguuacauacauaaguaauuugagagauauugugggaugacuccuggcuggauaggccaacaaaauacuuuaggagucuugaggaaagagaaaggaguuuugcuugguagcaucugaaaagucuuucuggaggugauaaggucuguuccagcuacuggauguacaguuacacagucgugccaucuaaaaagcaaaaauauuucuuuuuucugggaaugugcccaacuggucauguccuucuguucagauuccuuucuaccaaagaugaccucagcacauaacuuauuaaaaagaaaauaaagucuggagauuauauuauuaaggcuggcauauuuucuguuaauuauuuuuuguuuucuaauuuaaaaaguaauaaaaauucaugguuuuaaaaaacaauacagaagagaguguaagauaaaaugcaaaagccacaacuccccacauuccugccugacucuuccaaaguuacuucucuuaggccgggcgcgguggcucacgccuguaaucccagcacuuugcagggcugaggcaggugaaucaugaggucaggaguucgagaccagccuggccaagauggugaaaccccgucucuacuaaaaauacaaaaauuagaugggugcgguggcgggcgccuguaaucucagcuacuugggaggcugaggcaagagaauugccugaacccggggaggcagaggucgcagugagccgagauagcgccacugcacucuaucuagccuggacgacagagcaagacucagucaaaaaaaaaaaaaaaaaaaaggccgggcgcgguaccucacaccuguaaucccagcacuuugggaagccgaggugggcggaucacgaggucaggagaucaagaccauucuggcuaacacggugaaaccccgucucuacuaaaaauacaaaaaauuagcugagcgugguggugggcgccuguagucccagcuacucaggaggcugaggcacgagaauggcgugaacccaggaggcagagcuugcagugagccgagauugcgccacugcacuccagcuuggauagcaaagcaagacugucucaaaaaaaaaaaaaagcaaaguuacuucucuuaaccauuucuuuuguauucuagaaauguuccaugcauguucaaguauauguguaugugauaagcuuugugauuugauuuuuuguuguuguugcuguuguuuuaauuuugagacagucucgcucugucacccaggcuggagugcaguggcaugaucacagcucacugcagccucaaccuccuggacucaagugagccucccaucucagccuuuugaguagcuggcacuacaggcuugcaccaguacuuagcuaauuuuuuauuuuuugcagagauggugucuugcuauguugcccagucuggucucagacaaacucuuagacucaagcaaucuucccaccuuggccucccaaagugcuaggauuacagccgugagccacugcaccuggccuguuuuuuuguuuuuguuuuaaacaugauauuauaauaucuuggauacuuuuccuuauagggauauacaguucuuucucuuguauuuaaacagcugcauaauauucuuuuguacccuuguacuagaauauauugaaccccagugcucuauuaauggaccuuuaggccaaaucucuuauuuguuauuucaagcaauccuaagugaacaucauucuacagguacaaguaucuuuguaggauaaauuccuagauaggcaggaucaaagaguaugugcauucaaagucuuaguagaugcuaccauugcucaucaaauaguuguaccaguuuauauuccuaccaauaguguaaaagagugaggcuagcauuuuugaguuuuuuauccauguugcaagauagaggcuauguauccuaacccuuccccucuugucagaacugagaaccaacuugucacguuaguugugguuucuuacuauuuuaauguugcugugaugaucuuuugcaaauauugcuuuucaguuuuaggauuauuuccuuagaauagaaucucggaaauggaaagacuaagguaaaaugauacaaaaauuuuaaagcuguugcuaaguugcuuucugaaagaguaaguauuauuaccagcuacacauauacaugugugccagcuaccauuucaccaauacauucacuucaacaaauacuuacugaguuucuaugagccagccuauaagagauaucguaauacacaagauaaccugauaaagaaagacaucuuuguucucauagaguuuacaguucaguggggaagacacagauagucaauaucuuuuaugccugcuaugaaauggaaggauagggaaugccauggaaucacauaggaaagguagcuaacuuaauuuauaaaggaaaggaaaaaagaaagguagcuaacuuuaggaguauuucauacuguguuguaauugaucuacaucaaaauggccccuuuuaaagaucuguacuaauuaagaccaaaaauaucuuaaaguuuugaaaguuauauuuuauuauugaugcaauaucuguauauuuaaaacuuuuuuuuaguuuuuaaaaauaggaucuugcucugucacccaggccugucacccaggcuggaguaugaugguacaaucauaauuuauguaaccucaaacuccugggcugaagccaauccuccugccucagcuuuuugaguagcugggaccacaggcgugugccaucaucucuaugucauuuugauuaaauaggaaacuguacugcaauaguuucuccaacauaagaguuaaauuuaguuucccuguuaucuuaggcuccgucuggaauauccucccagccuaucugaggccuaccugauuaauucgcauuguuucaguuugacuuaaacuuaguuuuuuaguauaauguccuaccauucucuaccaaguuccagccuacuugccauuggcauuugcaagauuccuugauguuacuuuuaucugaggugcucuuuuuuuuuaccuuucugcuugccaaaauccuuauccuucaaagcugaacucaaaugucaccucuuuggucaguuuccuggaccucucagaguguauugauguuuuguacucuuauugcccaggcuggagugcaguggcaugaucugggcucaccauaaccuucaccucccggcuucaagugauuucuccugccucagccuuccugaguagcugggauuacaggcaugcgccaccaugcccggcuaauuuuguacuuuuaguagagacaggguuucuccauguuagucaggcuggucucgaacucccaaccucagaugauccaccugccucggccucccaaagugcugggauuacaggcgugagccaccgugccuggccgauguuuuguacucuuaaaauaccucguucucaguaaauuguagcauguacuuaugacacauuuucagcaagauuuuuuuuuuuuuuuuuuugagauggagucucgcucugucgcccaggcuggaguguaguggcaugaucuuggcucacugcaaccuccgccccccagguucaagcaauucuucugccuccgccuccugaguagcugggacuacaggugcgcaccaccacgcccagcuaaguuuuguguuuuuaguagagacgggguuucacuauauuggccaggcuagucucaaacuccugaccuugugaucugccagucucggccucccaaagugcugggauugcaggcaugagccacugcuccagcgaagauuuuauauaguucuaaauccucauugccucuaccacuaacuuagugggccuucaaugagucauuugcugaaugaacgacauuccuccuacucaggucaucaccgacgcuuacagugaagguucauuuuuagugucuuuguaguauuuacugucaguauuuauaaucuuauauuguuaacuuuuuaacauguguagguauaauauaacugguauacuaaaaguuuauaaggccguuguuuagaauguaagacacauuuuucuauagaaacaguguuacagauuauagguugaauauucuaggaaacuaauccuuauaauccaugcuguuccucuagcucuguaaaucagccgucuuuuaucauugugucuaugugaaaacucauuucauguuccaguucuggacuccaggagcacaucauuccgccagaagaguggcuaaggcaggggaaggaagaccugcuuucuauuuuccuguuaauagaaugccgcagagauuaagagagucuaaaggcaggaaggcagggaaaaagggugccagacaaaccuagaaauugugcaggaaauggagauuguggguucgaggucuggaagcaaccucuacauauucccaauuggagugacuuuuugaauucaaaaccugucucaaguagucucucuaguugcuucuuuaccuugcuuccuggcuaucugcuuaguaguugaaaaacuguguaggauaaguaguagauaacuaaucuggauucaaauaggaucaugaaucaaaguugacuuuuuuuuuuuuuuuuuugagagacagggucucgcucuguugcccaggcugcagugcaguggcacaaucauggcucaacugcagccucaaucuccugggcucaagugauccucccacuuuagcuuccugaguagcugggacuacaggugugcagcagcacacccagcuuauuuuuauuuguagagaugggggucuugauugucaucugaguuggaauaauuuuagagcuucccauaaauuguugacauguggcuaacucaaauuuauucauggacuuucaucauuccuuguggcugcacaucuaaugagauuuuaacauaggcauauauuugugcucaggcuuuuaggauuugauuaguggaauggguuccuuuuugcuuuucgucuuaauuacccuaguguuuauaugcuuugguuucugaguauuauugauuuuuuuuuuagugauguggucucuauuuugccuaggguggccccuugaaugccugggcuuaagcaauccuccugccucaggcuccugagaagcuaggacuacaggugugcauaccacugugccugucuugauuuguuuugcuauuaaaguaaugauaucucauugccccuagcccacccuccaaauugaaauuggcuagcuuguguuaggcauugaaacuugaauagccuucuaaacugauauugacuacuuuauggaucuuuuaaccauucuauaaaagaagcccuaguuaaaauuaagaggcugggcauggugucucaugccuguuaucccagcacuuugggaggccaagaugggaggaucacuggagcucaggaguucaagaccagccugaacaacauagugagaccccaucuuuacaaaaagaaaaauuuuugauuagcugggcaugguggcaugcaccuguagucccagcuacuugggaggcugagguaggagggucacuugagucugggaggucgaugccauggugagccaugauugcgccacugcacuccagccuuaguggcagagugagaccuugucucaaaaaaaacaaaaaaaaaacccaaauuagaccugcuuucuuuaaauauuuaacauuuugaauuaguaguuuuucuuugcuuuuaucaaauuauuuacauuaacauuaucuauagacugaggaaauaggcaaaguagaaaaagacuuccaaaaguauugucacuaugaauaaaagaauaaugucuggauaaauuaguaguaucucuuucaucuuauuaaaauagucuucaaagcauuaaaugccaagaagauuaagggagaauuucaagguuguaaagaccagcauuagugagcacacuguuccauuguuuggugauggcaucacugguuucagagaauuuuuuuuuuuuuuuuuuuuuuuuuuuuuuugagacagagucucacucugucaccuaggcuggaaugcagugacgcaaucucggcucacugcaaccuccgccuccuguguuuaaccgauucuccugucucagccuacagaguagcugggauuacaggcacccgccaccacgcccagcuaauuuuuuuguauuuuuaguagagacgggguuuugccauguuggccagguuggucucaaacuccugaccucaggugaucugcucaccucggccucccaaagugcugggauuacaggcgggagccaccaugccuggccugguuucagggauuauuagugguuggaaauaguuuuuugcgaauuucaggugcuuauaagaaugaaaauauauaaugguuguuugauuuuugugggucugugaaugcaagcaguggcuagcacauauaaaacagcugaauuucuucaugggaugauguagaaagccauagcauauuugacuagaauauaauguucaccacaacaaauagugcacaaaggacucugauagaaaaaauccaaguuacugaauauaguacaguaaaagagugguugcagagccccagagaguaaggcagucauggauuaucucagcuugcuauguacuauuuagcuuggaaaaaauagcucaaaucucuauuccucaguuuucucaacugagaguaaauauaacaauaguaccuacuacuuuuauucauucaacaaguacuuacugagugccuacuauguguguccaggcaucgaggauacugcagugggggccaggagaacagacaaaacucuguccuuauuggcuuucaugagggugcuagacaauaaauaagaaucgagcauugauugaauauguagauguguguauucaauguauagaccgcgguaagugcuaaaaagaaaacaaaaaaguaggggaaagggaauguaagauguugaaauggagaauaagauagaaauauuccauagagaauaccucccugacaaagguuacuguaaggaauguauaugaauaaugcauguaaagcauuaauagaguaccuggcauauauaacgacucaguaauuagcaggcuggguacaguggcucacgccuguaaucccaacacuuuugggaauucgaggagggaggcucgcuuuaccucaggaguuugagagcagccugagucuguaauugugccaacauuagcaaaugacaugcaguugccacuguacucuagacugggcaacagagcaagacccugucuccaaaaaaaaaaauuagcagcuauuuauuauauaugugauauuaaggaaaagguaagucaguugacuuaacacuaaucaaaguaaguugaagauuauaacuaaugaaaaaaguauucguguguguguguguguguguguguguguguguguguguguguguguauaagcccauauccagagacugguugauguuuuuuauuaauugcaaauggaaucucuucaacuaugaacaauuuaauuuucugagcuacuuacuaaagcuuguacuguuauauaaucaaauguguuuuguguuugauuuuauuuuuauguuuuacuuuacauuaaacauuagcugaucucuugugcuguuugggcuaauagucguaaauuaaaugacucauagcuauguugaugacuuuuacauuuggggccuuguauuuguucuuaaaaccaugacugauauacagauuuaggaaaauuaauuuguauuccacuuuaaaccuguaaaucauggauuaccuucuaggcuauuauuuguaucccuuuuuuuauuuuuucuuuauuuuuucuuuuuuaagagacagggucuuguucuguugcccaggcuggagugcaguggcacgaucauggcucacuguaacuuugaacucuugagcucaagcaauccuccugccucagccucuugaguaguugggacuauaaaugugcaccaccaugccuggccaauuuuuaaauuuuuuuguagagacaagaucuugcuauauugccuaggcugaucuugaacuccuggcuucaagcaauccucccaccucagugccccaaucugcugggauuggaggcuugggccacuauacccagcccauauguauccuuuguguaucuggaucaucaagacuuagaugucugaguaguuagauaaaaggaccaugaacuuaaagcugaagaucuuuuguugcuuguauagaauggaacacauugagaacuauguauuacuuagaauaugguaaaugauggcuuacuacuuugugucuuucaguguguuggcaugcaucagcccagaagcagugaucucuggauuaaacugcaugucauuugcuaauguuggcaugagcggcuuaagccccaaugguguggauuugagcauggaggcaaaugcuauagcucugaaauauuuaaaugaaaaucagcugucacaacugucugucacucgaucgaaccaaaauaauugugacccauucagccuucuccauauuaauacagacagaagcacaguggggcuuaguuuaauuucaccaaacaacaugucauuugcaaccaaaaaauauaugaagagauauggacuccuacaaagcagugacaauagugaagaugaagaggaaccucccgacaaugcagauagcaagagugaauauuuauugaaucagaaccuuagguccauaccugaacagcuugguggucagaaagagccuucuaagaaugaccaugaaauaauuaauuguucuaacugugaaucuguggggaccaacgcagauacgccaguauugagaaauauuacaaaugaaguuuugcagacaaaagcaaaacagcaguugacugaaaagccagcuuucuuaguaaagaaccuuaaaccaaguccugcagugaaccuucgaaccgggaaagcagaguucacucaacauccugagaaagaaaaugaaggggacauuacaauuuuuccugaaaguuugcaaccuucugaaacgcuaaagcagaugaauagcaugaauucaguaggcaccuucuuagauguaaaacgucucagacaguuaccaaaauuauuuuaaccuuuuaacucccugcccuuuuaauacagggacagggugucuccugaagauacuuagggaaaacaggagccuaccacaaggcuccugaucauucuggagucacuguuucuugguagcagccaauugggaagagugacuucugugagauggcuggcuggugauaggacuaaguucucauuguucaaauagagcuguucaacaucacugaaaccuuuaagaaaagcccugagaucaguuauuccuacaaguuuaaguaguagacagauacuauccagcucuaagucucaacugcucuuuuauacuguacuuuuuuuuuugagacggaguuuugcucuuguagcccaggcuggagugcaauggcaggaucucagaucacugcaaccucugccuccuggguucaagcgauuuuccugcuucaucuucccagguagcugggauuacaggcaugugccacaacgccuggcuaauuuuguauuuuuaguagagacugguuucuccauguuggucaggcuggucucaaacucccgaccucaggugauccgcccgccucggccuccuaaagugcugggauuacaggcgugagccacugcgcccagcuauacuguauauuuuaagaaguuccagcauguugcaucucugcauuuauccuauaucauuaaaagaacauaaguuaucaugguguuggguaaauuagcgaaaucaacccuuccuaaguuuaagggaaaaguuauuuuuaaaaacaacuuaauaaaaacuuacacucuuuuauacaagaguguauuuccccuuaauuaggaugcauguugauuaaacucgagauacagcuuuuugcaguaugguggguugguuuugguguaacaucuucaacaugucacacuggcuaucaaagaauaagaaaauuauugaguaugaguguguuuuauaaacuuucugaguuuuucagaugucuuaauauuuuuuaauagaacuuaauaaaaugucuagauugacuauuuuc

SEQ ID NO: 191396 - RNA, 33389 nt, Homo sapiens
ggugccggagcgcgggcgcggcgcacucggagcgggauggagcgggcgcgcgggccgcgggccgaggccgacgcgccugaggaggaggaggaggcgggggcggccauggcugcuguggugguggcggcugcggguggcgcgggaccggcgguccugcagguggccggucucuaccggggccugugcgcggugcgcagccgcgcccugggccuggggcucgugucacccgcgcagcugcgcgucuucccagugcgccccggcucgggccggcccgaggggggcgccgacagcagcggggucggggccgaggccgagcuccaggccaacccuuucuacgaccgcuaccgcgacaagauccagcugcugcgcaggugcgggccuggguuggcuggaggcgggcaggaggcgggaggaggggcggcccgggcugcugggccuuaggacagcccugugaggugggcacuaguacugucccagcucuucagaugauguagccaggcuccgcgaggcuaggucacuugcccaagaucacacagcuaauuggugucagagcugggagucucugcaaagcccuggcucguuccacguuugucugcuuugguucuccaaacgcuaagguggacucuuaugacagcccugaggcaggcagcucagagacaccuguccucauuauagaaaugggaaaacgccuucuagagaagggacuugacuugcucaaggucacauauuaagauagcugaggccuggcucagagcuggaguucccaggcuggugguagcuuagggccuugacugcaaggaaaggcgacuggggaugggaggagggcaucaaagacuaauagugucacagucggaucacccauugaacccucuuaaggagacugaggaucagcgagaguaagagacuugccaaaggucacacagcuguuugggauuugucugacucugaguccagggucccuaacaccaccucuuagcuuccagagggaaggaucuggagcuuagaggggcuuaaggugcauaugaggggcuauaggagcaucugaagaguucaagugggaagagcuaaaggagaucagaggugaaaauuaaaggggcuugggagagaauuuagcaggguaagaagguaguugucuuaugaaaggaaaccaaagacuuaguacuguaaauuugaguucugucucaucucuacuuccacugccuuaaucuacuccaucaucgucaccugggcuguugccauuauccucuaacuagaguucccuacuuccauuccuggacuacuuuaccccaguuccucucacugcuacuguagugaucuuucuugccauuugaaacaguuaugcaguaaaugaaugaguauuuuugcucuccuuccagcagcauugagauagucucaaguauuugucaucuuaaaagccuuucuuugauguacauuccccuccaggcuucucucguugaucuguauuugaucuguuuuacacacaagcaucucugaagaguugucuacuuguacuuugaauacuuuaucagcauccauuuauucuuacccacucaugaacaaauaaauaacugguuuuaccguccuuccccacuggaucauucccaucaacauuuacacauacuguuauccccccacugaccucuaaauaacauccaaacuccuuaauguuucacacaaguuccucauacccuagucccugccagucucucucuaguuuuaucuguuagcaaacuuccuuugaaaaagaauggagaggaggggauguuccagguaaggggagcagcaacauaaacaaagguacagaggcaugaaaccaccuuaaccauuuggggauguuugagcaaauuuucaucauaauaccuguuguacuuucauuuguuuacuuuuaugccugucucucccacuggauagugagcuccuugagguagggagucugacuuauuuauuucuauauccucagaucccagcaacagcuucacugcccaggcugucccuugcccucucuaccccuucacuauggcaggcccaguugcagcuguagccacuagcaggguugacccugguccugguacagcccccagggcugcuugcagcucuggccaggcaggugccaugcccgacuaagcagaaaccccuggugaggcucuuuauugaggaggagccggcccacuacagagagaagaaaaacaucccaucuacaugacagugaagggagugguguuuuaugucaccuccagaaaggaauuuuauggaagaaggggcccccuauaaugcauugaccaggaaaguccaccagagggauagccaagaugucccuggguccuccagaccucacccaugaaacucugggucucauggccaaagagcuggaaucccuggaugauaucuucaccaaaguguacaaaaccaaauaucccaugguuagcuacacagucugaagaauucuuaauagggacagcaccccagccuggacuucaaaccugaagaccaaccccauuuugacauaaacaauguguucuguuguuucaucuccaagagcagcuucuuuggaggguagguuagggagauacucagaugcuaaaucuucugcaaaauaggcuaccuaaagccucugaaucaccaggaucugaauaaagcagauguuuaaccugguuggggggacauauuuucaagaacuggauguauucaaguaaaagcuugacaccuaguaaggaggcuauaggauucuugucugaagaggugauccagcaagaugaccucaaaauucuaaguacccugaauguaaguaccugagagacuaagcccuguguaaaccuagggaacagccugcaaaagaaaaauguuacacaggccccuugaggauuaacaacaguugaauaacaggauuucuuuuuccaguuucuuuauuucuaggccugugcccaguucuuacuaacugaaggcaaauuuuucaaccucucugaauggcaguguccuuucucuguagagguggaaagugaugcuuuguuauuuuagaauucaaaaaggcccaguugguuuacccuuugguuuaccucugaucaggucagacccagcugcuuuugagucccgccuggagaaacgcagugaauuucggaagcagccaguggggcauuccaggcaaggugauuuuaucaaauguguggaacagaagguaagaccuucccccauuugugguguuugcuuaccagcacuccuucacccuccuuacccucacccuuauccuuaaaguugguuuauugaugggucagcugggugaacugaacauagucucucccaacuccauuuccauccauaaauguuuauccugcucuuucuaggcaaaguacuguggucaugguggagauauagaaguaugagagggguacuuccugcucccaagaggagcagucugguggucaaggcaaggcacacaugguaguaggcuagagguaucagagaaaauuucccaugggagauggaaccugaccuaggcuaggaacguugugggggauuuaaauuaaguagagaggaaggaaugggacuuugauguagagcaggggucaucaaauuuuuucuguaaagaacuagauguuaaauauuuuaggcauugugggccguauggucuucuuugugacuacucagcucugccaucauagugcaaaagcaggccuagaccguacguaaaugaauagguaugguucugucccaguaaaacuuaaucuacaaaaauauuuggcagacuagauuuaguuuccugacaaccagccaacccugccaacccacccccauccauucccauguugaggaauuagcuuaaacagaggaagagcuuugaaaguaaaagggguuucaggagacagcaagguacuaugcccaguuaaaauggagagggaaguguuaaggcuaaagaaauaaguuaggcauuaaacucuuugggcuuaaggaguacaggcaggauaauuuagcugcuaagaggaugggcucuggggccagaugccaaggacugaauccuaacccuuccacuuacuagcugggugacucugagcaaauuguuacuucuccaugccucaguuugcuuaucuguaaaacaggaauaauaacaguaccuacuucacagaguugugcugaagagauaauaccauuuaaaacucuuuagcgccgucucuggcauaaguacuuaauauauauuagccauuauuauccuuaaauaggaaucaaagcugaggaaaagcauguugaaaacugugucugggaagauuauucuaaugcaguguuuuucaaacuuuuugaccaugaccacaauaagaaauauauuuuacauugcaauucaguacacauguagguauaugauuguaacugaaaaaaaaauguauaaaauaaugcuaacuuuuacaacaugcaguccauucuuauuacuuuuuauucucuuucaucuuuuaaaaaacucugaucacaauccacuaaauguauuucacaaccuauuauuugaaaaauucuaaccuaggauggugcacagaacaaacugguguaggagaggccagcgccagggagaauauggaguaauccaggugugggcugcagaagccugaauuaagguaguuacaguagaaaauugggauucuacauuguguuuuaaagucaaauuagagguguuuauuuuacuuggaaaauacuuuuuuugccuuggguauccugaauuuuaagugaaucugcugagucuuaaugacuacuacucaucugacaaagggcuaauauccagaaucuacagugaacucaaacaaauuuacaagaaaaaaaaaaccccaucaaaaaguggacaaaggauacgaacagacacuucucaaaagaagacauuuaugcagccaaaagacacaugaaaaaaugcucaucaucacuggccauuggagaaaugcaaaucaaaaccacaaugagauaccaucucacaccaguuagaauggcaaucauuaaaaagucaggaaacaacaggugcuggagaggauguggagaaauaggaacacuuuuacacuguuggugggacuguaaacuaguucaaacauuguggaagucaguguggcgauuccuuagggaucuagaacuagaaauaccauuugacccagccaucccauuacuggguauauacccaaaggauuacaaaucaugcugcuauaaagacacaugcacauguauguuuauugcggcacuauucacaauagcaaagacuuggaaccaacccaaauguccaacaaugauagacugaaucaagaaaauguggcacauauacaccauggaauacuaugcagccauaaaaaaugaugaguucauguccuuuguagggacauggaugaagcuggaaaccaucguucucagcaaacuaucgcaaggacaaaaaaccaaacacugcauguucucacucaugggugggaaucgaacaaugagaacacauggacacaggaaggggaacaucacacacuggggccuguuguggggucgggggaguggggagggauagcauuaggagauauaccuaauguuaaaugacgaguuaaugggugcagcacaccaacaugguacauguauagauauguaacaaaccugcacguuguguacauguacccuaaaacuuaaaguauaauaaaaauagaaaaaaauaaaauaaaaugacuaauugaguuaauuagaacaggauuaauaguaaauggguugccaggcgcaguggcucacgccuauaaucccagcacuuugggagguugaggugggcagaucacuuaaggucaggaguuugagaccagccuggccaacagggugaaacccuguaucuacuaaaaauacaaaacuuagcugggugugguagcaggcgccuguaaucccagcuacuugggaggcugaggcaggagaaucgcuugaaccugggaggcggagguuacagugagcugaggucauggcacugcauuccagccugggcaaaaaaaaaaaaaauaacagauggguuaauuauaauaagguuggggagcaaauucaacuccuaugacaaauagaguuuacaacuuuaugugagcaaacaauucuuuacuacaaauauuuuaacaauugucauuuccuauaauaaacacuuauaguaguaagguuacaagucaauagcucuuggaaauauuacuauauuauaaacuuuaaauauuagauaggaauguucuuugccccuuuuugguaaacagacuuagaaauuuggcuuuaugaggccgggcgugguggcucacgccuguaaugccagcacuuugggaggccaaggcgggcagaucacgaggucaggagauugagaccauccuggcuaacacggugaaaccccuucucuacuaaaaauacaaaaaauuagccgggcguuguggcaggcgccuguagucccagcuacucgggaggcugaggcaggagaauggcguggagccaggaggcggagccugcagugagcggagaucacaccacugcacuccagccuggacgacagagugagacuccaucuuaaaaaaaaaaaaaaagaaagaaauuuagcuuuaugauaaaauguagaauauguaaagauuuaauuuaaauuguggcagcucuuagguaaauauucacuugcuaucuucuguaucuagcuagauagaggaaggcuaacggcuaacacauauuuuccauucccacagucuugucuuuacuacuuugaguuauugguuccccaccacaugggacucaacaucccccuuuuauaauacauuuuuuaaaaauucucccuuuucuacccugaaauaaaacaauagguauguaaaaauauaaccuaccuguauguauaaccucaggugggaaaaucaauauaaugcccuaaccauaauauaaagaaaaguauuuuuuaacaaaauacauauuuuagcauguaaauauuagggcacgacuacacugugagaccuaauguagucaugaggugcuuccacccauuucugaaauaaccuugaacauguaagcagcaaauacugacuggcaaauggguguuauguugauaauuauaaaaacucuaaaaccaccgggugcaguggcucacacauguaauccuaguacuuugggaggccaagguggcagaucacuugaggucaggaguucgagaccagccugggcaacacggugaaaccccgucucuacuaaaaugcaaaagaaaaauuagccaggcaugguggcgcaugccuguaaucccagcuacucaggaggcugaggcaggagaauugcuugaacccgggaggcggagguugcagugagcggagauugugccacugcacuccagcgugggcgacagagugagacucugucuccaaaaaaaaaaaaaccuccaaaaccaugagcaguguuguuaucagugaccuaugauuccacaauguggaaucuuucaaguuauauaguaguugcauuucuggaaauuuuaguauuaaagcaguguuuaaaaaaaaaagguucuaggcccaaguaauuauaaauauugaaauauuauagguauuuucagcugcaagaaugucuagcuagacauugaaaaguuguacaggaugagggaaauuuuuuuuauuauguagaacucacccauuugacaccccucccauaauguagauaucaauauccaauaaacuauuaugauaaccauaaaauuaucugcacagauuuccaaagcauccauaguagggaaguaaaauacccauuuaaaguucuuauuaaaugcuucugauuuuugacauguaguuucaacugcuuuaauuaccuuauuucaucaaaucuaaagcucacucuuauuuuucucauuuuaacaucacuaaaauugucuuauaauugauaugacaggaaaauauugugcuauuuaauuggcaucauuuucugaugcauaaaauaauggugcaucuuaagauaugaugucuuagauuugauaaaaugcaauacgcuuauacuuagggcuuaaauuuuuuauuucuauaagugaaaauggauacaaauaauagauuggagagacauuguguaaaaaccgauacaugaggcuucaugacugaaaggugaaagcagcugugcaaguggagguuuuguuuuguuuuuguuucguuuucaugguacaccugagaaugagugguaugaaaaugaaauucucaucaggcacaguggcucaugccuguaaucccaacacuuugggaggccgaagcgggcagaucacuugaggccagaagucaagaccagccuggccaacauggugaaaccccaucucuacuaaaaauacaaaaaauuagccaggcaugguggcacaagccuguagacccagcuacucgggagacugaggugggagaaucacuugaaccugggaggcagagguugcagugagccgacauugugccacugcacuccagccuaggcaacagagcuagacccugucucaaaaaaaaaaaaaaagaaagaaagaaaaugaaauuaacuccuuuuuagaugguuuacauaugaaggaacggcuacacugggauguugucaguguauaggugcgugaccaaaaagacuaaaggguguucaacaggcuuuucucuaauuuguggguacagguucuaugaccaucauuuaugaaaaguguggauuaauuaaagcacaaagugacuaaaggcaagguuuuaugcagaaaguguuuuucagccucagaaucccaggugucgaauguacuucugagaagcacagccuugaguggaagacucagaacaacccaucccuacuaccagaaacuacucaaaacaggauuuacuagcuaugaccuuuaugagagauaauggcuacgagacaaaauaaucacuuucaguuguugguggccuuuuuuuaagggugucuaauuugauagaggaaacauuaagauugaacacucaaaaugacucuagucugcugaggaugccuaccaucaaaguguugucagagauaagcaguauccuuggauaacacaucuuuccauuucuuaccucucccauggcucaguguggaauaggucaggacagagcacaguaaucccaagcaggccuaauucugggaagaaaucccucauauccacaguggcagguggagaauggacucucaguacuaguagaugauaguuuacugagagagaaaucuuaucucugaaucucagaaucuuagaagaaaguuguuuucuuauaaacaauaauuuuuauuuuuauuucuuuuuauuuauuuauuuuauuuuaugagacagagucucacucuguugcccgggcuagagugcaguggcgugaucucggcucacugcauccuccgccuccuggguucaagcgguucuccugccucagccucccaaguaucugggaucacaggcacccgccacuaugcccagcuaauuuuuuguauuuuuaguagagacgggguuucaccauguuggccaggcuggucucgaacuccugaccuuaugauucucucgccucggcuucccaaagugcugggauuacaggugugagccacugcgcccagccaacaauaauuuuuaaaauaguguuaaaauuuuagaacaauuauuauaaaaaguggagagaagugaguucucacaugcaaaauuauuuaaugagauuggguacuucaccuagcuuaguuaccuuuuuucuuaugaguaaaguguagauuaauaucuugucuuauauauuucagacagaugccuuggggaaacagucugugaacagaggauucacuaaggacaagguagguuucuaauuaaauauaggaaaaaaagcuugaagucauaugggacaucuagaacaagaggcugcaaauuugaacauaaguacuguggcucagugauuuuguguaaggugauuuuccagcuguagaagugagaaauauuucuaugaacuuuguguccuugaccaugaccccuagcauagcaguuuaauuaaaaauaacaaccaaacuuucuccucuuaccagcugcaaagugccgcaggacucauugguaagggugaagccuuugggaaguacauggcaaccuaagagagacuccucaggaacagaacuaugaaaaccugucuaggcuugggggcucacuuucucugagcauguggguuuucuuauacuuguuuucuacuuuuggaaaucuguuucauuguccugacauguuugccacaggcuuagagauagaguuaagcuguuuuuuuuuuuuuuuaauuauguguuaauugcuuuuuauugucucuuucaagacucucaguucaaucuuuaacauugagaugguaaaagaaaaaacugcagaagaaauaaaacagguaaugaauggaaaugggcuggccuacucuaugaaaaugugaauucugugaaccaaaucugaaaguacauuuucugacaccucuuucuagccacaaugaaagguaauaauaaaaggcaaaagugaugaauuacuugaagaacaaugucauaagaaaacuugucuucuuugucacucuuauaugucuaaucaacuuguaugucuaguuucuuuuucauucccauaauccacaucucguguaacccucaucaguacucuguaccuggauuacugcacuaccuuuccaaauagguuucccuucuccuuuuuuuuccacuccacccauaauauucucaucaacugaguccucugaaacuucuccuuucauuauggagaaguauaguguauugguuuaaaaacacagacucuagaaccaagcugccgguuuuaaguccuagcucugccacuaucuauaggacuuggacaaguuaaucaacuugucugggcuuuaguuucccuauuuaaaguggagcaaauaauagcacuuaccucauagaguuauuuggauaauuaaaugaguuaacauuuauuaucacuuagaacagucccuggcauagaguaagugcuauauuuauguuuuuuaaaaaaugggaaaaaaauguauuaggaaccuggucacaaauguucagugacuuccuguauuccuuuucugggcauucauagcucuccauuaucacaggaccuucuucaggaagcuuccugaacacuuuccuucaaagcacucaugagcuauccugccuguuuggucauuuauauuuuuauaccugugauucuuuucucucuaauaagcuauuuuucuggcauucuuuauaguuccaugaauuauacauuagguagauugagaggaucaaaauaauaauaaaagcagcauacucuguaucagguacaaugccuaaugcuucauaugcauuauuucauuaaauucucuuaaccaccccgugaagugggugccauuauucccaguuuacaguugaggaaacugugacuuaaagagauuauguaacuuagucagugguagagcugggacucaaacccaugucuauuugacucugcaucauauucccacaacuggaaguugugccaguugccauggguuuccuuuguaugcuguaucauuuauuuuagcacacauuuaaugcauaccaauuaaaugucagacucugugccagauacagagauaaaugagagaauccucauccccaaggaguuuuagccuccgcaaaacggaucagaucagcacaggguucuuucuauuaauagaggcauaugcaaagugucagggagaacucuggcugugccuuugggaagaaguaccaaaggaacauggacacaaaacaugucauuuaggggaaaaagaagccaggcccaggaggccugaucauaugacaaguaucauugagaccuauaguuuuagguauaaauuuguguuuguugaaaugaguagcuaaauucaacuauauaaggaaacauauaucagucucaugaauuucaguuuugauucauaaacugucugcuaauaucauaaauuaaauaaaaauaaucagaauaugcuguccuuaaaaugagaagacaauguuuugacaugcaaaaaaagaaaagguaaagcaaccuuaugccacauugagaguaguuuccauagguccuaggaguuaauaguccuuuugugcucuguguugauuagauggaucacacuuugauuaguaucuucaauuggggccccauauuuuaacagaaauguugacaaaacagaccaacucuaaaggaaguugacccauucuucaacacuagcucacucuggugucaccuugguuaugauacccuccucuacuucuaugccuuuguuaguguugucauucucugcuucaaaugugucucuuaucuccuucuccugcccuaccuguuaucuucccagccuccuuauuucccuacucuaacuccuaaucauucuucaggauacaguuccaagugucccuuccucuggcacucuucccuacccuggguuaagugccucuuuuagauuacauguuucuuauuauuucacaaucaucuaucauucaaccagcauuucugaguacuuuuuggguugcaaggcauuggugacaacacagcagauaccugccuacagggggcuugcaaacuagugagggaaauagauccauaugcaaaugaucuuauuaugaaguagcauauccuaggcaucuuaagagagauauaaaauaugaaagcaagggggaggaaauaaauaaaauagaaaagcagcucauaggaaaacuucugacuguaauaucaagggaaacugcauggaagaagaagcauauaggcucagcuucagaguacaggaagaauuugggaggucagagguaggagagagaggcuuucuagucagagccaauaacauguaaaaaggcaugggaaggcaaaaaaaagguaguaaaaaauaagaacacagagcauccauaugauauuaaugguaaauaaugaaaagacacaauauugcauauaugcuacaucuauguauacuauaaaagacaugcuagaaagaaauaaaguaacaguggucuuuguuagggugguaggacuaugggcauuuuuuccuuuucccuguuuucuaauuuucaaauuuuauuauauaauuuuuuuauuccccaccuuuugguauuugcaucaugaaggucaacuguagcuuccuuguucguuagugucaagcagagguaggacuucugauugguauauaccauagucagauccaacagaccuuaucucuuccacauguagaagacuuucuggaagcaggauuuuaagagcugccuauaacaugccaauaauaucuaauaugguuuugcuguguccccacccaaaucucaucuugaauuguaguucccauaauccccacacaucaugggagggacacaaugggagguaauugaaucauaggggcaguuaccuccaugcuguucccaugauaaugaguucucacgagaucugaugguuuuauagggggcuuuucccccuuuugcucauucuucuuccugucaccaugugaagaaggauguguuugcuuccccuuccaccaugauuguaagauucuuaacgccuucccagcccuguggaacugugagucacuuaaaccucuuuccauuauaaauuacccagucucuggauuaagaaaauauggcacauuuacaccauggaauacuaugcagccauaaaaaagcaugaguucauguccuuugcagggacauggaugaagcuggaaaccaucauucucagcaaacuaucacaaggacagaaaaccaaacaccgcauguucucacucauaagugagaguugaacaaugagaacacauggacacagaguggggaacaccacacacuggggccugucaggggguggagggcugggggagggauaucauuaggagaaauacuuaaaguaaaugacaaguugaugggugcagcaaaccaacauggcacacguauaccuauguaaccugcauguuguacacauguacccuagaacuuaaaguacaauaauaauaauaauaauaauaauaauaauaaauaaauaaauaaauugcccagucucagguauaucuuuauuagcagugugagaauggacuaauacaauaucuaacaaaagcuaacauuauuuguaguguuuauucugugacaagugcugagcuaagcacagaccuacauuauuucagcuagucaugacaauucugugagguuauuauugcuauuuuauugauguuuuuuagggaguuuucaguaauuugcccaagguaguauagcuaguaaaugacuggagcugagauucgcauccaggucugccugacugugaacccugagcucuaguccugacucucugggaaggcucaguuggcuggggagguguggguuuggggaggaaauaaaaaugugaaaaaaaagaaguugucuaucacacacaaggcacauauuaagaggaaugacuuuuaaagucagagaaucaguuucucugucaggaauuuguuauuaagaguuacaguuuaaucaucuagaagaguggauuguauuaaaucuuuuuugugaugugcuaguaaugaaagcguuauacuggguuuuuccucucuguuaucaaauagcauauuccucugagcaaugaaaacugucaccauuucuuggcacauguugaaaagauuacccacaugucacagacaccccucucuuuuuuguacagauuuggcagcaauauuuugcagcaaaagauacagucuacgcaguuauuccuguaaguaguuuggagggcaaagugaaaguguuacaacaugaaagucaguucucuaaccuuagcaggcaguugccuuuacuuuuccuauguuuauugccucuugagaagcugcauuuuacagcccugagaguuuuuauuaugcccugagcaccagagauuggaagcuccauaugguauauuuauggcucuuguuuuccuccuuucuacuuuagaaaugucucugagucaagucucugacaagggagcgugguauaaguucauguugcugaguaauuuccagaugucuuuuuuuucuuacugauguuuuccaaccaagcuguuggaauuuaagacagggccucuagcacagcuuuuuucccuucuugccuguaagugaccuauaccugagcugacuuggagccucuuccuagucuaucucuggugaauauuccccuuagcaaguggcauuuucuuggucuuucccuucuugaaauuauucuuagagauggucaccaucuacugcuugaccauuaaggucugugacagagaagggaugcugcuggcuucucugguuuaauguuuugcuggccuucacuauaauaaagcaucugaaguacuggauuaucagcuaguucuuuguuuuucccugaaggaggggugggagcuuagguuaaguuucuaucaagcacacaaauauauauugagauuacaugaguaaguguaagauuaaggaggaaaacauauagauggaaggauaaagccaggccuuuuggugguuaugaugguaucgcuaucuuuuuuuuuaaucucucauauauauauacccuuauccuacaugaauucaacagccagaagaagagucugcgcuuuuugugauguuuuagaucucugauacugacucauuguuuaaacaggccuucuuaccucucccucaaacugacuuggugacuugaugucucugacaauuguuaaaguucccuggagcauuggugcaccuagucuuuacacauaauucugacaauaaacagcaaaacagacaucugguuuuuccugucuuucugucauaagagugauuugaaaaugaugaaacuuaaaugacuguuuuaguuguauuauaauucuagaauucagucuuggugaauuacaugugauaguggccuuuuguguuuuacuauguguagguuaacuuuauucuuuuccaaccuacaggcagaaaaguuugauuugaucuggaaccgggcucaguccuguccaacaguaaguuucuggugaucacguaaggguugcuuaucaauguugccaaacaaguauuuuccagcccaucacgucauauuccauacugucucacauguuauagugcucuguuuacuuaauaaagaugcucacauguugauuguacuaauaaguuauagugcucuguuuacuuaauaaagaugcucacacguugauuguacuaauaagugacauuuucagccuuaugaaaucauguggguuugacccaguaagccucuggcuuuuuagcucccuaccacaucagcccuuucugauguagaucuuaaucuaucgguacaagugcguuuuggaagacaucugagaccuuaaucuuuucaacuucuuuuuuuuuuuuuuuuugcuuuuauuauuauuuuuaauugacacauaauuauacauauuuaugggguacagugugauaguucaauacaugugugcaguguguaaugaucaaaucagaauaauuagcacaucuaucaccucaaacauuuaucauuucauuguauugguaacauucagaauccauucuucuagcuacuugaaaauauacaauaauugccauucuaacuggugugagaugguaucucauugugguuuugauuugcauuucucugauggccagugauggugagcauuuuuucuuguguuuuuuggcugcauaaaugucuucuuuugagaagugucuguucauuuccuuugcccacuuuuugaugggguuguuuguuuuuuucuuguaaauuuguuugaguucauuguagauucuggauauuagcccuuugucagaugaguagguugcaaaaauuuucucccauuuuguagguugccuguucacucugaugguaguuucuuuugcugugcagaagcucuuuaguuuaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguguauacccaaaggacuauaaaucaugcugcuauaaagacacaugcacacguaugcuuauugcagcuuuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuauggcaagaacaaaaaaccaaacaccgcauguucucacucauaggugggaaucgaacaaugagaacacauggacacaggaaggagaacaucacacucuggggacuguugugggguggggggaguggggagggauagcacugggagauauaccuaaugcuagaugacgaguuagugggugcagcgcacuagcauggcacauguauacauauguaacuaaccugcacauugugcacauguacccuaaaacuuaaaguauaauaauaauaaauaaauaaauaaaaagaaaauauacaauaaauuauuguuaauuauaguacuccauagugccguagaacacuagaacauauuucucccaucuagcuguacuuuuguaucccuuaaccaaacuuuggcuauucguuccucuaguaaccacucuccuacucucuccuucuaugagaucagguuuuuuuuuuuuuuuagcuuccaacaugugagaacaugugguauuugucucucugugcguggcuuauuucacuuaacauaauguucuccaagcucauccauguugucacaaaugacagaacuuguucuuuuuuguggcuaaauaguauuccauuguguauagauaccacauuuucuuuauccauucauuuguugauggacacuuagguugauuccauaucuucgcuauugugaauagugcuguagcaaacaugggagugcagauaucucuucaacauacuaauuuccuuuccuuuggauauauauccaguagugggacugcuggaucaugugguaguucucuuuuuaguuuuuugaggaaacuucauaauguuuuccauaauggcuauacuaauuuacguuccaccaauauuauacaaaaguuccucuuucuccacaucuucaccagcauuuuuuuuuuuuucauuuagagaugaggucuuacuguguugcccaggaugggcuucaaauccuggccucaaaugacccucccaccucagacucccgaagugcugggauuacagguugucuuuuuuuuuuucguaauagcuguucaaacugggcugagaugccuguuuuauuggcaguuuucuucacaguuuuggcuaugcuauccugguaauaugugccuaaaggaauuaagaggucguagcugaaauacugagcugccagaaggccuaagggaaaaggaauaggugggguggaccagcuaacuugguaucaguaaugauuucucggguuuucaaaacauuuuuggaaacauugcugaaaacagagaauaccuaaauaaauggaaaugauauauaccauguucauggauuggauggcucaguuuguuacauuuuguuuuguuuuguuuuuugagacaggaucuuacaguguugcccaggcuggagugcaguggugugaucauagcuuacugcagccucaaucucuucagcugaagcaauacccccaccucagccuucuaaguagcugggauuacaaacaugcacccccaugcucagcuaauuuuuuguauguuuaguagagacaagaucucacuuacguugcccaggcuggucucaaauuccuugguucaagcaauccuccugccucagccucccaaagugcugggauuacaggugugagccacugugccuaggcuuuguuauuguuaagguaucaguucucuccuaauuggucucuagaugaaauacaauacuaaucaaaaccccacuaggcauuuaagaaauugaugagcugguuuuaaaauuuuacuuggauauuuaaaggacugagauagcuaaaacaauuuugaaaaagaacaaagcuugaggacuuacauuuccugauuucaagacuuauuacaaagauacaguaauuaaaacaguaugguauuggcacaaagauagacauguagauuaauggaacagaguagaguccugaaauagacaaacauauaugugguuaguuguuuuucaacaaaggugucuauaaauuagagaaaggauaaucuuuucaacaaaugcugcuaaaacaauugaauaucaugcacaaaaaaaaggaaccucuacuuuuaccucacaguguauacaaaaauuaaaguagaucauaaaaguaaauguaacuuuuuuuuuuuuuuuuuuuugagacggagcuugcuuugucacccagggugcaauguaguaugaucucagcucacugcaaccuccaccuccuggguuuaagcuauucuccugccucagccucccaaguagcugggauuacaggugccugccaccacacugggcuaauuuuuguauuuuuagcagagaccauuuuuuuuuugagucagagucuuguacuguugcccaggcuguagugcaguggcaugaucucugcucacugcaaucucugccucccagguucaagcgauucuugagccucagccucgugaguagcugaaguuacaugagcccaccaccacacccagcuaauuuuuauguuuuuaguagagacaggguuucaccauguuagccagucuagucucaaaacuccugaccucaagugauccacuugccucagccucccaaagugcuaagauuacaggcaugagccaccgcaccuggcccauaaauguaacuuguaaaggaaaauaaaagaagaaaucuaaauuaccuuggguuuggcaaagaugucauaaguacauuacaaaaagcacaaacuauaaaagaaaaaaaucaccuugggcaauauagugagaccuugucucuauaaaaaaaauuuuucaagcaccuguugucccagcuacucaagaggcugaggugggaggaucacuugagcccuggagguggagguuauagugagcccagaccggacaacagagcgagacccugucucaaaacaauaaaaauagggugggugugguggcucacgcauguaaccccagcacuuugggaggccaagguggguggaucacuugagguccgaaguucaagaccagccuggccaauauggcgaaaacccaucucuacuaaaaauacaaaaauuagcuaggcgugguggugugugccuguaaucucagcuacuccggaagcugaggcaugagaaucgcuugaaccugggaggcagggacugcagugagccgaggucacaccacagcacuccagacuagcugacagagugagauucugucucaaaaaaauaauaauaaauaaauuagauuucaucaaaauuaaaacauucuauuugcauacccaaauagcuucuacauucauagcaacauuagucacaauagccaaaagguguauagcucaaguuauaucagaaauucuuauaacucaauaauaaagaggauagacaaauggacaaaggauuugaacauuuuaucaaagaauagcagauaagcaccugaaaauaugcuugacagcauuagucauaaugggaauccaaauuacuacagugagauaccauuagaaugacuaaaaugucaaaaacugaucauaccaaguauugguaagaaugugaagcaccuggaacucuccuauacugccggucauauugcaaaaugguacaaccacuuuagaaaauaguucggcuguuucuuuaaaaauuaagcauauaccugccauacuaacuagccauuccauuucuagauauuuucccaagagaacucaaagaauauguccauagaaugacuugugcgcaaauauucaagcagcuuuauuuguaacaaccaaugcuggaaacaaugcaaaugucugucacuagugcacaggaauuguggaaagagagaaugugcauguguguguguguguguguguauguguguauacauacacaauggaauaauauucagcaguaaaaggaaugaacuauugauacaugcaacaacaugguguucugugaaagggccauaugugcaaaacgacccccaaauggugaaggagcugaaaaaccaaagaaggaggcagacaaauccaauuuguggguaugggaugauuuauugggggaacuuacagacgggaaugucguauuggguggcugcaauacagguagaucuccacaccacaaccagacagacccaauaugucuuauaucuuggggaaaguauacaugcucuggaaggaauguguagguggauacagucaucacugccuaugauuucugcaacaacaucaaggauuguuuuggaagaauagauguuucuacauaaagaguaauacaucaacuagacauuugggaggcauuccuggacuugggguuagucagaagucacacgguggacuagcauuuaaaauaaagucacucuuguuccuacacauggauagaucaugaaacaguuaugcugacugaaaguaaccaaaccaaaaaaguacucauuuugugguuccguuuuuacaaaauucuacaaaggcacacuaaccuauaguggcagaaagcaaaucagugguugcuuagggacaguaagggacagggaaguaugaacuucaaagggcaaagaaaacuuggaagugauaaccauguucauuuuguugauuuugguuaugguuucacaguacacauaugucacacucaucaaauuguauacuuuaaauaugugcacuuuguuguauuucaaguauaccucaauaaagcuguaaaaaaaauauuuucccuagcaagggaucaucugucaaguaggcacuaaguuuaucucaucuaauaauaauaaauuggagccugagugguugacaauaagaagauaauuugugacuaauguguauugggcugcuuuauacuuuuguuuuguucuggcaccauucuuuucucuacuacucauccccauucuaaacaucuugagcauaaaacuuauuuuuugguguuuagucuggagccaugcuccaauaucagccuuaucugauagaaugugaaguaauuacagcaauuggaacgagcuaauucagcagcauuagaaaguuuagaaauugaaacauccaucaagagaaggauaaauagugauaaacuucuacaauagaauuccauacaacagugagauauuuaugaauucagaguuauagauaucaacauggauaaaucucagaagcauacuaugaaguaaaaaaguuacaaaaggauacacacacuuugauaagauuuaaguuuuuaaacauauaaacuacuacuuuaaaaaaaauuuuucuaaagacagggucucacuauguugcccaggcuggucucaaacuccugggcucaaucaguccuccugccucagcccccgaguagcuaggacaacaggcacaugccaccacaccuggcuauuuuuuuuauuuuuuuguagugacggggucucacuguauuguccagguuggccucaaacuccugagcucaagugauccuccgaccuuggccuuccaaagugcuggaauuacaggugugagccaccaugcccagccuguaaacuacuacuucuuaacuuacaguuauacgcauauacauuaaaguauuaaaauaugaaaaaggaggauagacaccaaaugcuggauagauguuaacucugggaugggauuagaagggaaugcagagggaaccucaauuguauuucugaugcuuucuuagguggauugauaaguacaugaguauuuauugccacauaugaauuucuuaauuuuaaaaaaauguuuuaggcugggagcaguggcucaugccuauaaucccaucacuuugggaggcugagggaggcagauugcuugagcccgggaguucaagaccagccugggcaacauggcaaaaccccaucucuaccaaaaaaaaaaaaaaaguagccaggcuuaguggugcacaccugcaguuccagcuacuugggaggcugagugggaagaucaccugagcccagcagaucaagacugcggugagcugugaucaugccugcacugcagccuggacaacagagcgagaaccugucucaaaaaaauaaaaaaauauuuuaaaaaccaaauauggaggaaauggaaugaauguuacaggugguuggauauagagcaaauaauuucauuuauucaucugucuccuuguauaucuguuuuucacaguuucuaugugcucugccaagaagggaagguuaugaguuuuuuguaggacaauggacagguacugaacuccacuucacugcacuuauaaauauucagguagguggcuugugcccuuccucuagaggaaagaggacuaccccuugguaggacuagaaacccuugcugaggcucaaggacacagaauagcugcuuacucccagcauuuauuauuguggcgcagaugaauugucauacuuuuuguguuggacuaguuuucuaggcccuccucaauaccuagaaauuggaaaagacuccaaaacaccuucucugacuacuucugguucucuuuugucucuuccccagaccucuaguuguauauacugcaugugccucacuuaacaaacaugccugaguuaugauggcuaucuuuuuaacccaagcuagaagccccuugaggaaagcuccaagucuuaaauguguuuuauuaccuaagucaacaccuuccaacaugcuaagugaauaguuucuguuuaauguuauuuuguuugcuuucuuccuuuauuucuuuauuuccaauaaaacaauauuaacuuuuaaauauuauauuuaaaaguuagauucaaaacauuuaaaacuuuuaaaauaaaagucaauauuuuaaaucauaacuaggauuggcauucuauauuuggaggucaaauguggcaaaaaacaagcacgaauuauauuggcuuugaaguugggguaaagaaugcaaaauagaaugaaggaacagcuuuuuacuuugcuauuuuguaauaugucuaacaacccuuuauugaguacauacuuuaauaaccaacaauuugauguacuuacuaugugccacauguuuuauauauauuaugucauuuaauccucauaauacgccauauuuacuguuauuauuucuaauuacauagaagaaaguggccucagauguuaguuacauugucuaauaagugauagagccaggauugagcccagguuaucugacuucaaagucugugaacuuaaucauuaugggauuguguuaggaacugugcuaagacuuggagaucugugagacaaggucccugccuucauggagcuaauauucagcuuuaggagaaagauccagaaacauaauuacaauaaaagugauuaguauaauauuagaaugaugaccaaaaugaucaguguaacauuagaaguauguucaagaaaaaugagaugcugaacuauuacaaguacccuagugauaguuggauauuuauaauuaaaaagacucgcugaaauuuuagagauaaagucuaggaaucuucuuuugaauguaguuguuuccaccugugcuauguaggggcuuuagcuuugaacccauccucucuaccuagucuagacuugagauuuaguaaccacugcccugaucauucuucauaaaaucaugguguuuccauccuucuucuccccuucaccccccaccaacccagauuauauuuuagagcugcacauuacaaaucuggcucaugugcaaacucugcagcuccugcuacagcuuaaaagagcucagucuucagagccagccaaggggaguagauuucaacugugaaaugcacuaguccaugaaaguggcaauuacacaggcacauugcuuucuuuagaacuugauuugguagcugcuugugccauuuuguuuuuaaauguauggucacaaugauggauucacugccuacuguaaacauuuucugggaaaaaagccaaaccuuuuccaguugaagacacaaauaacacugugcaaacugucaguuucacugugccuuugcaggccugaccuuaccaccacauaccaguccuccaacucacuagccacccaaggggcuguuaagagccagaauuuccucuagacugucuauugcuuugaaauugcaguuuguugugaugguaccuuauugagccuugauaaguguuccaccuugcagacccgaggggaagcugcagccagccagcugauuuuauaucacuauccugaacuuaaggaagaaaagggcauagugcugaugacugcagaaauggauuccacauuucugguaagaauuaacuugcaaaacucuuuggauuuaccucauggcacugaagguauuacucuucugccaaagcucaugagagagaaaauuucaaagagcuacauauaccuuguuucuuacuuauuuuaaaguugacagugaaguugucuugcucaagaucuuccaauuugaaguuaguacagauccucaaucauuuauucacaauucugaaacccaugggcucugagaacaaaauguuuuuguucucauuuggucacaaaaccuuauguaaacuugaacucauuugguaacuaaaucuuuaaacugaugugaaacuauuuauauaacuaaucccacuugguguggaguauuaugcauuuuacuagggaaauauuaauguguuugaguauggggagucacauaauauaguuauauaguaucuauaccuauuaucuuucuaaaauucaauaauucugaaucuaagacacaucaggcccuaaggguuucagauaagagauuguagacaaguaaauggcuucuuaauuauagggaagaguuguauugaagccuaggauagcucucaauauuuuaucuuccuucauacuguucauuuauacaacauucaucauuuauaguguuuuucuuuccuccuuuucccacuccuagaugagaaucacugagauagagcauugaccauaugcucauaguuaaugaugcccacuguguucucucugcacauccaggugccaggagcaguguugugauuacuguacacugucugucuaguccuugcucauuucagucacauauccuuuuaucuggcagagguuaaguucagaauguccccaaacaguggacacuucccccuaacagucuucauuacagcacccacuuauuuuuucucuuucucuuaccagcugcauagggagaaagaagugauaucacucagcugauaucucacaguagcaguaacccacaaaccuaggacacagugaggauucuacuucccuauucuugaagcuauucaguaccaucucucccauucuuccuuccacauuaacccuuccauucaucacauucaacugaaagccaaaauucuauccaagaauauggaauugccauuaacugagauaggcaagauugcaggaggaauaggccuaacaggaaaaucaggagcucacuuuucgauguauuaaaucugagaugccuauuagauauccaaguaguaggcaauuagauauaugagccuggacuucaugggagaaguccaggcuggagauauaaauaugggaguugucagcauacagauuguacuuaaaaccauaggacugaaugaagucaccaaggaaguaaguaaaaauagagaagagacgagaucuaagaacugagcgaggggucuccaucccuggagagaugaagaagcaucagcaaagauuaagaaggaauggccaugagguaaaaggaaaauuaagaugguagaaugcccuggaagcuaaaauugaauguuucaaggaauagggacugcucaacucaccaaaucucccuuguuuauuagggcaaaugagauuagaacugagaauuuacugauuucacaaacauggaagucacugggggccuuauaagagcaguuucauaaaagugugauuggaguagacuuaagagaggaugggaagagaaacuccgaagaaucagcauagaaacucuuucaaggggcauuucuauaaagggaaggagagaaugggguauuagcuggagguggagaagugcgcccaaggguaucuuuuguuucaaauaugagaaagaaaacauauuuguaugcugaugggaaagguccaguugaggcugggacaguggcucaugcuuguaaucccagcauuuugggaggacaagguggguggauugcuugagcucaggaguuugagaccagccuggccaaugugaugaaacccugugucuacaaaaaauacaaaaauuagccaggcgugguggcaugcaccuuguaaucucagcugcucggaaggcugagguaggaggaucacuuaagccccagcagcaaagguugcagugagcugagauugcaccauugcacuccagccugagcgacagacccagacucugucuaaaaaaauaauaauaauaaaauaaaauaaauaaagauccaguggagagggaaauguugaugauacaggagaaagcgggaagugauauuuuugagugggcaagucugguaaugagggguugaucuuuaccaggaauaugacagcaggagagaagccagaguauaaggacacugauaaaauuagauggauagagguagugguauaaguuuccuacagauugcucagugaaaagaaagaaaaguucucaucagcugaaagcaagguuggaaaaauguuggacauuugagucaaaaagaggaaguacaaaauuguugucuaggacaagcgucagcaaacuacagccuaugggccaaguccagcccacugcuuguuauaacgcccacgaguuaagaauguuuucuaccucuuuaaaugauuagggggaaaaacucuuuuuuuguuuguuuguuuguuuguuuguuuuugagacagagucucgcuguguuggccaggcuggagugcaguggcacaaucucagcucacugcaacauccaccucccaggcucaagcaguucuccugccucagccucaagcaguucuccugccucagccuccugaguagcugagauuacaggcaugugccaccacaccuggcuaauuuuuguauuuuuaguagagacgagguuucaccauguuggccaggcuggucucgaacuccugaccucagguaaucgacccaccucggccuuccagagugcugggauuacaggcaugagccaccacgcugggccaaaaacucuuuauucuuaaagaaauacagaaauuauuuaauaacaaaaacuauuauuaaagaaaaauaguauuucaaguuuuauuagaacacagccauauucauuuauuuacauauuaucuauggccugaaggaaguuaaaggugaaugcaaaggaaugauuauugaccauggaauggaagcuggguaaugaggaaagugaaaauauaagggagguuagagacaguaagaauuaugaguccuaauggguugugggaguuggaagugagcugaaaagauaggaaauaauuugaucaugcaagugagugacaauauagagauuguacuauauuuucuggucuucggcaaagcacagcaucuaaucauauuaaaaguggauccuaaaggucagaggaggcccauucugcuguuugccauuuuuaccaccucacucugguggucucaaacugcugugcaguucucaucauuguuaaaauuugcuuccuggccuuuuaacauuugacagcauacaagacaauacauauuugccuuguauaaaucaacuugacugugagguuccgauguaguguagaacuagacauguuagaacuuguuguacaugacuuagagaagagaaacuuagaaguauaagaugaauauaugauccccuguauacucaugcaugaauugugcacuuuaggcauaguauuuccaacuaugguaaagcauuaaugucaaaugaauagaaauacauggaaacuagagauuucuucugaacuaacuuuaaugcuaaaaacuaauggaauauuuaaaaaccuagcuuuauuuggcuccacaucuaugucaauagaugauuucauugaaaugcaguaagugcuaggauagacaugcagaagguucuagggauagagaguggggugauaucccuggcccaaagggaguaauauuuccuggagaugacacccagacugaaccuucaaacagcaggaguuagccuaauaaagaaggggagaaauguuuccgacagagggaauagcauaaguaaaugcugagagacauaaaaugacuuggaguauuguaaagaguuugguaucacuuguguguguguguguguauguguguauauguaagguuuggugguuuuuguuuagagauuuggcuuuacccugagggcaugaaaagagucauuaaaggguuugaacagagaagaacccauaaagagauggauuuuaagaccuagccuauuaauuauuaacuuuaauuauuugcuuccuaaacauuguguaguucaagucuagucaguaugauaauuuagaagucaguugcaauagucugcacaagaaguggugaaaacuugaacuacagcagugguauagagauggaggaaagagaaugaccccaggaauauguagggaauaaaauagucaggacuuggugcguugauuguagauuugaaaauugaaagagagggaggaaucaaacuuguuaaaauaccucuuuauugagcagcacagggaauuaguauguuuaucuuauugggucuuggaaaaggaggagacuguugcuucauguugaaagccaagagaauaaaaggcagggggagaauaagggcugguggggguugccuuucuauaacccuccaugagagguagacaucucucucugugucuuaccuuccuauccuacucacuguacuaguggucuucaaaaacuuuuuuuuuuuuuuuuggagacagucuugcucuuuucaccaaggcuggagugcaguggcuggaucucggcucacugcaagcucugccucccggguucacgccauucuccugccucagccucccgaguagcugggacuacaagcgcccaccaccacgcccagcuaauuuuguuuuuguauuuguaguagagacgggguuucaccguguuagccaggauggucucgaucuccugaccucaugauccgcccaccucggccucccaaagugcugggauuauaggcgugagccaccacgccuggcccaaacuucuuuuuaaaguaguaggaggaccccuuuauccaaacaaaaucuuacuauguaaaaccccaggauaugacagcuaaaacaggugaagggaccugaggcaccuccacagagcaccuaggacucuacagaauaguuugaacagcaguguuguagugugaacacagcugaacuuacuccuaccuucccaccccaagcuucagauaaaaguugaugucagaggcccuguagccaggggcugagagaguggugguauccucagauuauagcagugcacuugcuucagaaaugauuugcucuugaggcaugugugaauuuaagaaagguaaaauggaugaaguaguuauuggccuucaucaaucuuaauuaucuugcccuaccagaaacagaaggaugaauuggggggaauaccagccagggagucuagaggucuaguccuggcugugaccuuggcuggccacuugaccuugagcccaucccugaaccucaucugccuugguuuccuagccuauuaaaugagaacugggugaucucugaggucccuucuagcucuaaaauucuauuaauuugaaguagccagcuuuuugggaaaagguuuuugauugaagaugcagucucagagauuagugccugcucaugagaaauguccugaaagucccacagagggaauagagauggagcacagcccauguuauuuauaaacccgucuucaucauucucuagcuagacauagcacacuuuuggcaguaaguuuuuagugggaauuuuccaugaccuuuugggguuuaauuuuggcuauaugaacauggugauaauggacaaguaccucugaccgacuagaacugcagaauguauagcaaaaguaagaguugucugaggugacucuuuugcaaaguuugagaguguagcccguguucuaacccccaucucugucauuuuuuaauuuuuauuuuuagagauagagucuuccucuguuacccaggcuggagugugcuggcaugaccauagcucagugcagccucaaacuccuggucucaagcaauccuccugucucagccucccgaguagcuaggacuacaggcucaugccaccacaucuggcuaauuucucugccucugucauguaggguggccugcucaccauuucucugcuauugcucaccauuucucugcuacugcccuucucuucccugggccuuugcugauguauuaguuauaaauggcugcauaacaaauuauacaaaaucuaguggcuuaaaacaacaaacauuuauuaccucgcaguuucuguaguagcagcuuagcugagugguucuggcucagggucucacaagguugcugucaagauguuaucuagggguauagucauccgaagguugauugggcuugagcgucugcauccagccccacucacauggcucuuggcagaggccucaugucuuugucguguuucuccauagggcugcaugaauguccucacuacauggcaacugacuuuucccagagcaagaaaauuagcaagagaaaaguuacaaccuuuauggcuugauagcagaacucauucuccaucauuuuucauuuuuucauagucuuuuuuuuuuuuuaaggggcucacuacauuacccagacaggcucaagcaauccuccuaccucagccuccugaguagcugggacuacaggcucacaccaaugcccccaaccauuuugucauagucuacuuguuagaaggaagucacugaguauagccauuacccaaggaaagggaaauuaggcuccaucaaagggaggaauaucuuaaaauuugugggcaaauuuuaaaaccaucacagcuggcucugggaguacuuuucugaccaagguaguaucauaacagguuuuauucaaguguauaucugguuagucaagaacuuaguucucacucacaaacugguucuuagagcuggguaacuguugcugucuuauuccccccuugaaauauauuuaacaguuauuagggaacuggaugaagaggaauaaugugaacauguacauuaauuuauucaguaaacauucaccagaugucacucugcagagauauaaaacaaaccacggucuaugucuuugaggaauuuguacuagggaaaauagacaaaaaaagaaaaggaaaaauacaauacagugugauaaauacuaugacagugguaagcacaggaugauuugguacacagagaaggggcaccuaaccaagacuagggacuucaagaaguuaaggaaacuuucuggaaguggugacuccugggcgagggcccccacccaccacacaauucagacaagagcuuuguggcccugugcaagaaaggaccucauuauucuuuuuaccuuacagaauguugcugaggcacagugcaucgccaaccaaguucagcucuucuacgcuacugaucggaaagagaccuacggguuaguggagaccuuuaaccucagaccaaaugaguucaaauauaugucugucaucgcugaauuggagcaaagcggacuuggagcagaacugaaaugugcccagaaccaaaauaagacuuagaacuguacagguuggcccuucaccuaguugacucagcccucgauagucuagagcccacccccuccucaggaacucaagagcucagcauuuauaaugagcaguugguaaugaguugcccuaugugcuugucgcaagcagucacagagaugagcccuauuacuugauauucaggaacaaagguaccugaacauucugauaauuaucucagcauacuugagguuuccuuuuuuaaguguucgagguuauaacaagagacagccaaggaccuacaagacaguugacuugauuuugcacaguguaacagcgcaguugcauucuggccacuuugaccuuauagcucccaaaugaugaguuugucaucuuuaugaacucaugacaggauaauaagcuugaagaccugcuguaguuagauaugggcuuuaauccuucccaggcaccagucagcugaacaaaagcauaagccaaacauccuguuuaaacuguagaauaaccagauauucccaucagguuaaagacuucaucuagaugaugccccccagagaugccuuuaguguaaguagcuggcuugggguaucagcaaauuucagguauaguuagauaaacagguacagggccugcauacuauuaaaccauaguuuguggcacccgcuuuucuaacuccaccuguuagaagcuauguguuugaaggaaugaaucagugcaguauaaauaaaauucuuuuguaaggagaagauuaa

SEQ ID NO: 191397 - RNA, 538 nt, Homo sapiens
cggcuaauuuuuuuuuuuuuuugcagaucacagaacuuuuauuuagauggaaucacugcgaauuacauagaagcuaccagccuaagccaaaacccacgagguucaugugaacuuacaguuacacaaauaagaaacaaaugguacauccgaaaccauaaggaaauauucugaugcccagaugaugaaggcuggggugaauuaaguccacacauuuauuucaaguuguuaaagaguuugugggccacgcaaugguccuuugcaugcaagaagucaaagagcuccuccgugcaauccucuucuguaugugaucgagaggauacaugcucaucauagagcucuagccgcucccgggccuuuacacauuucuccaacugcucgcauugcucucucacuguuguuaggggauccacuaauuccuccucuuccucuuccuccuccucaggaucuccggauucgguaagcaucuuuugcucguccuccagucccaugucuggcuacgguucuagauuuaacacgagcagcaacagcggcaccucaa

SEQ ID NO: 191398 - RNA, 6262 nt, Homo sapiens
ggggauuuuuaaucuuuaauuuucaagaugguuaaaauauugaaauguuuaaguggauaacuauauuauucauaaaaugacugagugaaaacuaauauacuaugagaugaaaaguacuugucagggauuuucaagcuuuugcucaaguaauuaccaugaaguaacaauuucuagaaaugaagaacaaucugugaagauaaauuaccauugguguggggaaaaaaagccaaacagaaguagaaaaagguguagcuggcauacaaauguuaucuacaguguauuuauauauauauauuuuuaaaacuuuuaacuaaaaaguaaacuuuaaugucgaaaaugcaaacuuggggaagacagaaaagaucacacacaaggcugucacuucacacguggaagguugcacagcggccgggcagaggcgcuugucacacuucccagauggucaggcggccaggcagaggcgcuccucacuucccagacggggcagcagcugggcagaggugcuccucacuucccagacuuuuauauuuuuuauacuugaccaggucucuuauguccuuuuucuggaaaacuacuuuuaacuacuaaagugauuauaaaugaaaaaguggccaauaaagugacuacuauccucagggcuuuaaaccaguugggauaaugugguaagagaaaaaguucaagguggaaugcuacucccauacccauuauuacugugacuauggcuucacuaagucuuucagaaauaaggaaggcaaaccaugaaaagaaaagaggagcugcacugcuagcuaaauuaagguagucugguuuggcuggacuaccuucugguagagcaaaaccccaucugaucccacccaagaaagauaggaaacuggcuccauaagccaucugaguaaaagcuaauaugggaauauaaguuuuugucaucagcaugaccagugguggagcaacgaaggggauuaguccugccagaguuacacauaaugcuggcuuugggcugucaguuagguaagugauggugcuugagggucuggcuagaagugcuugcuucugcugcuuuuuaaagcugcagggggauguaugauagcacugugucuugcucauauacgcuggaaaugaugaggaaagccaaggccuuggacauggggaaaaguuuugcuggagagacaucuugagagaaaguauaucuguucugcugguucuuagucccacugggaaagaguacuucaguaucuacaaagaaaauagaaccaaaagacaaaauuaaaaauauauauauguaucaucagauuuuagucaaucccaguaugaaauaauggggauuguuugaaaggagcaaacaaaaaagaucugcuuuccauuaccacaucaaacuauacagaaaggaugaacuaauaacucugaagugauauuauugcugguaagaguauuaaauggcuauacaauguacaaaagaaaccacugaacacaaacuagugauauauuucaaccuaccacuuaaucuuauuccaugagaaaaauaucugaaagaggagcagguaaagacuagaucuucagaauuuggccuucuaaacugccucuuuuauuuauaaauagcaaaagcagcagcacuaauuaccgugggaaugcuguuuuuauauggagaaaauaaaucuaccuuccaacuuaguuuuaugaacaccacauacuuuucacaguuccacaccuuuguguaugcucugccuagaauucuagcucuuacuacuuuccuaucuaggaaacuuaccucaacauucaaaauucaacuuaaagcuuuccuuuacccuucuacggucugauuuaaugcuccuauaguaagcacccugugcacacuuccaucauaauucuucucacagugaauuaaaauuguguguuuacuugucuuugucucaguagacuugagagccaggaccguauuuuuuuccuugccuuaaaauccccacugccuuucauuguacacgggcaaaguaauaaccuuuccugcugauucuguguuuuagugaccagacuucaacuaaaaaguguugcauuaaagaaaaaauugaaguuauugaagaaucucagugauuacucaaacaugcuaggaaugguuccaucuuggaaccauuucccuguuuccauauuuacugcucuucccucaguuaccuacuuccgauccccugccauuuguaaguccaauccuacgucuugacacuaccuauugcccuucccugcuuuauaguucuccacagcauuuaccaguugauguauuaauuuuuauuuuuauuuuuuugagaccgaguuuugcucuaucacccaggcuggagugcagugguacaaucucugcucacugcaaccucugccucccagguucaagcgauucucugccucagccuccugaguagcugggauuacaggcguccgccaccaugcccagcuaauuuuuguauuuuuaguagagacaggguuucaccauguuguccaggcuggucucgaacuccugaccucacgugaucugcccgccuuggcaucccaaaguuuugggauuacaggagugagugaccgugccuggccuuauuuuuuuuaauuuuuacuuuuugagaugaauuauuccucugucacccaagccagagugcaguggcacaaucucggcucacugcaaccuuugcuuccuggguucaagugauucuucugccucagccccccagguagcugggacuacgggcgccuaccaccaugcugagcuaauuuuuguauuuuuccguggagacaaggguuuuaccauguuggccaggcagguacugaacuccugaccucaagugauccaccugccucaacucccaaagugcugggauuucagccguaagccacggcaccuagccaauuuuuuuuuuuuuuaaacaucgucuugcugugucacccaggcugcagugcaguggcaugaucucagcucacugcagccucaaccuccugggcucaagcgauccuccucucucagccucccagguagcuggggcuauaggcgugugaccccaugcccagcuaauuuuuuguagagaugggguuuugccaugugcccagacuggucuugaacuccuugagcucaagugaucccacccaccucggccugccaaauugcugggacuacaggcgugagccacugcacccagccugauauaauaaacauuuuacuuacuuguauuuuacuuaacucuucccuccaucaccugaauauacaaggguaaggauuuuugucuuuuucacugcuacugaccuagcccaagcaauauuuggcaaauagugcucaaauaucugcugaacaaaccaaccuuugaagaugcuugagaaaacuucuggaugaagcgaagcauacuggccccuauugaaagucuuguucaggaagaugccagguaguucugauuaacauguuacagcuaagcagaggcacugaaucaggggcauguuucuguguauaacacaaggugucacuuaauuuuccucauuuuauacauuaauuuuuaaauaguaguaauucaugaauauaacacuuuccuuugaaaagaaucauuaauguuuucaaacugucgguaacacaguaacaaaauagauccuuuuaguaucugaacuguucuuuuagcuuuggcugucuaguguaauagaaagaguaaugcacauagagauuuuacagauacuuccaccauuuccuagcugugugacacugggcaaauugcuugaguacugguuuucucaucuuuaaaaugaagggucuucuaagugguguuuuugugaaauuaaaaaaaaaaccaaaacaaaacuggaaggucauagcuucuguuuccuuuuuuccuccuauuuuggggcuuaagaguucacaacucaaaauaacgauaguaccaaccaauauaauuuagguuuuuuuaauuuguuuguuuguuuugagacaagagucuugcugugucgcccaggcuggagugcaguggcgcgaucuuggcucacugcaucaucugccuaccggguucaagcaauucuugugccucagccucccaaguagcugggauuacaagcuccugccaccaugucuggccaauuuuuguauuuucaggagagaugggguuucgccauguuggccaggcugguccugaacuccugaccucaggugauccaacugccuaggccucccaaaguguugggauuacaggcaugagccaccgcgcccggugagcauuaacucauuuaaugcucaaaauaaccucauuaacuuaguacugagagagaauagccuguuggagugcagacuuuggugucaaacuugguuggaauccuggcuccacuacuuauuagcugugugucuuugaacaaauuauuuaaucuuguuauggugcaguucauucaccuuugaaauauggauacuaauucauaggguugauguaacauuuuuuuuuuuggauacagggucucgcucugucacccaaucuggacugcaguggcgugcucuccgcugucugcagccuugaccucccgggaucgagggaucuuaccaccucagcccucuaaggagcugggacuacaggccacgccaccaugcccagccaauuuuuuuuugagacggagucuugcucugucgcccaggguggagugcaguggugccaucucagcucacugcaagcuucgccucccagguucaugccauucuccugccucagccuccugaguagcugggacuacaggcauaugccaccacgcccagcucauuuuuuguauuuuuaguagagacggaguuucaccauguuaggauggucucgaucuccugaccucgugauccgccugcuuuggccucccaaagugcugggauuacaggcauuaggcaccgugccuggccccaauuuuuguauuuuuuguauagaagggguuuugccauauugcucaggcuggucuugaacuccugagcucaagcaauccaccugccucggccucccaaagugcugggauugcaggugugugccacuuagccugauauaacacuuaauaaguuacuacauguaaauagcugagaaccgucccugacacaaagcacuuuacacaggagggacugauuaaaaacucuaauguaagcagccaguaaaaacaggugaaugauaauauggaucuagaucugacaauuucauucuuaaccaagagaaugggaugucuaaaaaaaccuacaguugcugcuuaauuuuaaaaaaucgauugggcagggcgcagugacucgcuccuguaagcccagcaguuugggaggccgagguggguggaucacgaggucaggaguucgagaccagccuggccaacguagugaaccucccccccgucucuacuaaaaauacaaaaaauuagcugggcgugguggcaggcgccuguaaucccagcuacucgggaggcugaggcaggagaauugcuugaaccugggaggcggagguugcagugagccgagaucgcgccauugcacuccagcccacgagacagugcgaagcuccgucucaaaaaaaaaaaaaaaaaaucgauugaacuaauuuauugaucacagaucuuagggcugggucaagaaauccuguauaccaguuaaugucuucauacuauacuuaaggaagcaaguagggagguaaguaauccugggccuccgaguagaauuuagaucacacccacacccacccaccugagccccagaccaaaaugcccgcagagcguacccaucacuuuuguucaaaaucacuuucuucuuaaggacuuuccagaccacuccauuuaaaaucucaaccauccccccaucuuuggaaacucccuuuccucuguggcacgugcuuuccaacuaguggguauuaaaaagugauaaccuaaaaaguccagggacggcaggugaugcgggauuaaggacugagacucaaagcuuaauccuccuaauauaaaugaaaaagcucaauauucccauugcccuggugggaagacugcaaacugccagcuucaaacugaccucugagaaaggaaggcgggguuuagacgccagugucuucgggaaacccugcccgagagugcccgcgucuccaauuuacuaccaacccuuggugcccucccaucccaacgucgcaaauuuacuaccaacccuuggugccucccaucccaaccugcaccuguggcgacuuugagacuugccagcguugcacggagagaaggaaaacaaccgcaacaacagcccagguccacuggaaaggcacuuccggcaaguggauuc

SEQ ID NO: 191399 - RNA, 59327 nt, Homo sapiens
guguguaaggcggggucggacgggggaugggagggccgugcugcuggucgcuccuccuccuccacccgcucugccccuccuggaccuugugggccgggcagccauuuugggaagagcuuuguuaugguuguggacuagccgccucugccgggucgacaagcuggggacgcguccucagacgcagcgucuagucccuggccauagcuccgccgcugcccggugagugggaguuugggaaacggggcaguaggagauccuggagucguucuggcgcggggcuccgcccggugccuaaccaacgggcuguuaaaacuaguugaaagaagcucucacacaggugguuggguauagguccgacccgagaggggcgagcggagcccacgggucaagugguucggaugcggcacccccgccucccccgugcauggagcuuugcacgcgagcgucgccggggcuccgcgaaagcgcuccuacuuuaacuucggucgucgggucggaacgcucaccugcggcucuuuggcuccucuccaggcgauccggcuuggugcucguugagugacuuggcuuacggguuuuuuucuuuccuucuugaaaugagagcuaagggcuuuuguuuuccuucaaaggaaaaccuaaggaggaaaaaguguaagucaaauguuggauaucugaggggaaaaaaguuuuaacccccagcuuuccgguucucugugguagcgagguguuuucgcuuagauugagucuauccgauaucuaccaaccuccuuuccuuggaggggcagggaaagcuggucgauccugaaauguuuuaaguguuauuuuuuuucuguuguuuuaaaucuaguucuccccaacccgugaaauucgaaagacagucugaauccaaaauggcuguagcuuggggaagugcccugcccuucgauuacuuaaauacauuaacguuuaaagauuuuaguccuuuccccuguggggacauuaacugaaucuuuugauauuuugguuuuuugcaguuggugucucaccuuuaacucuccuuaugcugggugaaaacaaaggugaggcucacaaaguugacuauuccaaaaguuuacauaagaaugggugcggugcggugguguguguguuuaauaguugcuuauaguuuugaaauugugcuguggugucaauuuuaucugccaacuucgugcucugaaguuggcuugucauauuuguugaaauauuuuuaacauugacauuuauugcuuaccagaaaaauacaguuaauaauagugguucauguuuuaguuuaguaguaagucguguucuuguguaaaucuuauccaaaaguaaagugauugguagucacuccucauuagacuuauauuuguaauuuaguagacugcugaucuuuucuaaggucuuuuuuauccaauauuugaaaggaaauuagggugcuauuaaguuugagauauuuacuagaauaguguaagacauuuuaacaagugaaaacauacuuuagguauggaguaccugauugucgugcccuuuugaacaagagacugucuuuuguuugcuuuuuuuuuuuaaucgauagauccagaaguuuaaacaaaaagucauagauuggaaaccaaaaccaauaaauuucaauauuuggaaaggugcugaagccuguaucuauuuaaaagauaaaagagugaaaugcuaauugugaaugagaacuuugaaauuaauaguaaaauaaacucaucuuuccuagggagucaguuuucaauguaccuuuugacguuuuuucaaauacaaaaguugguuuuuguuaauaccccuaggauuuuuuguuguuguuguuaaauuauuuuggugguuuuacaggaaaaauauuuaaaguuuuuaauagaaauuacaagcuaguugcuuuguguuuugucacuguuaacuacuaaacuggagugagauauugauuuuuuggggggguacucagugguuuguacauguuaauauaaacauucaguugauucuggauggugucuuuaucagagcucuugauuugugguguggggggaacucuuggggaaaccuuuauuuugagcgaauucaauuuacuagauugcucaucaguggcuguuaaaaugcuuagcugaggaggacacauucaaccauuuaaauuuagaaugauaagaaaucuggugcacauuucugcuuguaauucauuuuuaauuuugaguuaaagauaagacacaaucgugaaucauacuucagaagauugcauaucuuuauuuuauggcuauaacucugaugugccagggacugacugcuguuuaaagugcuuuguauuuguuacuuacuuuuuuuuccuucuuuucuuuucuuuuucuuuuuuuuuuuuuuuuuuugagacggaguuucgcucuuguugcccaggcuggagugcgguggcuugauuucuguucacugcaaccuccgccuccuggguucaagcgauucaccugucucagccucccgaguagcugguauuacaggggcucaccacuacgccuggcuaauuuuuuguauuuuuaguagagauggguuucaccauguuggccaggcuggucuugaacuccugaccucaggugauccgccugccuuggccucccaaagugcugggauuauagucaugagccaccgcccccgcccggcuuguuguuuacuuuuauaaguauacugguuuauuuguuuuguuuuguuuuugauacggggucucacucugucacccagauuggagugcgguggcaugauuucagcucacugcagccuccaccucucaggcuuaagcaguccucccaccucaaccucccuaguagcugggacgacaggugcgugccaccgcacccagcuaauuuuuuuuuuuuuuuuuuuuuguauuuuauuagagaggagggggaggguucauccuauugccaagcuggucucgaacucagggacucaagcaauggucucgaacucagggacucaagcaaucugcucacuuuggccucccaaaguguugggauuacaggcgugagccacagcgccaggucuaaguagauacuguuuuauacccuauuuuguaguugaggaaaaggaguccagagauucauccagcugguagguaacagucuauauucaggccgggcgcgguggcucacgccuguaaucccagcacuuugggaggccgaggcgggcggaucacgaggucaggagauggagaccaucuuggcuaacacugugaaaccccgucucuacuaaaaauacaaaaaauuagcugggcguggugguaggcgccuguagugccagcuacucgggaggcugaggcuggagaauggcaugaauccggaaggcagagcuuccagugagccgagaucugcgcuccaaccuggggacagagcgagacucccucucaaaaaaaaaaaaaaaaaaaaaaaaaaaaggccuauauucaaauuuaggcaaucuaaguuguuguguuuaacuugacuguuauggucacugccuuuaaacaugaaaguaagacuguuggucuaaaagaugaaaggcagacaaaauuuuaaaggauuccaacuaaaaaaaaaaaaacuaaugggaaaggcaaauuuugguguauuuaugguuguucagauagaugaggggaaaaauaacauacccccuaaguggcuguaguugcuguugucuggaauuuaauacgugguugugcuguuagagaccuaauugcccaaguuacuucuaaaucagacuuaguguuuccuauuucccacugaaaucugccucaaacagccuauaaucaaacuuggaaaauaguucaguaagaggaacugaacuuuuguccacagguauacuuuaacugagguagauauauuucuaauguuauguaaauugaauuuuuauaggugauuucaaacgugcuaggcaaacauuuaaaagagccuauuauuuuucuuuacuaaggcaaauaauugaucuguuagcugaaucauuuuucagcuaaaacagcucaaucauuuauuuuuguuaagaaacuagggauugggaguaucuagaugaccauaaaacaaagaacuuuacgguuuaacagauaauacuuaauaguuggaggauaacauaaaaagcaauuacucuuaaaggaguugauuuuaacaaagucauuaaguucaccuuccuuuucuaagauaaaaaccacuuugccuuuuguuaaccagaggucagccuagagaaucaccagaaugaacaaaguuuuaguacccuuuucugagcaguaggucuauuuguguggaguaaguuuuuucccccagaaaaaucucauuugguuaaguuuagcuauacuuuaaauugagcuugcaaacucuguuucugcuuaaguuuaaaaguuugguauauaaaaaaguuauugucugaauuauugcuaucuuuaaaguuuauaaguauauagaaaaguugguuuuggggcuguuuaguuaauuugaaaguagagcuuuuccaguuuuugugcuguuaguaaauuuuucuacuuuuuaauucgucuuaccauguauggcaggaagggcaauaggaaccauuuauugugggcuucauaaacucagaugcuguaauagagucaauuauguaaucuuauuauuccuuacuauuuaaagaaguagauauuaacccuucuacaagagauauacagagguuccaagaaguuaaguaauuucgguaacauagagauggagauuugggccgcuuucugugauuccaaagcauaguuuccaccauagcacacagagaaauggcauaguaugguaaucagugguuggcuuuguagccagaccauuuggguucgaaucucagcuuugcugcuuacagcuuugugacuuugagugaauuauuuaaaugagacuguuugccuguuucuucaucuguuaaauaggaacaauaauaguaccuucuccuaggguuguuguaauaaauaauauuuguauaauucuuaaaauaaugucugacgguaagaacuucaugauuauuagagaaguugucuuuaaugaacauccuuuaacacaccaauccagugaaauucagugaaaucugcacagaugaguugcacacggagggguguuuuucuuucuuagguacuacuuuucuguugaccuuuguaauuuauuugaaucaggaucuaggucccacaaacugcaauuggcugccauuuuaaaugccuuaauuugcauauuucuccucaguuuuuuuccuuguacuuuguugaagaaaccaggucauuuguccugcaguuucccacauucuagauuuucuugauuccuuguaaauugguaguuggauauagaggcuuagauugagauuugauuuggagauagagaagacugagaagacuaaauuuguuaggugauucuguguauuuggggauuuuuauuuucugguuuguucagugguucucaucuguaucauuuucuugcaauuucucuguugggcaacauagaauaacuuuaugguuuauuuacucucguuugagaugcuaaguaaaguggaguguuugguuugcuuuggugcccaauucaguauuaacuguuccagguaguuucuuuccugccuuuuuuuuuuccuacuuguauauuuauucuguuauaaaauugagccaaguaucauggguuuucaguguucuuguuuccugguuuugguuacuaaugaauaguugucucagcauauucaaucugaaaauuucucaaaacugaauuuuuuucccuauuuucuacccuccaacuauuaggcauuuuauuauuugcacuuaugguauacucacuguaggcuaggcacuauucuuuuuucuuuuugcagggaacaacauccaggcauuacucuuaacacuuuauauacauucacucauuuaaucaacaauucaagagucuccaaauuagguagguauuugggacaaaaaggggugaaauaacuuauucaaagucacacagcuagugugugacagagccaucuagguccagaauuugcuauucuaacuuaaaaauuaauauuugcauuggaagugaagcucaucuaagaagagauuuuuagagaugcuuuuaaaugauucuuuuuaaaaaaaaaaaguaugucucagcuggucaugguggcucacaacuguaaugccagcacuuugggaggcugaggcaggcggaucacaugaggccaggaguuuaagaccaggcuggucaacauggugaaacccugucucuacuaaaaauacaaaaauuagccgggcaugguggugaaugucuguaaucccagcugcucuggaggcugaggcacuagaaucacuggaaccugggagguggugguugcagugagccaagacugugccauugaacuccagccuaggugacacagcgagacucugucucaagaaaaaaaaaaaaaaaaaagcgugucucaaucuguuagucacuacuauuaaaucacucauuuguuuaaaaaaacuauaguuuugaaaauguuacaaauagccuguuuacuuguaaucauagggaaauagagccuuuuggugcugcugaaacugauaaaaguuuauuuauuuuguagagacagggucuugcucuguugcucagauuggagugcaguggcauguucauagcucacugcagcuuugaccuccuaggcucaagugauccucccaccucagcuucauccugggcccccaccccccgcccugcugggaauacaagugugugccagcaugccuggcuaauuuuuuuuuuuuuuuuuuuuuguauagauaagagucucucacuguuguccaggcugcucuugaacuucuggacucaagcaauuccucccaucuuuaccuccccacaugaugggauuacaggcaugagccacugugccuugccuaaaauuacuuuuuaggaaauuuuuuuggaacaaugaaguagaagaaggcacaguaauucaaguugauuccaaauggcuagacuggcaggauuccuguguuggacauuuuacuaauugggcuuuaaaaugguucuuuguuguuucuuuugucuguuuaccauuuuagcccccuuccaguauugcuuuuuugugaaucuuauugggagaggaugcuggaaagguugggugcacacauacacauaccauauagauaaacuuucugugcuggaccccuggcagcuagagcugggucauguuacccaaacugugccagucagaugcccuuuacuuuggggacuugcaccagaagugagagaugcaaagaugcaaggaccguuuggaguucauuccaguggcuguuggugguggcauuacuagcuggagcaguuuccuaagcaggcucuuccuguggcaugaccuuggcagggguuuugaaugcuuagcuuccuuugguuuuucguguuugccaagucaagggagccucugcuucguccucugaauucccaggguucuucugauaaauuccuuuuuaaacuugucagacaauuuucccuuuuaucugccccaauucucaaaagugauaguucucaaccuuuuaaaauuuaucugggguaaggccuggacaucagugguuuauuaaaacucuccgugucauucuuucuuuuuauuauuacagaagcaauguaaggguaauguagaauauuagacuauauagauaugcaaaaauaaagccuuggcauucccaucacacaggaguuacuacuguucacaacuccgugcauuuuuuuccagauuguagucuaagugcauauguuuagguuucuauuuuuauuuuacuaaaugagaucaacuugcuuuuuuuaguuggugauacccacuuuccaugugaguaaaugaucauuucuucuaauacccaggugcuauucaaauuucuccagcugauccaaaaaauguuuauuacagcuagcuauccaagccauuaucugauucaggaccuuguugcaaauguuuacuuuaucuauaucuuuuuagugcaguauagucuuuauuuuucagugacacugauuuugagacugugucacuuaaccuggagugguuugguaugauugcauccuuaugguauuauuuagcuuguucuuuuuuuaauuccuguauuuuucucuaaaguuuauagcugacagauugauggauucaccuuuaaacauuguugacuaaaauacagcauagcaauuccucauuuugcauuguaucacaaaagacauuguaaugcuaagauugguucuuuauuaagguaguccuaucuauauauuaaacaaucuuuccccuuagaacaagaaacuaauuugcaugguguuaccuugguggcgaaggauuucccagucccguaucaaucguuggucuuaauuuuugggagaauagcuucauugagcuguaauuuauauaacaaaauacacauauuuaaaguguucgauuuagugguuuuuaguauauucgcauuuguacaaccauugcuacuaauuguagaacauuuucaucaucccaaaauaaacuguaaccauuaccagucauucuucauuccucucuagcucuagacgaccacuaaucuacuuucucucucucuggauuugccuauucuggauguuucauauaaguauaccauguggucuuuugugucuggcuucuuucauguagcauaauggaugaagguucauccauguuguaggauguuaucagaauuucuuguggucaugggugauuaggauuaaugggucauagagguuuuacaacuuguuugccaguuuccaaagugguugugugccaguguucacucuaaucagcaauauaugagaauucuuuguuugugccucaucuucauuaacacuuuguagugucagaauuucuuuugccaguuugauagguguaaaauagucucaugauuugauucagguuuuaagaguaugaauuagugaauaauucgagauaauguuuuauauugugcuuuauauuaugucauagcacuucacaugauuucucucaugcaccucuuauggguacagaaaucccauuguugucguugaauuugugauagaaauacaauuuuuguuuguuuauauuuuuuucuuuuccuagccacuacagggauuuuguuuauuagacuccauaauagacuuuacauauccauguuaaucaccauaguauuagguacuuucucuuuguuuuugcuguugugaaacagggucucacacuguagcacaggcuggaguguaguggcaugaucaucacagcucacuguagucuugacuucccaggcucccaccccagccuuccaaguaguugggacuacaacaccacuaugccuggcuaaaauucuuuuuuuuuuuuuuuuuuuccugagacgaaucuuccucugucacccaggcuggagugcaguggcgcaaucucagcucacucacugcaaccuccgccuccuagguucaagcaguucuccugccuuagucucccgaguagcugggacuacaggcaugcgccaccaugcguggcuaauuuuuguauuuuuaguagagaugggguuucaccacauuggccaagcuggucucaaacuccugaccugaagugauccaccugccucagccucccaaagugcugggauuacaggcgugagccacugcacuggcccuuuuuuuuuuagcuuuguuuuguuuuuuuuugguagagaucuuaccauguggcucagguugauggcaaacuccugggcucaagugauccucccucuucggccucccaaaguauugggauuacaggcaugagccaccguuccuggcgaaguacuuuguuguuguuguugcuguuuugagacagggucucucugugucacccaggcuggagugcaguggcacaaucauggcucacugcagcuuagaccuccuggauucaagggauccucccacuucagcuucccaaguagcugggacuacaggcaugugccaccaugccuaauuuuuuuuuuuuuuuuuuuuuuugagacagaguuucgcucuuguugcccaggcuggaaugcaguggugcagucucggcucacugcaaccucugccucccgaguucaagcuauucuccugccucagccucccgagcagcugggauuacaggugccugccaccaagcccggcuaauuuuuuguauuuuuaguagagaaaggguuucaccauguuagccaggauggucuugaucuccugaccucaggugauccucccaccucggccucccaaagcuggcuaauuuuuuuguguuuuuuuguagagauggggucuugcccuguuucccagguuugucuuaaacuccugggcucaagcagucugcucacccuggccuccaaaagugcuggaauuacaggcaugagccacugugcucagccccaaguauuuucuuaauagacagaaaugcuguaugggaaaaaaaaucuuaagguaucuuauguccccuuuugguucauugaaagacuugcucaaauuucauauucuucagaaaaucuuaaauaggaauuuuucucuucuggagauaaaauaaguaguacuaaaguagaaaauggcuuugggcucuuuucuguuaagaauuagaaauaaaagaagcaaggcacuaauaacccuugaguucuccuuguugaggacuuaggagggaaacuauguacagauagaaaaugaguauauagacuacuguaagguuauacaguccuuugaaggaagucccuuaaaccugugugguuuucaaaucaugagauuuugaaaagaaauauuaggguuagugaauauuuaaagauaaacauacuauagucuuaggaucugcaguuuaaggaauaaggaaugcucaaggauagcucuuaagaacaguaagaaggcuggguacaguggcucaugccuguaauccuagcacuuugggaggccgaggcugguggauugcuugacuccaggaguuugagaccagccugggcaacauggccaagacccugucucuacaaaaauuacaaaauauagccaggcauggugauaggugccuguaguccuugcuacuugggaagcugagcugggaggaucacucgagccugggaggucaacuguaaugagccguaaucgugccacugcacuccagccuaggcaacagagugagacccugucucaaaaaagaacaguuaagaugaaggggauacuaauuuauagaauugucaacaccuuuaaaaaauuaccauuuauugggcacccacuaaauagaccccgucuauaaaaagauagagauaaucaccuuugcuauuaaucccuaccaagugugucccauuuguaagggagauaaauacauaaaaagguaaguguaaugcauuguaaugggcccaugaagcaagaauuuuuuauuuuuuuauuuuuauuuauuuauuuuuauuuuuuuugagacagagucucgcucuguugccaggcuggagugcaguggcucgaucucggcucacugcaaccuccgccuccuggguucaagcgauucuccugccucagccucccaaguagcugggacuacaggcaugcaccuccacgcccagcuaauuuuuguauuuuuaguagagacgggauuucaccauguuagccagaauggucuugaucucuugaccuugugaucugcccaccucggccucccaaugaagcaagaguuuaagucacucacuuggagaccugaagucuugaaaauugaugagauaaugaagagcacagaaaaacaagaaaaggacuacauggaagcauuuaaagaaccauuacauugacaagagaaaggaagaguccgaaaaaaguacagcuacuccuugacuuacaucuggauaaacccauuuguaauuugaaaauaauguuaaguugaaaaugcacuuaauaugccuaaccuacgaagcaucauagcuuagccuagccuaccuuacacguuuucagaaugcuuacaugagcuugcuguugggcagaaucaucuggcaacacauacccuguacaguaucagguguuuacuguugucuaacccuugugacugacugggagcuauggcuugcuggcacugcccagcaucacacgaaaauauuguacugcguauugcuagccugggcaaagaucacaauucaaaguaugguuucuguugaguugcuuucucaccucacaauauuguaaaguugaacaaucuuaaauugaacuaucguccuaaguuagggaccaucuguaaucacaggguagggagaagaucaggauauguuaauacagugguugucacucauugcugcucucugacaaagacuucagcccuuugugaauauuaucaauguaagauuguuaacuuuuuuuuaaggugaguuguuccuuuuuccaagauuugucuuuuaugacauacugucuuuaaugaaauugugauauuaaaauuuuuaaucuucuacuuauccaaauaaaauaggcaauccugugucaguccuuaaaacaucuuuugaauuuuuuuagcuugauguaauccagguuugagaacugcuggucuaaugauguaaugucauggaaaucaggggauuuaagauggguuuugcuaaggaacauguaaacaguguaagccauugaaguuggggauucacagguuauugacuuuuucuuuuuuuugacaauuucacucuuucacacaggcuggagugcaauggcacaaucucggcucacugcagccucccgcucccguguucaagagauucucgugauuuagccucuugaguagcuggaauuacaagccugggccaccgugccuggcuuucauugacuuuugagaguauauugauuaggguucuuuguuguagaaaacaauuuuuuuuguuuguuuguuugagacggagucuugcucuguugccuggccuggagugcaguggcgugaucuuggcucagugcaaccucugucucccggauucaagcaauucugccucaaccucccgacuagcugggauuacaggcaugugccauuacgccuggcuaauuuuuuuguauuuuuaguagagaugggguuucaccauauuggucagguuggucuugaacuccugaccuugugauccgccugcauuggccucccaaagugcugggauuacaggcgugagccaccgcgcccagccgaaaacaaauauuuaaaagcaugguuguguaucuuucaaccacagucagcuucaugggugacaagcaaaguaagcaagaacugggaucuuaacuuagauuggcauuuggggaauuggguaugggucagugagaagagcaagagacuucagggagucaaaagucaugguagcuuacaagugugggcccuuacucugcugggaagcucugcuguaucucuguaguucauucuucaguuucacgcuuuaauucuucucacaccccucaacuccucugcaccuacccauacuuuuagcugaaggucuugcugucuacuuaguugagaagauagaagcaaucaggguagaccuuccaagcucucauugcauuaguacccacguguucugcuuucccaccuauguauucaugagccugcugaaggccagucuucacugguacaucccaucucaccccucugaacugcugaaggauauuucagcaguuuucuguaucagcugcaucguuuucuuuuucuacuggguuauuccuaucagugcaguaaaaaacuuauuuugaccacacauccccuuuuagccuacaugcuccuuuucucuguugugcagcaacacuucucaaaagaguugucuauacuuuuagucuccaguuccuucccucuugaacucacuggaaucaggcuuucaccaccuccccuauccaacaucaucacugacacuuccaugugaauccagugaugaguucucagcuuuuuauccuauuuaauaacauuugaaaauggucacucuaccuucuugaaacauguuucugcuuagcuucuggguccccacacuuugaugguuuuuuuccucagucuccccaaucuuuaaagcuguaugucaagguuccaucucuuuuuacguucacuuuguugaugaucucaucuggguccauggauuuaaauaaaauuggucuacagucuguauuucugucaugaacugcagacucuuauccagcuaucuacuuaacaucuccacuucgaugucugguaggcaccuaaaaguuaacauguguauaaaaagaguucuucugucucucauuauuuguggaaucuauagacaaauuauuagaauuaaugagaguuuagcaagguugcuggauauaauuuaugccagcaguaaacagccauuuaaaggaaauaaugcaauagcaucaaaaaauauauauaaagguaccuaagaauaaauccuuuuuuuuuuuuuuuugucgccugggcuggaaugcaguggcacaaucucagcucacugcaaccuccgccucccggauucaagugauucuccugccucagccucccgaguaguugggacuacaagcgccuggccaccaugcccagcuaauuuuuuuauuuuuaguagagacaugguuucauaguguuggccaggcuggucucgagcuccugaccucgugauuugccugccuuggccucccaaagugcugggauuacaggcaugagccaccgcacccagccugaauaaaucuuuuuaaaaagguauuauugcaucuuuauggagaaaaguuuagaacuuuauuugaugauguuaaagaagacuuaaauaagaaguugaccgugcucaugauuuggaagauuuauuaugaagaugucaguucucccauuuugaucuagauuuauugccauuccaagcaaugucauagcaauauuuucccccuuaaauuugacaguuguuuuuaaaauuauuuauuuauuuauuuauuuauuauuauuagagacagagucucgcucugucacccaggccuggagugcagugaugccaucucugcucacugcggccucagcuucccagguucaagcaauucucccaccucagccuccugaguaguugggacuacaggugcaagccaccacaugcagcugauuuuuguauuuucuuuguuguagagaugggguuucaccaugaugcugagguugauuucaaacuccugagcucaagcaauucucccaccucagccucccaaagugcuggaauuacaggcauguaccaccgugccuggccuguuuuaaaacuaauauuaaagagucagagaggcugggcaugguggcucaagccuguaaucccagcauuuugggaggcccagguggaucaguugaggccaggaguucaagaccagcuuggccaacauggugaaaccccgugucuacuaaaaauacaaaaauuagcugggcaugguggcacaugccuguaaucccagcuacuugagaaggugaggcacgagauuugcuugaaccugggaggcagagguugcagugagcugagaucacaccacuguacuccagccuaggugauggagugagacugucucaaaaaaaaaaaaaaaaaaaagccagagagccaagaauagcuaaggcauuuuauagguauauuaugaggggagauggccuugcucuaauacauaucagaauauuauuguaaagguaugauaguuaagacauaugguaguccgggcgcgguggcucacgccuguaaucccagcacuuugggaggcugaggcgggcggaucacuugaggucaggaguucgagacaagccuggcuaacacagugaaaccccgucucuagugaaaauacaaaaaauuagcugggugugguggcgggcgccuguagucccagcuacucgggaggcugaggcaggagaauggcgugaaccugggaggcggagcuugcagugagccgagaucacaccacugcacuccagccugggugacagagugagacuccaucucacaaaaaaaaaaaaaaaaaaaaagacauaugguaguaguguagaaauauguaaauaagccaauggaacauaaauuuggaagcaguugcauacauauauagaaacaauuuaugauagagcuggcuguauaaaucaguggaaaaagaauacuucugggacaguuuuuuuuucauauggaaaagaaugaaauuggaccugggucucauaccguauacaaaucauuuccaacugauuguaaaugugaaagacaaaacuuaaaacuaagaagucaauauagguaaauuguuuggaccuuggagaagaacuguuacaaacaagacacagaaaugugaaucauaaaggaaaugaccagcagcuuugauugcaucuaaauuaagaacgugugcucaucaagacaugggaaagaaaaucaaaagauaacccaugaaguggaaaaagguauuugcaacucauauaaucauaggauucguaucugauuuauucucuugcauuaauaagaucaacaaccaaaagaagaaugguaaaaagaauagguauccuauaaaaagggaaguacaaagaccugauaaauagauuaaaagaccacacaguaggugaucguguuaaaccuaccagcagagcaaagaauaaccuccagucuggccauauguaguuugguugaagauguaaagcagauggaacgcuuaaaaugcugcugcugauggugaaaacugguuacacguuguucagaaguauuaugacauuaccuugugaaguugaagauguacugcccuacuagucaccaaagcauuuauuaauacacucauucaggaaauauuuaucuacuauguuccagauaguguucugugugcuugggaucagugggagacagauaaagauagauugauaacuagugauacagggaaauacuaaaaaggaguucaguuuugugccaacuuauguuuuucauuuuuauggauauaaguucuaagaauguuacauacuguuugaucagugccacucaguucuuugaauccuuguauuuacuaaaagucacuucacaauccaucaaaaauuauuuuuaaugaucccuuagcugagaacuacauucuuuuucuauuuuguggaauacacagauuguaaacuauccaauuaguuuaugaaaucauguuacuuagucauuuucucaauuuuggcaggggguuggagggggggucauacccaaaagccuuuaccccgaagaagacuuucaaaugacuaaacuaugucuguuauucuuuuacuuaaagucacuuuguuuauggagccaaaauuaaacaaggcuggucaaaagucagaugcugcauacuuuuagauuuucccauagagcuauuaaaucccugggcuggccacaguggcucacaccuacaauucuagcacuuugggaggcugaggcagaagggccccuugaggccaggaguuugacaccaaccugagcaacauagugagaccuccaucucuagcaccacuguugguggcaugcgccuauugucucagcuacuugggaggcuaaagcaagaggauugcuuaaacucaggagcuuaaagcuauggugaacuaugauugugccaauguacucuagucugggcaacagagugagacccugucuccaaaaaaagaaagaauaaucucuguauuugagccaaacuuaaaugguguuacagagaggacaaugcuuuuuaauuguuuuauauaguauagauagaauggaaacuauuucaugguugaagaugugcucaaaauuaugcuuuugacagaauuaaaaugguguaucaaugacagauggagaauguauugaaauuaagugaagcuuuuaauuuuuauuuuuuuagacacagucucacugucacccagacuggagcgcaguaguacagucauagccuacugcaaccuugaauuccugggcucaaggugaggugauugucucaccucagccucccaaguaggcgcccaccaccaugccuggcuaaguuuuaaauuuuuuguagauacagggucucccuauuuugccuaggcuggugaaguuuuucaaguuuagggcauuacaucggccauuaacauccucaagaacauuuguucagccuaauauguagaugcagguguucuguuuugguuuuuuuguuuuguuuuuguuuuugagacagagucuugcucuguugcccaggcuggagugcaguggugugaucucggcucacugcaaccucugccacuucccggguucaagcaguucuugugccucaacagcccaacuagcuaggauuacaggugugugccaucaugcccggcuaauucuuguauuuuuaguagagaugagguuucaccauguuggccaggauggccuugaaccccugaccucaaguuauccgccugccucagccucccagagugcugagaugacaggcgugagccacugcaccuggcuagguguucuguuuuuaagugugcaauuuaauuuauuagguacuuaaaaaauuucauaaauauuccuacagaauuuugaauacuauaaauauauucauucuuauuucagcgcauaucuuuucuaaacugucauucaucaaccauuucucugcaaacuuauuuaugccuaucauauacuaguuagauuaacuuaaugggaauauuuugaaaauagagggguaccagucagagcugugggagaaagguaauuuucuguggguugaggaauaaaugggugagugaggaaauaaagacaauaaggguacacuauucuguauagauuuuuguuaagacuagagggcaggcguggcucacaccuguaaucccagcacucuuggaggccaaggcaaguggaucacuugaggccaggaguuggagaccagccuggccaacauggugaaacuccgucucuacuaaaaauacaaaauacaggucacacaugccuguaaucucagcuguucgggaggcugaggcacaagaauuguuugaacccaggagguggggguugcagugagccaagauugagccauuguacuccagccugggcgacaaugagacucugucucaaagaacuggagaguaaagcacauaaaggauauaccuggagcaagauacaggcucuaggaaggggguuuguuuuaauuuggagaauuggauacaguuuuuuguuaaguggacucaguguaaauagaaguugaaguuaccagaaggaauaaauugaugaugcuacuggacucuggagaaaaugagugguugaagccaagagcacugguaguguuguaucuagguaaaaggagccugaaguagagguaauugagauaagacucuuggccggggaggugcucuccuagcaguauaaacuuaauuauaaaauauaaaauuaggucauguugugaaguaccgaauagugcgccugacauaugaggugcccgauaaguuggagguuuugaagagauaaaauauuugacagauguuuaugaaugaaugguuggaucaaguauucagauacaaggaguuuguagagagggagcaaaaguacuuauguaaucugaaaaagaaugggugauguagggcaguguuuguauuuaauauuaacauugacugcuuuauuauaauuuuuuuaguuaugggaaaauacaagauuuaccaucauaagcaauuaaaaaagugugcaauuccauggcaugaaguacauucucagcguugugcaaccaucaccacuauguaguuccagaaccuuuucuuaccccaaacuaaauuuucaucuauauuaagcagucacaccccauucccuccucuucccagucccugguaaucacugaucuguuuuuagcucugugagacuggauguuucauauaaguggaauaauacaacuuacaguuuuugugucugccuucuuucauuuaacguaauauuuucaugguucauccauguuguagcuuauaucaguacuucauuuccuuuuuauagcugaauaauagccuguggugugaauauacaguauuuuguucauucaucuguugauagacauuucaguuguuucugcuuuguagcuauugugaauaaggcugcugugaacguucauguacaaguguuguguggacauguuuuuauuucucuuggauauauaccuagaaguagaauuauuaggucauauggugccucaguguuuaaucaguuauucacaguagcugcaccauuuuacauuucuaccagcaauacauuagguuucuaauuucucugcauccuugcuuuauuauaauucauaaaaauuuauuaaacuuuugaauccuuaccauaugcaugguaccaugcuagauacaugcuguguguguccuggaagaagugaguauuaguggcuuaauaggcacaauuaaaguacuuugaggccgagcgcgguggcucacaccuguaaucccagcacuuugggaggccgaggcgggcggaucaccugaggucaggaguucaagacuaaccugaccaauauggugaaaccccgucucuacuaaaaauacaaaaauuagccgggugugguggugggcgccuguagucccagcuacuugggaggcugagacaggagaauugcuugauucuccugggggauggagguugcagugggugccacugggggauggagguugcagugggugccacugcacuccagccugggugacagaagacuccgucuaaaaaaaaaaaguguuugaagauuucauuuucagaggcagggauuacuuccagacagaguauuaaaggagacuuuuuagacugguuuuugaggggugggggaaaggcuuauuucuugucucuuagacugaggaauuuaaauccugucguauuguuggugggaaaucagaacuuuuugagcaggguagugauauaauuacaaccuaagucuaggaacagagaguggcaaccaguaggagaggcugaggcagaugguggaaagagacuaguagugccuaaaaaauuaguuuuuuaaguuagagaguaauuugaccuugaagagucgaaaguaacagguggaaaagaaguaaugaaauaaacaagacuuggaaacuuuccuuuuuuuuuuuuuuuuuuuuuuuuaagacggcgucucgcucuguugcccaggcuggagugcagugguggcgugaucuuggcucacugcaaccuccgccucccgguuucaagcgauucuccugccucagccuucugaguagcugggauuacaggcaugcaccaccacacccggcuaguuuuuguauuuuuagcagagacaggguuucaccauguuggucgggcuggucucgaacuugugauccgccugccucagacucucaaagugcugggauuacaagugugagccaccgcgcuuggccaacuuuuccaucuuuauguucuccuuggauuucaccuauucccaaacuuuaaauguugucuaccaaauacugacaauuaugaaaauucuaccaguagaacacaccuccccuuugagcuccagagcacaugcuugacaucucauauuagaaagaaucuugauuuccccuccagucuagucuuucauguuuuguuuuucuuugugagagucucccucagccugcaauggcgugaucucggcucacuucaaccucccgaguucaagcaauucuccugccucagccucccaaguagcugguauuacaggugccagccacgacacccagcgaauuuuuguauuuauaguagagacggggguuucaccauauuggccaggcuggucucgaacuccugauuucaggugauccaacccccuuggccucccaaagugcuaggauuacaggugugagccaccacgcccggccaucuuucaucuuuuuuaacaguucuaugaggccaggugcaguggcucacaccuuuaaucccagcacuuugggaggcccaggcgguggaucauuucaagucaggaguucaagaccaaccuggcuaacauggcgaaacucuaucucugcuaaaaauacaaaaauuaaccgggugugguggugggugccugcaaucccagcugcuugagaggcugaggcaugagaauugcuugaacccgggaggaggcagagguugcagugaucugaggucaugccacugcacuccagccagggucacgaaguaagaccucaucucaaaaacaaaacaaaacaaaacaaaaaaacugugagaugcuugagcucaggcauuugagaccagccuaggcaacauagugaaaccccaucucuauggaauaauuuuauuuuauuuuauuuuauuuuauuugaggcagagucuugcucugucacccaagcuggagugcaguggcccaucuccgcucacggcaagcuccaccucccggguucacgccauucuccugccucagccuccguaguagcuggaacuacaugcgcccaccaccacgcccagcuaauuuuuuguauuuuuaguagagucgggguuucaccguguuagccaggauggucucaaucuccugaccucgugagccaccacgcccggccuuuuuuuugagacggagucucacucuguugcccaggcuggagugcaguggcaacgaucucgguucacugcaagcuucaccucccggguucccgccauucuccugacucagccucccgaguagcugguacuacaggcgcuugccaccaugcccagcuaauuuuuuguauuuuuaguagagacggaguuuuaccauggucucgauuuccugaccucgugauccgcccaccucggccucccaaagugcugggauuacaggcgugagccaccgcgccuggcccaagaaauuuuuuuuuaauuagcucagcaugguggcuuucaccugcagucccagcuacucaggacccugcucuauugucucagaaaaaaaaaaaguucuaagagaauuuuaaaugauguguuuuuucuucucagaauuuuuuaguaauaagcagaagucucccaguuagccguucuguaaaaauagccacagcccuaaaagacaucacuaaagaucuuuaauuuaaaauuuucagagcaaguaaguucguuacaaaaacuuuugacuaauagagaagauaaaacaaaaugcccauaauuccaccauucuaauaaaaccauuauuaacauuuugggauuuuuccuuuuagucuuuuacuuccagaacagaaaucucuuuuaucugucuucuucauuuuuuauuuguucuguuugauuaaguguccccacuuauggcgcaucuccucucaaccacauacucugcacaugcauguguaggucacacucuuuacacuucagauaucccagcuucuugagggugaugggugaguaauuguuaguaggacccguaauaguagcaaaguauugcuaguuaguauuucuucuacagucacugccuaaguugggacucugcuauagaaacuuuggauucgguauguaaaacacugaaaaggugguggugugugucaguuggaaaaccggaagguaccuaguggugauugaaaagagggaauuguuuauguugaaaauugaggcauuuuccuuuguguccaacagcuuuauacccuaacagaugauuuaucucucugucuugaacuucagguucucugugguuuaaacuagaauucguaagauaaaaaguacgcaccagacaguuauuuauaucuuuuccauauggaugcuugacuuauuuuuccagaauaacuucacuacagggacaguuucauuuaucuauuacugagaguuacagguguaggcuuauauaaaaacaauuuugggguuuuuugcuuuuuuuuuuuuuugagacagagucuggcucugucacccaggcuggagugcauuggugggaucucggcucacuguaaccuccgccucccggauucaaguuauucucuugccucagccuccugaguagcuggaacuaugggcaugcaccaccaugccuggcuaauuuucguauucuuaguagugacgggguuucaccauguuggccaggcuggucuugaacucuugaccuccauuaauccacugucucggucucccaaagugcugggauuauaggcgugagccaccgcacccggccuaauauucuuuuaaguguuagaaguuuauaaaaagagcaauaagugaauagucaucuuguacccaucgcucaacuugagaaauaaggcauuacagauacaguugaaacucuuuggggccucucuuuuauugcccuucauuuccccagagauacuuacuauccugaauuugauauuucuuauuccuaugaacuuauucccaugaacaauagugcaaggcugcugaauuggauauaugagaaauaucuuccaaacuaagauuuaccaguauagaccagaauugcccauagaugcaaaaauucuuuucuaucaaaaaauuauuuccacagccaggcacaguggcugacaccuguaaucucagcacuuugagaggccaaagcaggaggauugcuugaaccuaggaguucaagaccagccugggcaacacagugagauccugugucuacaaaaaaauguuuuuuaauuagaugggcaugauggugcauaucuguagucccaugguuuuuguuacucgggaagcugaggucucugagaggauugcuuaagccugggaguucaaggaugcagcgagcuacgaucaagucacugcacuccagccuaggcaauagggugagacccuguuucuaauuuguauccccugaaagaauguugagaaauuaccgaagaaauuuuuguuucacuccgugccuaacaaguuagauuauaaaaguuuuaaaucucugaauugagagccagguaucuaaaaauauauaccauauaaauauauaaaauauacugugacagauaucucaaggauccuagcuguggcuaguacuaaacaaauagguaguuggugauauaccagcaagcuauaugguucuuugaccacucauggcaaccugucccauuuaugagagaaaaaucuauaucugaaagaccuauuauuuugcauuucugaauaccuuagauagcugauuggaaaauuuggccucucaaaguguugagauuacaugugcuuuuauauaaaaaagcaaacuccaggccaggcauggugggucacucacguaaucccagcacuuugggaggccaaggugggcggaucacaaagucgaguucgagaccagccuggacaacauagugaaaccccaugucuacuaaagauacaaaaaauuagcugggcaugguagugcacaccuguaaucccagcuacucaggaggcugaggcaggagaaucgcuugaacccgggagguggagguugcagugagcugagauggcgacauugcacuccagcuugggcaacaagagcgaaacuccaucuccaaaaaaaaaaaaaagagcaaacucuguuuagaugacuuuucucaaauccuuaaaaaagauuuauauccaagucaucuuguugguauagguggugacauacaucuguaguaucuaaauuggacuuaagaguuuugacucucaggaccuugauuucauuauuuaacugugucucauuuuagcagauauauguauauaugauagugauuuugccuucugugauuuuauguuuuguuuuuucauuuacagagugauagauucguguggccuuucaaaugauugugaagugguggaaauggauccaaaauaauaagugacuucucuaccaaagcauagaagauucuucauaucuccuuccaguggcucaauuuagauuuugggaaggagcagaacaagugaaacacagaaaacugaagagaagaaauccucauuuuggaccuauauuucuccuugacuauuucuuaauauccauccuacccaucguucuaauguuuuaacuuugcucugaauuuauaaauaguaaaggccaaagacauagaauauacauuuaguagcuuuauaccaagaaauuugccuugaaagcugcuguucguggagggaaaaguguagcaaauuccugucuauuuuuauuuuuuauuuuuuuuuaacaaagacaagauuuaugucccuagauuuugaagguuaaggcaaauauaaauacauaucugcacacuauuuuuuagcaguugcaugaguaagaguaaugagauuuguauuuuaaggacuuugucauguggauguuuuggaguugacugcucagaucuuuuauagggcuuuaauauuuuugaucuauuaccuugaugacauuauuuguccacacuugagcccaucugucuuucuagcuaugaccuuguuaugaacaguauuugcacucggugcaaauauccaugucuuaccuaauuaagcaacaucauagugccauaacucaaggaaguugaaugaggugaacauagauacagcucuuuccccuucccccccuuuuuaaauguaacaaauacuuuuuauguuccccuuccccccuuccccuuuuccccuuuccccuuuuggaaacgugucaggaaccaaauaguuuaagaugagcaguugaggggacugagagagugaucgacacagaaccuggcuucuucgugcuucaucauaagucgugcugccggccagguuacuuaagcacccuuuuaacaaggaaaccuugugggagauccagcuggccgacucgaguucagaaacaggaccacagagguuacacucugggguaaauauucuccauaugucuaacuuggaaagaagacucuauguauaugcaucaugaaaaauaccgacugcuuucugauguaauuaauuuuggagaauaucaguggggugguuugaagacaccaacagaucucaggaaaacugaugcuaguugguauuugaagaaauuaaugugaacuaaauauaaaagcucuugagagguuguaucguccuucucuaggaagaucuuuuuuucccccaucuugaggcagggucucacucugucacccaggcuggagugcaguggugcaaucucagcucacugcagccucaaccuucccagcucaggugauucucccaccuuagccuccagaguagcugggaccacagacgugugccaccacaccuggcuccuuuauuauuauuuuuguacagaugagguuuugccauguugcccagacuggucucgaacugcugggcucaagcgauccaccucggccucccaaggugcugggauuacaggugugagccaccgugcccagccaagaagaucuuuucuacugcuuuugcuagaaguuaccugaguacuugaagcagauuaaucucuuuucauaagugucugugguuuuaaauagauguuuaauucuucauguucuuugauguaacaaucaagaauucauuagcuuccuucauaaaaccuuccagauucacugggcgcagugacucacaccuguaaucccaacacuuugcgaggcugaagcaggaugaucuuuugaggccaggaguucaagaucagccugggcaacauagcaagacccuuccucuccaaaaaauaaaucuuccaggcucauguuacaguuuucuuuuguuuagaacuuuuguuuuaacaaaaauugcuuuuauuuagaacuucucugaguuauaaggcuugguaaguaaucuguagacaggcucagagggcaggucuuucuguaaagaggaaucuuagaauaauuacagauuccuuuacacauugguaucagauucuuguaaacauaagugauuugaauuguuuuguuuucagauccuggccaugagguuggaugccucaccuuacugaaaggagacacuggaccuaaauggcgcagcaugauuuuguuccugcuuggcuaaauuucucaacaccacagucagcuaagguacuguucuccauuccuguaguaacuucucaaauaugagaggguuugggggugguuuugguuguuuuuugguuucauuuuguuuugagacagggucucccucugucacccaggaugaagugcgguagugugaucacagcuuacugcagcuuuggccuccugggcucaggcaguccuccugacucagcucccagaguagcugggccuacaggcuguguaccaccacgcccugcuaauuuuuguuuuuguuguuguuguuuuauagagauggaauuucaccauguugcccaggcugguuuucaacuccuaagcucaagugauccgccuaccuggacuucccaaagugcugggauuacaggcgugagccacugcacucagcccagucuugauguuuuuuaauauauucaaccucgugugaggauuucaaaaacauuuucauagacuuaauagcuuucuguuagaaggauguaaguaauuaggcaguccacaugaaugucuaccuuauuacugccaaguaucucacuuuuuuauguuucuuuuuuucuuuuuuuaaguaucucacuuuuuucauuauauccuaaggcuuuucucauuacaugacacaguuaaguguuguauuagcugcagcacacuuuggagauuaaacguacuugcuaaccuauuguggaggucaaaggggcagaaguaaaaggggaauggcacuuggguaaacagaccuuuggagugaacacacauuuguuuauggcgauagaugaagaggaggaaaagguagaggcagugauuguucaacuacuacauggaucucagauuaaauccuagaaacuguuuuagaggcauuaaccuacuuaauaguuucaggggggauguguguuguauuaaggguaaacacaaauggaauuaccaguuuauauagauuaaagcagaccuagucacaguacacaaaagaaucagccugaguuauugauaaaacguuugggaagcuaguaaacuuaaaagugcuucccauuuugccagcgaauagaggaaggaugaaauugguaggcauucccaaaaauaaaggccuaccuuuccuauuuuaaaauguggacuuuugggaaggugcuucuggucucaucuagacccaugaucuuuugcucuaaacuucauuuuguuucaauuuuauuuuacucauuuauuuuugagacagggucucugucaccgaggcuggaguacaguggcauggucauaauucauuacagccuugaacucccgggcucaagcaauccucucgcccuagucucuagaguagcugguacuacaggugagcaccaccaugcccagcuaacuuuuuuggguuuuuuguagagauagggucucaccauguugcccaagguggucuagaacuggccucaaacgauccugucaccucagccuccaaaagugcugagauuacaggcaugagccacuguaccaggcuaaacuucauuuggggauuuuuguuuguuuuuuuauugagacggggucuuacucuguugcccaggcuggagugcaguggugcgaucauggcuuacugcagccuugacuucccuggcucaggcgauccuccuaccucauccucccagguagcugggauuacaggcgcacaguaccacucccagcuaauuuuuuguaguuuucuguagaagacaggguuuugccauguuacccggcuggucuugaaauccugggcucaagcgauguaccugccucagucucccaaagugcugggauuacagcaaugaaccaccacacccggcucuaaacaucauuucaaauugucuuaacaaaauuugcaggaccucauaauuggccuaaucugacccaaagcuuggagcuagugggcuaccugaaaaguauauagaucuaucagagaagaauaauuguuuuagcaccgugaacuuaaguaaaaagaauuagaagacauucuuucauuuucgaaacuauaauaagcaaagcccugugguuuuggcauaaugauagacauaaaaggaauagaauagagaguucaaaaauaggccuguagaggcugggcucaguggcucaugccuguaaucccagcacuuugagaggcugaggcagaaggauugcuugaaagccaggaguuugagaccagcuugggcagcaaagugagaccuugucucuacaagaaaaauuuaaaaaaaaaacaacaacaaaaacuaggcaggugugguggugaauaccugucaucucagcuacuugggaggcuaaggcaggaggauugcuugagccaaggaguuugaggcuacagugagcugugaucgggcuacuguacuccagccugggugacugagacccuggcucuuaaaaaaaaaaaaaaaaggcuuauguauguauuuuguugauuuuugacuaaaguacaaagguaauucaauggggaagugauaguguuguguuuuugagcuagaagaacuagcuucuaucuacaugggggcggaguaaagaaccucagccuuugcuucauacacaaaaagauuaaccugaaauggaacauaaguuaaaaagcuaaaaccauaaaacuuuuaagagaaaacaggagaaaaucuuuuuacccacucgaauggguaaaauauuggcaaggauguugauaguaagaaaaauaaauguaaacaugccccgauuuacgguuuuccuugucaaacauacccauauuuucauggcuuuguggacuuuggucucuaucauuuaagaaugucauagaauaaaauucuuugaaauaggaagggauauuagaguucaucuauaauaauguuucucaaacugcuuccuuccaguuuuguuaccucaaagacuuauuuuuucucucugaccucuuucauuauguguaaaugaguaaaauggguaugaugccaaaaguuuaguauuguuacagguauuauaucuggaaauaaauguuuuauaaaacuguaaaaacucuaguaguugggagcuguggcuuauaccuguaaucccagagcuuugagaggccaaggcaggaggauugcuugaggccaggacugagagaucagccugggcaacauagugagacccccaucucuacaaaaaauuuagaaaauuagccagucuuaguggcaugggccaauaguucuagcuacuccauaggccgaggcaggaggauccuuuaagcucaaggguaagcagcuguagugagcuuugauugugccacugcacuccagccugggcgaccgugagacuucaucucuuuuuuuuuuuuaaaaguucuguaauuacuacugaccucccaaggugauauuucaaccguugccuucacccuuauuccagaaauacuaaaacuuuagaauuauuuuugaggcaaucaucuugauuuuccucuccuacaagguaaauauuuuuaaguguaaaguuuuggagcuuauauuuaugaauauuugcaaggcuuuuuuccccuccgccuccuuucaugcaaacaauugaaguggcuagcuuuucuccucuccuggaauaaaggaagugaauuagcaauugaauauauaaccuaggacuucucuaaauuaggcaccuguggguacccuuaggguccauaugcuuacaauaugaguuucuaucaccauuauuacuuguuuuuugaaggccugaugcaaagccuauuaagauauugaaaaggacuaauagcuauuuauccauuugccucuccauacuucaucaucuuagucaccuacugccaccuucgaaaaacacggagagcaccuacccagaggagaagguagauuuggaguaagccgccgucgacauaauuccucugaugguuuuuuuaacaaugguccccuacgaacugcaggaggugagccauguccaacuuucaugacuauauuuaagcuacucauuuaggacaagcccaggcuguggguacaugucuguaaucuugaaauaggaucuuuucugaacauaguuuucauuuagauucucuaguagucauuacgcaacuacauuggcuuucuaggucuaacuaugauuaugauucucaugaaucaucuguucaguugaacugauuucagaaauuaccucacaaagaaaagauacauuuuuuuauuuuuuuuguguggacuuuuuauuaacgaggucuccugaaggccuuuggccaauaccguaaaccaaaucaggaagcaaacaaucuaauuaguccuuuucuuuacuauucuagauucuuggcaccagcccucccuguuccgccaugauucuguggacucuggugucucuaagggagcauaugcuggaaucacagggaacccaucugguuggcauagcucuucccgaggucaugauggcaugagccaacguaguggagguggcacagggaaccaucgccauuggaauggcagcuuccacucccggaaagggugugcuuuucaggaaaagccaccuauggagauuagggaagaaaagaaagaagacaagguggaaaaguugcaguuugaagaggaggacuuuguaaguaugaaucuuuagaugugugguuagaagccaacaaauaaugucugaaauaugagacccuguuaguaaugagaacauuucagaaauuacagaaaaaggaauuuguaaguugagguuuuuauuguuuuagaggaaagaaguuaaguugauaauauuugaaaauggugaccaaaacuccuauguaacuuguagcaaauuuuucaucuuugugucuuuggaauuuagaaaaauauuuaauuucucuuaagucuuauaaaguuuacucaaauauaauuauguuaaaauguacucuugcauguuaaauugucuuuuuuccaacuaugauaaaacauuuuuucucuugauuuuguucucuaucacauaaaauuacugugacaugaacauguaauugggaguauuucagcuguugccuaugcguucaguaacacuugauguuauuguguguuaaauuacaugccuuuuggccucuuaaaucaaagguagcauuuucagaguaucuuuaaaauguuuuaaauauauuuuauuuaagaaaagauuaucaggcugggcucgguggcucaugcuuguaaucugagcacuuugggaagccgaggcggguggaucaccugagggcaggaguucaagaucagccugaccaacauggugaaaccccauaucuacuaaaaacacaaaaauuagcugggcuugguggcaagugccuauaauuccagcuacucaggaggcugaggcaggagaaucacgugaacccagguggcagagguugcagugggcugagauugcgccauuacacuccagucugggcaauagagugagacucugucucaaaaaaaaaaaaaagaaaaaaaagauuaucauuuuaacaaaucaguaucuuuaaguuggccaggcauaguggcucaugccuguaaucccagcacuuucagagaccaaggcaggaggauugcuugaugccaggaguuugagaccagccugggcagcacagcaagauccuugucucuauaaaaaauuuuugaaaaauuagcugggcaugauggcacaugucugcggucccagccacuagggagacugaggcaggaggauuacuugagcccaggaguuugaggcugcagugagcuaugauugccccacugcauucaugccaccacgcccagcuaauuuuuuuguuucuuauacagacuagcuaucacuauguugcccaggccagucucaaaugccugaccucaagugaucuucccaccucggccucccaaagugcuaggauuacagacagccaccacacccagccucuagcuguuuuuaaguagcacaucgaucagucgcuucuguuauagccauuucaucaguuaguagagucaccuaaagaggagugaaauuuaggcauuagcuccucuacccucaagucuaggaagugaccugggguccuugcuguaaauuauauauuaaugugaauuccuauucccaggugaguguucuucaaaacuuuauccucaggaaggucuauacugcccuuacauauugaauauuuguccagaauguucuagauaacaaauaguccagaaauuacuacaauuucaaauguaaucuuuauuauuuauacagcaaacuuguauuacaagcaaauccaagaaagaccagugggaaugauuugaaaacaauguauguugcucauuacacuuaaggaacuugaugaaauucauaucaaacuagcaaugaaagcauuagcaacagagcugguggacauggguggcgugcaccuauagccccagcuacuugggaggcggagguggaagcaagacucuaucucuuaaaaaaaaaaaaaugcagcaaucacaguauauucuuauuaaaaaacaacuuuccuuuaauacuuuuauucuaugauuaaauaaacccauaaugauuuuaacauaauuuguaucugaaaugaaauauuuagaguauaucuaauauuauaaccauagccaacugugcauauagaagacuaauuuauuugaauccccaauaguuuugauuucuuacguacuucauuaagaaaaagagaagauuguagcaaacaagaaauaguguggaguaaaguagaaguaauuguaccuuuuaaacuggguaguaugcuacugauuagcauaguuugauuagaaacuucauuaucaguccugugacauucccagugggaaugauacaaacauucuauuuuaucaauuugugcauuuuuuuaccuucauaugaauaauucauacuguaauucucuuauuuauguaaaauuguuugaaguuuacauguguugaaucaugaggcucuagcuuagugguucucaacuaggggcaaguuugcccgcugggggauauuuggcauuauauggagacaucuuuguugucacaacugggguuaguguuaauaucaccuaacauguagagaucagggauguugcuaaacacuuaaaacgcacuggacagccucauaacagaauuaaccaggcuaaaauguuaguagugucauggcugacaaaccuugcucuagaucuuuuuuacuacucuauagcaaauauuauauugugugaauacacuugauuuauuuauccauuuuucuguuaauggaaauucaguuuguaaaagaccuuguuuuggagacuaaacuuaaaggauuggaacugagguauuguuaauuagagaaggaagagucaaaaauaagauuucuucuccucccgccacccaagaugccgaaaggaaagaagggcaaggggaagaaguuggcucuggccccugcugucgucaagaagcagagccaagaaaguggugaauccgcuauuuaagaaaaggccuaagaauuuuggcauuggacaggacacccagcccaaaagagaccucaccugcuuugugaaauggcccugcuauaucagguugcagcagcagagagccauccucuauaugcagcugaaaaugccuccugcgauuaaccaguucauccaggccuugcgcugccaaacagcuacucagcuacuuaagcuggcccacaaguacagaucagaggcaaagcaagagaaagaagcagaggcuauuggcccaggcugagaagaaagcugccagcaaaggggauguccccaguaagagaccaccugucuuucaagcaggagucagcacuucaccaccuugguggagaacacgaagacucagcuaguggugauugcauaugacauggaucccaucaagcugguugucuuccuaccugcccugugucguaaaaugggggucccuuacugcauuaucaaggggaagucaagagugggaugucuacuccacagaaagaccugcaccacugguugccuucacacagguuaacuuggaagacaaaggagguuugucuaagcugguggaagcuaucaggaucaauuacaaugacagauacgaugagaucugccaucacuggggaggcaauguccugggucccaagucugugacucgcauugccaagcucaaaaaggcaaaggcuaaagaacuugccaccaauuggauuaaauguacacuguugagcuuucuuuacauaaaaagguaaugcaaauuuuccuaaagauuucuauccaaagugacuugaugaauaauauguaauuaacuugaagagagaaagcagaaggagcagaauugguuggagaaaacaaauucuugaugccaaagagauggguuaggucuagagaagugcacuugaaaauagagauaauaguugagguuuguggauaaauaaaaucgcucaaggagaguaauacauuggaaagaagggagguguagagcagaaccuguggauuagcaguaagggagacugagaagugguuagcugaagaaggaacaaguauaccaagaaaaaguagguagauaaaaaucacaaauugaagauguuuugggaccugauuguuugcaguagauuuucuguauuauuuuuuucuauaccauauguauguauaauuagaaaauuauuuuaaaaucguauugguuucguguaauuaacaguccuauauuguuaccugggcaaguuaaauaguccuaauugucccugaguuguuagagaauguuugugaaccacucagcacagaccuugacagauagguuuuuguuuuuugcuuuuuugaaguacaugauauagacaggaacacagauuuuuaaaugguagcuguuacuaagugugggagagagcuuugacucuggcaguuugggauggccuuucaaaauugacaagugugguuguaaggguuagagaguaaguuggugaugaaugauacacuacucuuuggagaauaaagagccaggugugaggguagaguguucuaggauuaggagacuuggauguguuugaaaccugaggaguaagaaauugguggagagaagggacucugagaggaugccagcaguauuggcuacagcuuuuucaucuuccccaauuauccaguaaaagcagagcucccuuuaauauugggagcaauauuaauauguuuacucuuaucacuuguauuuaucauuguauuagagguccuaacaaguacaauaaggcaagaaaaagaaauguauacaguuuaacaagaggaaauaaaacuuuguguuugcaggugaaaugaaaauccuaaggacucuguagaaaaacuauauaugaaauuccagaacagccaaauaaucuaugaugggaaagaaaaucagaaugguuuuaugguugccugugcacaguggggauuaacugggaaaggguaugaagggaacuuucugguugauggaaguguuaauaaucuucaaagaaguuagggagguauuagcauuuuaaaaacucauagaauugaguauauuuuauauguguacauuuuacuguaugaaaauuuuaguauuaaaaaauauuaaaauuaccaguagugaaacagauuuaaaccuccugauaugauggcacugagaaauaugcaccaucaccucuguaacauuccuuccagaaaugcauugccuggaucuaaucauaggagaccucagacaagcccaaauugaggauucuacaaaagaauugcaaaauaacuggccuguagucuucaaaaauguuaaggccaugaaaaaaaaaaaagcuccagauuaaagaacuagagauaugacaacuaaaaacaacauguaaaccuagauuaaauaacuacugggugaggcaaaaccauuuugcaaaaauuuucuuuugcuaaaacaucagugggacaauuugaauaaguguuguagauuagauaauaguauguauaaguguuaauaauuacucugauuauguaaaagauauccuuuuaaggaaauacauauuuaaggguaaguggcaucaaguccugcaacuugcacaugguucaggagaaagaauggggaagcaaaugugaaauauuaauacagguugagcaucugcagucuaaaacuuuuugaguguggaugucaugccacaaguagaaaauuccauaccugaucucaugcagcaggucgcagugaaaacuuuuguuuccugcacaaaauuauuugagacagagauucacucuugugucucaggcuggagugcaauggcgcgaucuuggcucacugcaaccugcgccucguggguucaagccauucuccugccucagccucccaaguagcugggauuacaggcaugcgcaccccuacgcccagcuaauuuuuguauuuuuaguagaggcgggauuucgccauguuggucaggcuggucucaaacuccugaccucaagugauccgccugccucagccucccaaagugcugggauuacaggcgugagccacugugcucagcccugaaauuauuuuaaaguaaaguuaaaaauaagacaaagcaaguagaguugaggaaccaacaaaaucuacagaugccaucuacgucaaagcaaaaugauauuuccccacauacccguaaagggauagggacaaaccaccaaaaucuauauaagaggcuugguuaauacuagcauuugugcagggggaacugaagggaagcagcagagcaccugacagcauaaagaaugcuaacagagccaaccguuuuucuggaaagcucguagggcauauuugagaagagcagcaguuaaucgggaguaguuuuccguaauggaauaacaaguaaauacaggggcucugggauaagguaugaaggaucugacuggaccagucaagaguucaaaccacacaguaguuugaauagagaaaguuaauauaaggaauuuaacuauagcaagauuggaguaaugaaggauugacuaguacaaaguaaaaagaucuuuaaagaaaauagaaauagcacguagucacaguucaguggcucacgccugugauugcagcacuuugggaggucgaggcagggcgauugcuugaguccaggaguuugagaccagccugggcaacguggugaaacuuuugucucuacaaaaaauuuaaaaauuagcuggacgugguggguaccugguagucccagcuacucagggggcugaggugggaggauugcuugagucuggcaggucguagcugcagugagcccagauggcaccacuucauuccacccuggguaacagagugagacccugucucaaaaaaaaagaaaaaaacauacacacagacauauaugcauacauacaaggagcagccacuacccuuagggcuaagacaguguguccaagaaugagucccccauuucccuaccaccaccccagggcugagauucauaccugguuagaaagggcucaguuguggcucacugaauggcagaguaauugcugaugugcuucucuggggaagcgugcugaaaggcuuuucaugagaggugucacucugcuacaaaacuacucagaugaggugcugagggaagcugcuggucucugagcucacuuauaugucagaaccuggcuuugaggaacugggugcugugggagccugcugaaaaacacacaggaacaggaaguaaaaaucucuccauuguucuccgcuggcagaaguuaacaugccagcugucaaaggaaaaguuuuaaaguguccaggcacauuuuugcucaacaggcagaagggaugacuuugugacuaagaagcgguaaccagcacaggguucuaucguuguucaugcuagcuggccacuauacccuuccagaacaaagcccgucacugaggacaaacuguuggaaauauaauccagauugagcugcagagagacaaguuaguagagacgaaaggaaagguucagauaaaagcgguagggagaagauaaccaggacauuaaagaacguaaacccgggaggcagagguugcagugagccaagaucgcaccauugcacuccggccugggcaacaagaguaugaaacuuggucucagaaaaaaaaaaaaaaaaauccuaagaaguugguuuaaaaaaaaaaaucaucugggaaaacucaaaauaaggggcuagaacucuugaaaagaaguaauaauaaaaaauuucagaaaaauacugaagaauaaagagaauaaauaauauuuuucaagaauuagacagcgaaggaaaauuuuuuaaaugaaggagaaauacauagguaaaaaauuaaaacugggaaaaaaaaguuuggcagaaaagaucuaauauagauauauaauaggaucuucccaccccgcccccagaaagaaaaccaaaauaaaggaauagcuuaaauacugacaaguggccggguacgguggcucacaccuguaaucccagcaguuugggaggccgaggggggcagaucacgaggucaggagaucgagaccauccugacuaacauguugaaacccugucucuacuaaaaauacaaaaaauuagccaggcaugguggcgggcgccuguaguccuagcuacucgggaggcugugaggcaggagaauggcgugaacccgggagguggagcuugcagugagcugagaucgcgccacugcacuccagccuggggacagagugagacuccgucucaaaaaaaaaaaaaauacugaaaaguauaauucaggaacauuuuucugaaauacauuuagauuugaaucuacaaauugaaaggauagccaggaugacuaagacauacucuuacaaaauacuagacuugaacaaaaaaagaaagauauccuuuggccauucaggcauaaagacugaguuguuaagagaaagaaaaccagauagacugugacagcaaagcuuuauaacaaguaaauggaguaacaauuacaauaaagaaaaugugagccaaagauuuugugcuuugucaagcuaauguucaguuauaaagaucacagacaaacaucaauguguaaguacuuggaauauugcucuuuccggcauuguuucgcgcugccacaauggugugugugaacauccuaccuguugcucucaagaguaucaccaaugccgaaaagagagggaaacgccgguucuuacuaggccaugcuccaaagucauuguccaacuucuagcugugaugaugaagcaucguuacauuggcaaauuugaaaucauugaugauaacagagcugggaaaauugugaaccucacaggcaggcuaaacaaguguagagccccagcuuugauuugcaacucaaagaucuagaaaaacggcagaacaaucugcuucuaucccaaccauuugacuucgucauauugacagccuuagcugguaucauggaccaugaagaagcaagacgaaaacacacaggagggaaaauccuuggauuuuguuucuagggaugcaauacauauuuacaaauaaaaugccucaaaaaaaaaaaaaacaaaaaacuucggaauaucguucccaagacuuuuccugagaacuacugaagaacaagcuucugacaaacuaaccagaaagauuacaaaaggaauggugguaaauacuaaauguaugguuaauuguagagcuaagaagaaaugaggguuaaaagagaguuagcaugugauaguuauaugaucucacaaucuggacauaguauaacuuuuuuaaagugggaagauggggagaacauguccaaaaaaaacaaaacauuuuggucacuggugaaauacugacauugcuauucugaaacuugugcauaauauggaauaaagcaauuaaauaugauauucuauacuuuguaugcuugagaaucaggauucuuguaggaggaaauaaaaacguaaaauagauguuccguaaaauccacaaggguacucaguuugaauugggaauaucaguaauaaguuaugagguguuuuagcuuuggagugaaaaauacauacuucuaggcgguucuguccacugaaaagacauaaaaacagugaacaaccccauagcaaugaguggcucuacugccuggauugugaucuugaaauaguuuauccagacagcauacuuaaaagaagagcuuggaauauuuuuucaaacuagauaacaaagaaguaaagaacuacuuaggguuguagcaaaaggauuuagaagccaaauugaagaggguuccauaggccaaacaugggacaguuuuaugcaucaauuaauaauaauaacgacgaggguugaaucacaucaaauuggauuuaaaucugugaauucacaaugauaccuaccucaccuuaggaacaagcauguaucauauuuuuucuauaugaacuguacuguugaauugccaaauaggggaaguuccuauuuauggaaguauacuacuuuauaaagaauuguaaaauuagaucauuguuuuugcaucuuguauugagcugacaguuuuaggcuaugagcaccagugucugccagcaucacuaaaagaagcacaaccacauguuauuugugugugucuccuaauggaagaauacaaaaccacuaaggauucuguaaccucuagaaccaacuaccaauuuauagaaagaggcuuaagauuuucuaaaaacuaguagauuaaaagcugagauuguuuuuggagacaaaacuauagugucaagggagacacaauggguuaguaaaaaaaaaaaaugcagugaucaccauaaguaugaguaguuuugggguuuuuuucuaaugagauuuguaaugucuuucugguuugucugguaauguuauguugcuuaaaccauguaguguuuaaaagaacuuuuacccauuaacuuauucauuuguuuuauauuuuuccuguuuauauuuuacaaguuuuaaaacuguauuuuuuaaaacaguagaaagagaucaaagauacuguauaaauaggagcauugucucugagaacccuggguacaacaugccuauuaaaaugaaacaaggaaacaaccacagcuuuuauggcugggcacuccuucugccucuaccacuccaucuagaggaauguauuuaccuguccuugaaaaucugucacugauuuguccacuuauauagagaguugguaguuucauuugcauuugugcuuguucuccuauuguagugguucucaccuugauugcuuggaaaauacauaccugcuagaggcccugccccuggagauucugauucugaagcucuguaguggagccugggugucuuuuuguuguuuguauaauguucacaggcaauugugcugaaaagccauuuuccugcugggcacaguggcucaugccuguaaucucagcacuuugggaggccaaggugaguggaucacuugaggucaguucgagaccagccuggccagcauggugaaacccugucuguacuaaaaauacaaaaauuagcugggugugguggugcgcaccuguaaucccaguuacucaggaagcugagacaggagaauugcuugaaccuggaaaguggagguugcaaugagccaggauugugccacuguacuccaaccugggcaacagagugacacucugucacaaaaaaaaaaaaaaaaaaaaaaaaaaaaagccauucuccuacccuguuaccagaucguaaaguuugggcuaggacagcagugucauacgauuaguuauuaagucuagucuauugcucuuaacucuucccugcccuuucccuuaucucguucucuacuucuguuaccuuuauuacccucccggacuauggaauugaucuccuaauggucucuuaguugauguuuaaauaccucagauccauccuuuaagcugcuacuagagugacgguuguaaguugauaauuagauaauguuaacugcaugaaagauggauccucauuaccuguagaauaaaacuuaaucuccccuaagaaauccuccacaagcuggcucuugccugcuuugccagauaccucuuuccccacagaaggguccccuccuucccuagcacuacucaugcugaacuauuugcagaccugaauauucuguucuuuuuaaugcuuucuguuccuggaauuaccguuuuuccagcuuuggaauucaucuuuaaggauucuuaaaucaccuguuaguaaagccuuuucugauagcacuucucuuucaaguagaauugauguuucuuacugaguacuccuucuucccuaauaugaauuuuuuucaucguccuuguaaccuuuuauuguacuuaacuugucuagaaguuuuuauagcaaaacugugacccgugugaagacaggggcucuuuauuguauuucuagcacaguccuuggcauauggucugccccugcccuacacccaucuuagaaaugcagugaauacuauacauuucacugaccacauuguccuccuuuaaucugaggaaaaugauccacauucuuguucaucuaacuuucagugccuccuuauuuggcauacauauccuauaggaaagugggaauucgcacauuuagucuguuuauuuaaaauaaaugaaaucccuuauaucaaaggaaaugaaacucaggagaaccuaauauuaacauaauaccuauugauuuuguguuuugauauuuucuguuuguuacguuucugaauacagugucaaauuaguaaguguugcuaauauguaaaauauguaauuauuugauagguuccauggugauggcuacuuugugaaaagugccaaaaugaucagcuuucuguaucaaccauucauaucccuuuuuuccuagccuuccuugaauccagaagcuggcaaacagcaucagccaugcagaccuauugggacaccuucuggaguaugggguagguagauuuugccauuuuaaaggcacaacuuuaaaauuuuuucuuagcagggaggggagcaaagauuccuuaucucuuuuuaucucuuguuucucaucucaugcauuugcccaugguaacuaacaucugacuguagcggguuauucugcccccuaccccaccgcccaacccccaaacaccacugaaauguuaccaugguaguagagucaaaauacagacaacugagaacuuauagaaccgugaauuuggaagcaguuguuuuggugguguuuguuagucuguuuguuugagacagucucauucuguugcccaggcuguagugcaguggcgcaaucucagcucacugcagccuccaccucccuagcugggacuacaccaugccuggcuaauguuuguauuuuuaguccagacaggguuuuaccauguugaucaggcuugucuugaauucuuggccucaagugauccacccaucuuggccucccaaagugcugggauuacaggcaugagccaccguagccaacauggaagcagauuuuaaguagaaaaaguucaugaaaaguaacuuaauuaacauugcuacuucacuuacuuuuuuuuuuuuuuuuuuuugagauggagucucacucuguugccaggcuggagugcgguggcgagaucucagcucacugcaaccucagccucccggauucaagcuuuucuccugccucagccuccuaaguagcugggaauacaggccuaugccaccacgcccggcuaauuuuuguuauuuaguagagaugggguuucaccauguuggccacgauggucucgaucucuugaccucaucauccgccugccucggccucucaaagugcugagauuacaggcgugagccaccauacccagcccauaacaauauauucuuaaacauucauauauauguauguuuaaauauucguguguguguguguguguguguguguuuauguguauguguguguauauauauguuugugguuuuuuguuuuguuuuguuuuguuuuuugagacagaaucucacucugucgcccaggcuagagugcaguggugcgauaggaaucuguauuucaaaccaaaccucaucuguggcauugggaucuuuggcauuuacaaauuggacucuccugguuucuucauuagacauguugauagccaagaacaugggaagucuuuaacauaucuaaaugauggguuuagaauccaguauuguaggauuaagauugaucgauguaccuucuccucuuugcuaaugguguauaccuuugcuccaguuugccucaucagaggguuucauggcagacuccaaucccugauuaccucaucucucuauucucaugcugacaggagcugcuacuuuuagguguuuuuuuuuguuuuguuuuuguuuuuuugaguuagggucugacuuugucauccaugcuggagugcaguggcacagucauggcucgcugcagccucgaccugggcucaagugauucucccgccucagccuccuaaguagcugggaccacaggugugcaccaccaugccuggcuaauguuuguauuuuuuguaaagauggggauuugccacaggguuugccagcccaggcuggucucgaacucuugggacucaagugaucugcccaccucagcaccuccaagugcugagauuacaggcaugagccacagugccuggcgcuuggauuuauucuuguuggguucaugcuuaacugaucacacuguccaucagacauauugugccccugaaggacugcuaacaucuuuggacuuccuggcugauuuauaaauuuaguauccaguuccucauaugcugcauuuuuuuguacaguuccugaguagucucacuuuugagaguaucuauuaagugcauaccagggaauguuuaaucccucugucucaacugucagcuguuuuguugacuaaggccuuuguauaaacuaugcuucauguuacacaacagguuugacauucuguugucucuccacucuuguacuucacagaaaacccgccuagugccaagcaacccuccaagaugcuaguuaucaaaaaaguuuccaaagaggauccugcugcugccuucucugcugcauucaccucaccaggaucucaccaugcaaaugggaacaaauugucauccgugguuccaagugucuauaagaaccugguuccuaagccuguaccaccuccuuccaagguaugauuuagaaucagggcaagaaccuuauacaagagagguuugggaauaaaucaggaaaaaauuaauaaauuuguuuuuucuugccgcaucagucaccagauauucuuucaguaccuguuauauguauacagcuuucuuugcuuuuuuuuuuuucuuuuucuuuauuuuuuugagacaaggucucacucugucacccaggcuggaaugcaguggcacaaucauggcucagugugaccucagccucccaaguagcugaaacuacaggggcacgccauuaugcccggcuauuuuuuuuauuuauuuuauuuuuuguuuuguuuuguuuuuuugagauggagccucgcucugucacccaggcuggagugcaguggcacgaucucagcucacugcaagcuccaccuccuggguucacaccauucuuccucagccucccgaguagcugggacuacaggcgcccgccaccacacccggcucgguguuuuuuuguauuuuuaguagagacgggguuucaccguuguuagccaggauggucucaaucuccugaccucgugauccgcccgccucggccucccaaggugcugggauuacaggcgugagccgccacgcccagccauuuuuuuuuuuuuuuuuuuaauuauuuuuuguagagacagaaucucauuuuguugcccaggcuggucucuaucuccuggccucaaggaauccuccugccucagccucccagagcgcugagauuaugggcgugagccaccacaccuggccccucugguuuucuguaauagcaacaacauccuaaucacucagcuugacuaucuuggcuacuucucuucucuuccuccuuagucauucuccucagccaaggaauuacaaagucccuguuauucucucuaugcuguccuuguucaggacuuugucuucucacauuuacuguucuaguauaccuuucuauuuucucaugucucuguguccuacagaacugccagaaugaucauuccaaaaacaauugaauauaucacaugccuuccugaauuccuucaguggcuccaaacaauguauggcagggauugguaauuuuuuucuaugaagggccagauaauaaauauuuuaggcuuugcuugauauauaugauuuuuguuacacauugccuuuuuuuuuuccagcucuuuaaaaauguaaaaauaaguaugagcucaugaaucauacagaaaugccuuggucaagauuuggcccaugggucauagugugcuaguccuauagucagugugcagaguaagcagaggucugugaaguuucucauagccaaacucuaauccaucuuuugcaucuuauugccccuuuuuucucuuacccgggaagaaauuauucuucuggcgcaugccauccucucugugaauaauuuucuuucuuuucuuucaucuauuuauuuaaaauagugauuggggucucacuauauugcccaggcuggucucgaacuucugggcucaagccauccucccaccuugaccucacaaagugcuaggauuacagacgugagccaccgugcucacccucugaauaaauucacugggaguuacuauccuagugauaaugauuggaguuuucaagguagauuagauauacaagagaagaggauggaagaagagaagaggauagaagaggaguaaagaaugggauaguacugagaaacuaguucagaaaaaaaugguaaacucucacagaaauacaagugggugaguuugcaauagcaacagggguaacaaguugaggaaaauaacugagaaaaaaccuuagugauuaucuuaggagacuuuugaguugauguuuuuagggaauaaaguagggcugaaacaguauuucaagggcuuuuggaaauauguggagguaguggcaccuuuuaaccuugacaguaaaaggaacuagauagaauauaggcaguggaaaagauaagugaauggaugaggaagucuguuggaagaagccacuggaagcaacuugaacuguacuuggaagagaucauuaaaggauuaugggccaagaagaaauaugugggaauaaaacuaauugacaaguacaguuaucuuugaaaaggguuuaggauacuuaggguuuauuuuccucugauguagaagggaaagaaugugaauucaagugaagagagcaacuauuacaaagaaacagcugagcauggaaguuaacugccgggcuauggaauagacagauuucaccuuacaccuucuucaucuuacguccuugagcaaguuucuucacuucccagucucaguuucuucuucuauaaaauagacauaacaaugccccccuuuuuuuugugaggaguaaaugagaaaauuuuaugaaauaccuaaaacuggcauauaauaagugccaauaaaugguagcuauuguuaccaaccugccagcacaacuuauguuugucccauuucuugagaguuuauaaagacuuucuuaaguguuacuuuaagaugucugcaagcauucugcaggacuacagaaaauauaaaaaugaguaagaaaaugucauuguguccucaaggaucucauaaaucaaaagguaaaaaaauuuuuacaaggauaaaaauuaugauacaaaacuuaagaucacuuuagcccuguugugagucagggguagaaugaagauuggaaaacuaauauaaaggcugcugcucuugaagcuugaagaggaugguaacaguuggcagagaauggcagagaugguaacaguuggcagaggugguaauggcagauagugggaggcaaauuaggcagcaaaagaaaacagaagacauucuuccugggaaaauugggguaaauauggaaggucagguuucaggaaaugugauugugguucuggguacguaggauaugagauguuagagggaggaagagguaagauaacuaauaagcagauguugauuuauccauucauuuuaucuaaacauuagcaauaauuauugaguaucugaguaguaaacacugugucacuagagacacaaaauaauacuuggccuguaaucgcaaagaguuuacugucuagugaagaaagaguuauuugaaaaaaauugugcuucucugccuggggagggucaucaaagucuuuacggauaacugggauucaaauacaugauaaaggaaagagaacugccauuuguugacaucuuacuauguugcuugguuagggcuuuuacacauauuaaagcauuuacucuuuuaauccugggauauagagaauacacacugugggguuacauagcuaauaagugauagagucaggcuuuuaacucaggucugacuucaaaaccagggcucuuucuacuguuccagaaugccuccugucuugaaggaugaagaauagaagaggaaguugagaaauuaaucuuuugacucaaacuuaacuaaguugaaaucuuugugacacuuucuaggguugugaucuuaagcaaguuauuagauuuugcuaaacucuucuugacaguaaauuggagcaaguacuuggaauauaguuuuugaaacauccuaauuacccaguaaguggacguuuaaaaacaguaguacaguaguucauuagaaagcaaguagguagggcauucucggcagagggaaccuguuguuaaccagaaaauggaugcagaauaugguauguuuggaguaaaggaaccauauugguucgguauggcugguaugugaaagugaauggggaagucagacuugauggaggccuguauaaaaagaacaggagagaaguuaaaguagguagagaugcaauuuuacauauuaucuacacaauuuuaacauuuuaaacugaaacaguuauaaguaauugcuuuuucuaaugaaauucaccuaguucaacagacuacagaagaagaagaguacugagucuggaaugcuaguauacuuacauccauugaaaagaagggaauucaagagguaaagagagaacugagagagugaagcaucaggaaaucaagaagggaaaaagggacagguucagaaaauauucauaaugagcaauaucgcauuucccaaagaagacagguuuuuuagagcuggccuuuguaauauaaggaugaaaguuuugguuauuuaugaaagaguuuuacuaaaauuggggauagaggugaguauugcagggaacuaagcaguaaauaguuaaugaacgagugaaagauaauguauacugacuuacucagaaguuuggcaauaagaaggugguauauaagauugagggaaaauaagaagucuggccuuuuucuccuaauuucaauaagguggauuagcauauuugauaaacccaaaaggaaagagaagaaagugcuagaaagggaggaggacauuccuuugaacuugaggggcaaacggcagaggaggugggagaaaguuugagcccagugauuuuagaauuuuuaguccaguagaagaagauucugaaguggagcaagcuaggguugauucagaauuuagaggaaaaggagagaacauuuaaaaaacaacaacaaaaaaaacugguuauacaauucacuuuaauggacuuuuacauguauaaucaucuaauaaaaacagguguggggcauaaugauuuuuccaggggguagucuagcuaucucauaggguuuaaguuacugaaaauuaaguugaaauaaaauuggcacagacauagauauucuguuuuauguaacagaguaaaucuuuuguacuacuguggcagaaacccaaguguuucugugcucuggagugacauuguuuuaaagacaggacaucuggugacuacaacucaggggaagccacaaaucaucuuugagaguuaaccugacacaagcaaccaucuuuagauuuuuaucaaugcaagaaaaaaauuaaucuucauucugguugggucaucguuucucuuaucugcuugcuuguucuuuguggaggcauuuugggauaguggaaaggugguuucauuuacuagcugaauaaccuugaacaaauuguggaacuuccuuauugucagugucauccucuauuaaaagucagcguaacaauuauuauuccugauugguuuaagaauuaaauaaaacagacugaccaucaccugguacaugguagauaguaaaguuaauuccuuuccuaaagcuauuauugugucuucuuuuaauacccaucaaucaagaaagcaaccaggaagggaauccauuucacucaggccccuuuguccuggagguccucuguucuaaguguuucauucuggaaaaauaaguuggaaguuuuucauuugcuucagcaccacuccacuggcuugccacaucuuccuuggucuccuuggacagugugguaacucaguauuccagcuuucuaucauacuugggguuauggccagagugacagaaugggcccagacccugcagaguugaguagacgggccuccagacuaaauaaaucaggauuguucaaccauuuacaauagccacccuggccuggaacuagccuuuugccaucagaguuccuggaaagcagcaauuuugugaugcacuuugugggcuaucaggauuacauccaaaguuaacaaacacuacuaaaaaaaguuuugggauucaauaaauuaggaaaaugcugcauaacugccucucaaauucuuaugugcaguuaagugcuuugagaaauugcacagugaagaaccuuguugaacuuuuuucaccccggcaccucccaaacucauugaacuauugaacuagagcccuguuuuugggaagucacuauuaauguccaauggcucuucuguaucccaucuaccauuuuccuugaagugccuaaccuccgaaagagguugcauacuucccaaacauguuaagacagguaagcccuggaaacuuauguucucauguaacauuucacucuuugcuuuaugauuuuauaagcugagcuucuguuugugugcuuguucugacugauuuguucuuucacccuguguagccuaaugcauggaaagcuaacaggauggagcacaagucaggaucccuuuccucuagccgggagucugcuuuuaccaguccaaucucuguuaccaaaccagugguacuggcuaguggugcagcucugaguucucccaaagaggugagugaggaugaagcaggacagucuuuucugaaauugccauuucccguucacuuagauaacaaguguaauauguauagcugugacacuuguuuuguagcuauauuuagcugagaauaguuucuuuauugauguuuucuguuagcauccaaaagugggcaguggcuaaaugggauagaugcucugugguggaccaaggucauccuauguuagacuggcauucugcugaugucuguagaaagaucaaagaggugccauguaagccagcugcucuuaacuauauaaacccugcaaaacugaaguuugaacugcuuaaauaaaaggauuguuugguuuaagacagagugauaaauaggcuaccagauucuugaagucagcacuuaguagaagagaaccccaguucuugcucuuugcugucaggagcaaccuguuugugguauuugcccagagucccuccagcaccaccccuccaauugagaucagcuccucucgucugaccaaguugacccgccgaaccaccgacaggaagagugaguuccugaaaacucugaaggaugaccggaauggagacuucucagagaauagagacugugacaagcuggaagauguaagagcauccgccuuuucuggggguagccuaggaauuuuccuuugauacauacgugauuucuucuucuuaaaggauaaagauguggcaagauuuuuaaauguacagagauacugucuguagguguaacugccuucuagaccacauaguaaagugaguuuaauccuuuuuucagcaaaaauguuaaauucggguuuauuuuaguaaucacucaccuauugaaguacaucuugguugcuuccaaguguuggcaacuaugaauaaaacugcaguaaacauccaugugcagguuuuugugcuggcauaaguucaacuccuuuggguaaauaccaaggagcgcaauugcuggaucauaugguaagagcauguuuagcuugucaggaaaccaccaaacugucuuccaaagugguugugccauuuugcauucccaccagcaauaaaugagaauuucuguugcuacaccuccucaccaguauucgauauuaucaguguucuggauuuuggcccuccugauagguguguaguuuuaauuugcacuuccaugaugacauaucauguggagcauccaucuauguaucuucuuuguugauguguuuguucaggucccuuacccauuuuuuaaugagguugucuguuuucuuauugcuaaguuuuaagaguucuuagaguucuuuguauaucuuaguuaauaguccuuuauuagaugugucuuugacuacaguuucuccaagucugugauuugacucuucauucuuucuuauuuauuuauuuugagacagagucuggcucuuaucacccagacuggagugcaguggcacgaucugggcucauugcaaccuccgcuucccggguucaagcgauucuccugccucagcuuccugaguagcugggauuacaggcacccgccaccacgcccagcuaauuuuuguauucuuaguagagauggaguuucgucauguuggccaggcuggucuugaacuccuggccucaaguguucugccugucucagccucccaaagugcuaggauuaaaggcauaagccaccacauguggccauauuuauuuauuuguauuacuuuauuuuuugagauggaguuucacucuguugcccaggcuggagugcaauggagcaaucucagcuuacugcaaccaccgccuuccagguucaagcaguucuccugccucagccucccaaguagcugggauuacaggcaugugccaccacaugacacacguuauuuagcuucuuagcucuggccagaggaccaggaaacuacagugcagaacaagaggcagaggaaggccaaccugcuuccuugaagaccaagagcucagaccauaacucuggaacacagccuugugguucugauaaggaauuagaccugugaggaugaaagaguauacuauuuucuggaauuuuuuuuguauguaguagagacaagguuucaccauguuggucaggcuggucucggauuccagaccucagguaauccacccaccucagccucccaaaaugcugggauuacaggcaugagcugccaugcccagccggccauauuuguuuuugagacagugucucacucugucgcccaggcugaaugcaguggcauuaaugaucacaguucacugcagccucgaccuccccuccucaagcuaugccucagccucagccucccgaguagcugggacuauaggcuugugccaccaugccuggcuaauauuuuguuugguacagagauagcuucuugcuauguugcucaggcugguguuaaacuccuagacucaagcaguccucccaccuuuggccuccgaaagugcuaggauuacaggugugagcaacuacacugucuuuuaauucucuugacagaguguuuugcaaagcagaaauuuuuuuuauuuuaaugaaauccagccuaauuaauuguaggccagucacgguggcucaaaccuauaaucccaacacuuugguuggcugaggugggcggaucaccugaggucaggaguuugagaccagccuggccaaccuggcgaaaccccguuccuacuaaaaacagaaaaauuagccgggcaugguagcaugcacccauagucacagcuacaugggaggcugaggcaugagaaucacuugaacaugggaggcggggguugcagugagccgagaucgcgccacugcacuccagccugagcaacagagugagacuugaucuccaaaaauaaguaaguaaauaaacaaauaaauaaauaaauaaaugucauacccaagguaaucuaaguuuucuuuuauguuauccuuauaggaguuuuauaguuuuguguuuuacauuuaggucugugacccauuuugacuuuauuuuugugacggcuguaaggucuuuguuuagauugauuuuuuuuuuuuuaguguggcuguccaauuguucccucaccauuuguugaaaagacuaucuuuucuccauuguauuuccuuugucaaagaucaguugucuauuugugggcucucuguucugucccauuggacuauuugugucaucuucugccaguaccacacuuuuuccccccacaccucuuaugagcacuguuaccauacuguuuuaauuacuccagcuuuugugguaagucuugaugucagguaauaucaguacucugguuuuauucuucaguauuguguuggcuguucuggaucuuuugccuuuucauuaaaacuuuagaaucaguuuuguugaugcagcagguccucauuuguaaauggggaaaaaaaucugugggcugaggcugucuuuuggaaaacacuuccugggucgugaguccuugauuucauagguugcuuauauuacuacaaaggaaccuuaaaccaacuguguccuuccuuuuccuuauugcaguuggaggacaacagcacaccugaaccaaaggaaaauggggaggaaggcugucaucaaaauggucuugcccucccuguaguggaagaaggggagguucucucacacucucuagaagcagagcacagguaagugaggaggacaucacagggcaugcagugucugaccuuuaaggaccuugaacauacuggagaagauaucucagauagauaggucccacaugcagagagaaguggcccagucauaacuuguucucuguguaugccccagguuggccuguugcucaucaagcauucucucucaaacucagccaucuuuuccacaaucuacucuccaauacuuuaauacuuuuaacuucaggccgggcgcaguggcucaugccuguaaucccagcacuuugggaggcugagguggguggaucagucaaggucaagaguuugagaccagcuuggccaacauggcgaaacccugucucuaccaaaaauacaaaaaguagcugggcaugguagugugcgccuguaauuccagcuacuagggaggcugggacgggagaauggcuugaacccgggaggcggagguugcagugagcugagauuguaccacugcacuucagccugggugacagagugagacuccaucccaaaaaaaaaaaaaagccagacugcaagugcucucuuucuuccuuacacugucuugguuuugcuucuacugucucuucuuuagcucuuccucucucaacugugaagagccuccauuuauuuacagcacccagguagccacaauuaaagcuugucccacagggaggaaaacaaaauuccuucuuuaacauccauugccccugggcagaaaacuuuucugugaaaaguggugggcuguucacuuaggcuuagugauguuguauucucuuuaccuguccuucugcguccaccagguuauugaaagcuauggguuggcaggaauauccugaaaaugaugagaauugccuuccccucacagaggaugagcucaaagaguuccacaugaagacagagcagguauguuguaaaccuucuuccuagagaccaguuaguaaccaggagaauaaggagucaagacaguucuugcccugagggagcaaguuuaaugugagagaaagaucgggugggggggggggggauuaccuuaguagaaauguaguggggccccuaaaucugccugggaaauaaggauccccaguguuauauacaaaaaccaagugucagugauuagcagauuccaaaaaauaguaugcucuuucauccuaacagcucuaacuccuuaucagaaccacaaggcuguguuccagagcuauggucugagcucuuggucuuuaaggaagcagguucaccuuccucugcuuccugaucugcacuguaguuuccugguccucuggccagagcuaagaagcuaaauagcuugugucaguuuauccagcaguugcuuggauucuuucucugaauaaaacacugcuagaucuuagggugaacaagacaaaugggguuucuauaaaaauccuugaacuucugguggccuguauuuacagcacaauuggccaaguccuuaaaaggggcauggcacaagcugaugugagaccuugccacuuagaacucuguuagaaauaaggacuuauggcugggcacaguggcucacgccuguaaucccaacacuuugggaggccgaggcaggcagaugacgaggucaggagcucaagagcauacuggccaauauggugaagccccaucucuacuaaaaauacaaaaauuaacuaggcgugguggugugcgccuguaauccaagcuacuugggaggcugaggcaggagaaucgcuugaacccaggaggcggaggaugcagugagccaagauugugccauugcacucuagccugggugacagagcgagauuccgucucaaaaaaauaaauaaauaaaaagaaauaaggacuuucaagccccaucccagacauucugaaucugaaucugcauuuuugaaagaugcguagaugacucguaaauuaaaauuugaaaaguacugguauaagagaucucagagggucucuuagaagcaccccccgccccacauucuaccuagaauugaauugaggccuggccuuucccagggcuuaugggucaguacagucauugauauuuuuuucuuuuuucuuucucucccaugcuaaccauagcugagaagaaauggcuuuggaaagaauggcuucuugcagagccgcaguuccagucuguucuccccuuggagaagcacuugcaaagcagaguuugaggacucagacaccgaaaccaguagcagugaaacaucagaugacgaugccuggaaguaggcauauaaaugcucacaguuaaaucugacccaguaaacucuguguguuuagggaguauacaaaagaaaucguucuuuuccuuuucuuauguuguugaauacuucauucacaagggaaauaaucauaucccaaagagagagcaauuggcuuguuuugcuuuuguuauuguucuucccuguuaucugcuuuauagagagaaguuuguguggugggacagauuuuuuaaacacacucacacacacacacacauacacacccaguauauauggggcgaugcacagguaggagcuggcagugcagggaagaggagacacuggucugcagcaacagcuucuacuaccagcccuuggggcacucaccccugugaucaagcaaucauugucaaugacaaagugacuauugaaguuauaauuguauuaaauuaaugcuaauaauuuggauauuuuauuuuauuuuuggcugcucggguaacuuuagcccuuaaccaagcauauguggguuuuuuugguuguuuuuuuuuguuuuuuuuuucuuuuuccuuuuuggguacagcuguaaaauauuuggauauaggaaauguuguguuauucuugcagccuugauauucaggguggauuguaaaauauaaauuuuugugagauuucaaagauuaagauuauuuugauaacauuauuuacagauuuaaaagaugugguuaucacaagucucgagggggaaacuacugcauaaaauaacuaacuuggaauaaauauuuugcaucaguuuggauugucuuguguaagaaguauauuuucuuuaaaauuagaugaguggauucuuuuuuaggggaaauauuuuuagaaguuggggggaaaugugaauucagacacaacuguuucucuauuuuagcagauacuuuuuugaugcagaaaaaccugugcaauaaauuaccaguaauaaagucagaaaccaa

SEQ ID NO: 191400 - RNA, 34919 nt, Homo sapiens
uuccagacaaggagauuuuuagcaucuuuauuugagaagucaauucugcagauggguaacaauuccaaguguugauauaucucaaccuuucuauacagaaaauaacaaaacucaaccagccagccuccccacauaugcuuccaaccacaucuggaguguccaccaucaguccccuuggcuacuuucaaaccagagcucaaaugcagaccguuuuccuuaggaaucauuccccugacccagguuuucagaguucuuuuuccaggacagaauuauagccccaggugaagacuagguggauauaggacaagaaccauccuaggccuggcucacagccaaaguccaucauccauuuucagcacugaagagcaagaucuucaccaauucuuguuuuuguagcccccauccagggacagcaccacugaaaguuugcaagacagcuggguucagugaaguguuugaaaacagaauauagcaccauuggaaaacaaaggccuacagccacacuugaucaccuccacguuagacagauaggaauuaggaucaggaacacagaucaguacagaaggccagaacaaaaccuuuggcuaauauauaaaaccagcagugcuccaaggcagauucagccaauaauuaagaaaaaaaccaucaaagccucaaccuuugcuuacaaucuuuauugaaguuauacaaaaagaauccuccaaaagugaaaaaauacauuauauacaaaaacacuuucccuugggaggagggcugugcccccucuuaacaugcagugcuuucaacuguagcuccagccuccacuguccccuccacugcugcccggcuuucagccugauucucagccuggaagacaaacagaaccugggcaugagugagccuaguuuaagccauucugucuuauauaacugaggccucagucauaggaagcauauacaagucacccaaacucugcuuugcucccuauauuaagagggcagugaccacaaaguauuucuugaauacucugugauaauggggcugacagagccaauaaucaucacguggaaggaagugaccuaaugguuuugcccaucaagugccuucucauauauucaucgagggaccuauaauauacagguuccauuugucagugagucauccuauacucccauaaccaaacuguuuuccugcacaaguaccguuuucugugaggacugcacucaacaaucguuagcaggcucaagguggggagcaugcacuugagaggacugauuuccccagguccugagaacaaggaaugaggcaagaggcuaagcccugcuuaacugcccaccuccuccuccauguuuuccgaaacuucauuuccacuggggacagcauccccacugccuccguucaccuccggcucuuguuuggcuuucuuugcaucaucuuuccggggacucucuuccucugguuuccucuaaagauauaauugugaaggcuucacaaaugugcuuaauguuuuuaaaaagacaacugcaaaacauuuccuuaacccuuguggugcaaagauccugaacaucaggauucacagcucuaagggucucucucccuagccacaggcagaugccaaccuguacucucagaauguauuaaucugucccaccauaucacuucaggccccucuaccggaagcacagggagauaggguuggggugaggagaugugaaugguaaucacuguacaaguuugaauuccuguguuugagucaggaaacagaacaggaguucagaguucccuggcugagggcaguggcucacgcuuauaaucccagcacuuugggaugccgagguggguggaucacgaggucagcaguucaagaccagccuggucaguauggcaaaacccagucucuacuaaaaauacaaaaacuagccaggcgugguggcgggcgccuguaaucccagcuacuugggaagcugaggcaggagaaucacuugaacccggggggcagagguuucagugagccgagacugcgccacugcacuccagccugggugacagagcaagacuccgucucaaaacaaaacaaaacacaacagucuccacucacaaauccuuaccaccuuuggaaaauaagugucuuauaugcaccaacuauagggagggguuuauaggaaagggauuaaaaauggagucugaggaaacgguagaaaagaaacaccacauguagacuuaccuucuuucugacaaggugggaaauaucagucacacaauuugaugaggaagcaccgucuguuggcuuucuacuggcaaucuggcaaaauaagcccuuauuagcaauuguacaagcuauaugagaucaaugcugaggcuuuuauaauuuuuuaguuuuucagagacaaggucucacuauguugcccaagcuaguguugaauuccaagccucaggcaaucuuccugccuuggccucccaaaaugcugggauuacaggcaugagccaacacugagacuuaauguaagugaccaaaaaaccaccugaauacgcaccauggagacugaagagccuccuccaccaggagugaaaccugaaguagaacucuccaccugcgagaaaugacaaauccaaauuaguuugaagauagaacccaggccgcccacagccuuguaacaggaacccaucaccauccaaacaacugacuaagaccugaaaugcuaguggccuccauauaguauccaguucuaccccuggcccaccuaugccugucuagcagccacccagagcauagucuauacauagaguguacauaauaaacuaaaucuucuauauccuaccugcaggguaaaaaggucugugccaaaaacagaaccaggcaauuuguggugaaugccucucaaugccucauuaauuuaugcaaaugaguucuuggagauggaaauagcaacuuacauuuuuuaagaaaugucuauuuuuccaguacugucagaaguauauuuuacacauauguacuacaggucgggcaucccaucccuuaauccaacaaucugaaacuuuuugaggacugacugacacucaaaggaaaugcucucuggagcauuucagauuuuagauuaaggguauccaacuguugaguaugaugcaaauauuccaaaauccaaaagcauuugaaaugcaaaacacuucuggucucaagcauucagguaaggauacucaaccuguauuauccccauuuuacaaaucggucaacugagggagagaaaggcccauggccacacguaaguauggaauuaaaacccagauagucuggggcuccaggguauuuccucuuaaccacugcauuacuugauaggaauaauuagaugagcccaccaacucccuggaaaccaagucaugaugaaaaguuccuggcaaauagaacauuaacauaaaugguaccaaacaugcuauuaucaaaauguuaacggaaccaaccagaguagcuuucagagccaguucagcuacauucccacuacgcugagacuccuuugcaucuucuaucuucucucuaauuucggguagcaguuccuuuaguuccucaauuucuuucuuguauucagcagacgauccuucagccuccuucaccugcucguuuaguacagcuaaaaagaauaaagugauuaguaauggcucaaaaaagaacuguuuucuuccuuguuaauugcuggauccaacaucaccaugaagcagcucgucuucacucacccauucuguucucaaugacuucaauagauuugcugaacugugccacugccucaucauacugagaguuguacccauaagccaagcccagcugguagugggucucugcaaggagacggucgugggcuuccagguacuguuccugcagguuaaggcaggacuggaacuccuccacagcuugcacauaguuuucuaacaaagagaaaaagaagagcaaguaaauggacagcauucaacauaaaauacuuccagaauucagacccauccuaugggaaugcacccauauuuaacauuccauuuuuguuuauaguuauuuccaggacccuuggcuauaaagaaagucaaaaugacuuuuaaaaaccuacugaggcugggcgugguggcucacaccuguaaucccagcacuuugggaggcugaggcgggcagaucacaaggucaggaguucaagaccagccuggccaauauggugaaaccccgucucuacuaaaaauacaaaaauuaaccgggcgugguggugggugccuguaaucccagcuacucgagagccugaggcaggagaaucgcuugaacccggguggcggagguugcagugagccgagauuacgccauugcacuccagccuaggcgacacagcaagaccccaucucaaaaaaaacaaaacaaaacaaaccuacuggaagacugagugccacuuggaagagacuguucauuguuccagggucuacagggaacacagaccuaucuuuuuaaagaucaaguucgguuccagagaaucuauuagaggaagaacgagggagcugaagagaguaggagaguauaaaauggaaaaugcauuaccagauucaacacuaacuucuccgaguuuaagaugugccugggcagcauaaagcugugcuucuuuuguuucuugccuaaaagaaggaaaauugaucaaaaaccuuaacaguaccugucuaacccuaacugguuucuauuuaaccaccaaacucccaacccaagccuagaagcaccaagaguuuuaccuuuuaaaaaugaucuuugcuaaauccagcauaucccaggcaagcucuagguucccaaucuccuccuccucauuuucuugaagagacuaaaguauaaccaaauaauaaaaagauaggcaucuuuuucaaauacaaaucuaaauguauaacuuagcguagcuuaaaaaaaguugauauacgauucaaaauuuggacuuucucccuaaaaucuagagaauggguccacauacugucuuaagucaugaccaugucacugauauuuuaacagugaaauguuggcucacauacuaacacacaagaaccccaggaucaaauauauccacccauccuaggcaugaauaaagggucccuaauccauaaucaagagacaguuaucuauaauaaucaugccuagggcugggcaugguggguuaugccuauaaucccaacacuuugggaggcugaggcaggagaauaacuugaagccagguuugagaccagccugggcagcacagcaagacagccgucuaaacaaaauaaaauuagagaacaaauuagccagacaugguggcagacaucuggagaccuagcuaucugagaagaugaggcagaaggauuccuugaacccaggaggcuaaagauacagugagcccugaucaugccagugcacuccggccugggcagagacagagauucuaucucuuaaaaaaauaauaaucgugccuaaacuagguaagcuacaguccugcaaacuagcugggcauguuggcacaagccuguagucccagcuacuugagaggcugaggugaggcgaucacuuaagcccgggucuaggcugcagugagccaugaucaugaucaccccacugcaauccagccuaggcaacaagagugagcuccagucucccaaaaacagaaaaaggcugacaacaguacugaguggcuaacaacauaccuuguuuucaaggacugaaucauuuggcauuucuucggucuuaucauuuucuuuaucauccucuucugagccuucaguuucuacaaguaaaaauuccucaguauugagaauauaacuaagaacguauucugacuagucagagauuccaauacacgucucaaccuauauucagauaggacaggccagaugcuaauccaagugaguuaacaccugaacugaauauaucgucagugggugcagucuaguucaaguguaaccuagacuaagaaugugcaaucuuagucuaugggucagaccuucagcaauuaaaaggcugaguguuucucuuauaaaagucaaccuggaccauucagaauaagaaacauuggcuacugccucuuauucaauggcuagaagcucccauucauucagccagaagcagguggagaccucagucaguguuucugguaucuuuaagccacucauuagauaauacuaauagccugggaaaguacgaaaguuaaauuauuccaguccauucugaucaagaaugcucaagagacuagcuuucccacaacagagauguggagcaaaaagcauaguccuuaccgacuuacaccaaugagcaugccacagacuccagccagcucuagcacauacagaauuugaguaaggaauacuauaaccccuauuuuacuccuauaccuuugcuaaugacaccucuaaaaucugcagccauauaucaacaccauauuucaccauauugaauacacucacaagucaaccaucuaaaggucaggcuccuaaucaauagcgcuacugugauuagacaaaucaacaauguuaagugauuaaaauaagcuuucuguuaacacaaacaacucaugaauuggauauaauaugccucucucugccaucuuucauuaugcauuuuuaacaccagcaaaaaagcucaaacacuaucuccaaacacucuuacuaugggaauauaaauauggcaauuaggacuuagagcaaucgucaggucaaaggaguuuuaucagcagcaaccacaaagagauuccguuuucaaagaagcuuagaaaauacuuuaacagggucaggcgcggugacucacgccuguaaucccagcucuuugggaggccgaggcgggcggaucacgaggucaggagauugagaccauccuggcgaacauggugaaaccccgucucuacuaaaaaaaaaaaccaaaaaacaaaaaaauuagccaggugugguggcaggcgcauguagucccagcuacuugggaggcugaggcaggagcauggcgugaacccaggagguggagcuugcagugagcggauuaucgcaccacugcacuccagccugggugacagagcaagacuccgucucaaaaaaaaaaaaaaaaaaaaaagauacuuuaacaaauuuacugaggacaucagggcauugccauugauaccugggcacaaguugggaaagguuuuaaaguaauggcaauggcugccaggcgcgguggcucacaccuguaauccuagcacuuugggaggccaaggugggcagaucaccaggucaggagauugggaccauccuggcuaacacggugaaaccccgucucuacuaaaaauacaaaaaauuagccaggcgugguggcacaugccuguagucccagcuacucgggaggcggaggcagaacaaucacuugaaccuaggaggcggagguugcagugagccuagaucacgccacugcauuccagccugggugacagagcaagacucugucucaaaaaaaaaaaaaaaaaaaaaaaaaaaaguaauggcgauggcuuucuccuuaaccuagcuccccaccauuccuugaagaugguacagauuccucaagaggaaccaguaauauucuucugaagcaauuauaggaauuuuaauuuaaaaauuugauguaaaacuuccaaguaauuaagauauuuuguuucaaauuagagguugucuucuaguauucugguaugaguaggaagagauaccagguaagaauagaagauaacaauaucaauuuaauuuuuccuacaaauugggaagaugaaguauuuacuuuucuaucaauuauccuacauauguaaaucuacuucagcuuuucugcauauucugcuagaggaugggcagaguuaauaagaccauccaucuggucuaacuuuggggaacuaagcccggacccacuuggaaauguggauaugagaagauaaugguguauggugggccaggugcaaugguucacaccuguaaucccagcacucugggaggcugaggcuaguggaucaccugaggucaggaguucgagaccaaccuggccagcauggugaaaucccaucucuaguaaaaauacaaaaaaauuagucgggccuggggacaugugccuuuagucccagcuacucaggaggcugacguaggagaaucgcuugaaccugggagaugcagguugcagugagcgagaccgcaccacugcaccccagcugggcauggugauacacacccauagucucagcugccugagagacugagggaggaagauggcuucagcauaggaguuugaggcugucgugagccaugacugcgaugccacuguacuccagccuggcaaaagagcaagacccgauucaaagagaaaaagaacagaccaauuaucuuuauuagaagcaaauguacagcccaacacauggcaaagagucaagagguggcaguaaacaggguuuuaauuuuuaagugaaaaaaacugcuuggaaguuuucugcagaauggugcugccacguaaagggaaauaaagcacagaaaguaagugguugaguacucaagccagaaguuuggguagcaggcuucuccuuacugugugacuagggcaaguuacuuaaaccccuuucucccauuucuucuuuuguaaaauauggaaaacuguauugucuuuacaagcagaacaguaucugauauacaacaccaaaaaaugcagcauaugaaaagccuggggcuuuuaaaauauaguuaacuuuuuaaauaagugacagauuuuuuuuuucuuuuggaagacagagacucgcuguguugcccaggcuggagcacagcggcaugaucucagcucacugcaaccucugccucccggguucaagcgauucuucugguucagccucccaaguagcugggaccacaggcgcaugccaccacguccagcuaauuuuuguauuuuuaguagagucaaaguuucaacauauuggccaggcuggucucaaacuucugaccaugugaucugcccaccucggccucucaaagugcugggauacaggugugaagcuacugcgcccagcccacgacaaaauuucuaagcaguggguguaggaaaaggaugaacacugucuucuucaaugugugguaacuugggaagaauaauauauucaaggcagaucuggguucagauucaguauuaugacccuaaacaagucauguaaccuuuaaaccucaaccucaucacuguaacuugggcaauacuaccuaucacauaguauuguuuuaggaucagauguaauguaugagaguucuaacaauguuaauuaugauccaacgaguuuucgaacaaucuguaagggacugugauaucuguauuguagcuuaccauucaaggucuuaggggucagccagcagagcuuuuuaccauccuugcucacaaucauuaagaucaagacaugggaguuuuguuuuuuugugugugugguuuuguuuguuuguuuuuugaggaauuuaguucugugcuuuuuuccauaaagaacuccuaaagcuccauuaagaaacccaauggugcuaccauuuuagccaauucauuuccaguuacugagccuguguuggcuggaguacagggaccugcacauagguagaaggaaguuuaccagaaugaguucaaaguauugaagaugggucucugaaaaucuaaaacuuacgagaacucuugaaguagucuggcaauuacaagaaguaacaauuaguuggaauauaccugugguuauuaaugccaauguuagaugaaacuuauauacaguagaauccucaaaugauagcaaaagucagacgugccaguuauguaauaauuagaggcuuauacaccuuaaugaaauuuaaucacacuuagaccaauagcauuauagaaagcauccacacuuuauaauauucuaaguaacaaaaauucaguuuagcagccgaagcaagcaugaaaugaggaaggaaaacaggaagagagcuaaugguuauguuuucuguugccuuggggaagguggggggggccuguuuuaacuaaugugaauaagccucuaaacacuuccugaagacuuaaagaggggcaccagaauucuuuaacucuggugauacaacagucaagguuaacugccuucauuuaaauggcaugccugcuucaguguaccaauucaguggauucuacugcucuguagcugcuucccaacgcacagaaaaggagucaugugaacaauaauuuuaaaauccagaggcaugcaagugaacauccauucagcauucucugccagccuagcccacuauuucccuaccuaccccaccccucaucuaccuuuuccaucccacuuuauuggcuaguaugcugcaacaaguuacugauagcuagccaagucucagaaaucacacagaaggccuauuuugcaguuaguaaaaguguuaguuuauaagccagcuaaagaagacuugcugcuuuugauugaacuuacuugacuaucacgaccuuguuaaacuaccccccuuuucauuuagcccuuuccuaauccaaaggcagacggaaaauccugaauggaaggcugacuuuuacccauaauuagugagucaaauccagaauguacuccacccacugcagcucuugcauaucccgguuaccuucacccucuuucaucuguucuucucucucuugugucucuucauuagcagcuaucugaacuuugucuucaggugauuucucaguagcucccugggcuaccuugguaucaaccccaucuccagcugccucagacucuucuacagacagcuuagucuccuccugacuaggaaccagcuuugcccugaccuucuccucuaguccugagccaucuuuuguuucugucagucuuucuauagaagucugugguucaauaggagucugaucuccuacaacugacgguccauugacugcaccauccuuagggagaacuggagccuccugcccaggcuuuucagagacuucugauccagccucuacagcugaggccucugcagccucuguugucaccucuggugacucuucagcaggugguacuucuugaccuaccaguuguucaagaaccgccuuuccugccucguuuucagagguaacuaccuucuccucuggcucguccccacccacauccacuggcuugacugucgggucuaaagacucugcuucuaccuccacugcagugcccugcuuuucuagagucaccacaggcugcucuucugaaacuucuuuuggcuucuccucuaugcucacaauuaccucucccugcuucuccugaccuccuuuuucucugcacucuucuuggacaucaguuccagaaacugauuuuucuuccucagcaucugguacuuccuguucuggcuucccagaagugaccucagcuucauucgguccuucuggugcugcuccuccuuuugccucuucagagguuucaguuaaccaaucuagagucaagucaacuuuuuccuguggcuccucugcagauuuacuuauauccauaucuucucuuccacccuucuccauuucacuguccuguucuuuaucaguuucaggcuuugccaaagacuugucuucuguuuuuuuggcuucuucuuuuucucccauggcgucauaaaccuguucucucaacucuucccuugcuuccucuacaugguuaaagaacaugaagcauaaacaugucuucgaguuuaaugauaaaggcauaaauggaaacuaaaaauacauucccuuuaaacccucaaaaagccuaccaaguuucagcagauggccuaaaaauuaucugcccccuagagaaaaggaaagggagcaucccggcuagcagagcaacuuacugcaaaagaaacccaagcuuguuacacuagguauuguuuuacuugagcauucugauuaccaguuagguaagagaugccaagcuuuucauucucccccaucugauauguaaaacuauagcagccaaauucagcuuagaaauuauauaauuuucgcacacauaaaaaauguacaagggcucuaaaaguacugcuauuaaaauaacugaacugcacaggcuguuuaaaaaaauuugcaucagaaaaacacuuaagguuguaauaguauuuaaaacaccaauuuaaucuugcuuuuaucuuuuugauuuaaaaaaccccaaucgaaauaacuggauuuacuugagaaaauaaguuauucucuuucaaaaaucugcugucagcuucaguaaacagcuauccccacugcaaucuccaccagaugcaggcaucaucaccccaagcaucuuaggagagaccauccaggacagguagagccccguuuccaccacuguauacaagaaauauacaacgucgcaucucuugaaugucacaugcaacuccacauaccaucuauguuaucauuauuuucuaccagagauucaucuucuguuuuuucuccuucuuccucuuccacaugcacaccuuccaaggcguuucccaacacaccauucuccauucuaggagaacaaaagaaagcaccaaagguuugauggcuagaaccuagcaauuuuuucuaagacagaaaauacaguccuauauuauaaaagcaagaaguguaagccaagcgcaggcaauacaaaacuauguauauucaaggaagcaaugaucaaaacuuuaguaauauaaauuaagacugcaagagcacugaaggaaauaagcauauuccuccauccagccgccugaaaagcaugucucuugucaaaagaacaagaccuauaugcauuccauuuguaauaggaccauacuauuucccaaacuuuguauccacccgauuucucuaaauagccaaaaauacucuagcaagauuuucacggcaaaucaugagaaaguucuguaugauuacgagauuaaaaacuuaccagagaccaggcacgguggcucacgccuauaaucccaucacuuugggagguggaggcaggcagaucaccugaggucaggaguucaacaccagccugaccaacauggagaaaccccaucucuacuaaaaauacaaaauuagcuggacaugguggcgcauacuuguaaucccagcuacucaggaagcuaaggcaggagaaucgcucaaaccggggaggcagagguugcggcgagcagagaucgcaccauugcacuccagccugggugacaggagugaaacuccgucuuaaaaaaaaaaaaaaaaaaacuuaucagaacugggccaggcgcagugacucacgccuguaaucccagcacuuugggaggccgagguggguggaucaccugaggucaggaguucgagaccagccuggccaacauggugaaacccugucucuacuaaaaauaaaaaauuagccggguguggugacacaugccuguagucccagcuacucaggaggcuggggcagaagaaucacuugaacccggaagaugaaggaugcagugagccgagaucgcgccacugcauuccagccugggugacagacugagacuccaucucaaaaaaaaaaaaccuuaccagaacugagauuaaauagaugacaucauuugcuaguuuguauacccuaaacagaacuuauucugauuaauaaauucugauagaacauagccaagaacuuuucaauaguaaaagucuuuuuuacuggacagucucacuugcuaauucuuuccaguuguccucuauucaguccuuguuuugagcuagcucacagugcuuuuaaagauucucuacacugaacuuuggaucauucacuacuggaaagaacuuugcuucuacugacuccaaaagucaaaacuuaaauauaacuacuaauuguaucaagugccauucacaacuuccaucacuacuucaagcuccuucaaaacucucuagguaaaaccaaucuugcuuagcuccugugaaaucucaaagcuaguaaacaaucuuaacaaggaaacuucaguuuuuaaauacaacauccauaccuugccaacuccagaagugauuucccauagaaaaagaaggcuucuccacacucauuagcugucucuccauacuucuuaccucuacaaagagaauaaacaucuaaaaucugaauuaccaucuaaucuaaaacauuuaguucuaguucuucaguuauaaauugauauuucuccaguaacauacuccuagaaaaccaauaccccucuugcuuucaaggucaaagugacauuaaacaaugcaugaaaauuuuguaugcucuuuaucaauauauaauauauauacauccuaagugacauaaaugugcuacaauuaguaauacauaauguagggccaaacagcccuaagguauuaauagguauuccuccugcuaaaagauggaugucaguauggaucagaauaguuaaaggaccuuuggcugggaccuagaggaugauuaaggcccauggaaaggcaugauguaaagcgcagaauaucuggaguucuucuaacuggauucaaauccuaccuuuaacccauaacuagcugugagaccuuagacaaauuauucucacagugccuuaguuuucucaucuguaaaaugggaauguuaauaacuguuuguucaaagagcuauugcaagaacuaaaugaguuaauguauguaaaagcacugaaaacaauguuuagacaacaaauagcacuguguauuaagucuuagcuauuaauaucuagacagaaggaagaaggacaaaaauuacguaaguauaaugaacaaaaggagaaaguacuucucuauguaagguaagaagacuggcuuucauggaguaaaauacuggcagaauucaugcaaagucaggccaacuaauggccuaagagucuauugagaguaacuagagaaucuaagcaguaaauugugauggaggucauguuuaaggguagucuacuagauuagaauaagacaucucaaauuuuccuccuaaauacccuuaauggcaggaaagugggaauacugaccucuccaguaaucugggaaaaauaaccuaagagaaaguauuuaugugugcuuaaaaacuuagguaacauuuuauguuguaagacaaccaugcauuuuuaaauaaaaauaccuaaauacagcugggcacaguggcucacgccuguaaucccagaacuuugggaggccgagguaggugaaucaccugaggucgggcguucgagaccagccugaccaacauggagaaaccccaucucuacuaaaaauacaaaauuaggcaggcguggugaugcaugccuguaaucccagcuacuugggaggcagaggcaggagaaucacuugaaccagggaggcggggguugcagugagcugacaucgcgccaucgcacuccagccagggcaacaagagcgaaacucccaucucaaaaaaaaaaaaaaaaaaaaucucuaaauacuaccagauaaaauuuagucucucagagccccaauucauuaaggucaaacagagaggaacaaagaggacaggaaucagacaaaagauuuuugcagauauccaggaguaagauucuguucuggauguuggcagaggcaguagggguuuaggaaaagaauggauugauauuaagcgucaaaccugaaacccacaaacgcuuuguuauaaccauuucuuuuauaaggaagauuuaacuuaacuauauguaauguaaucaacuguauguaauguaugcaaugauugaccuucaaguucaauugcaauugcuaauacuauauuugaggaaacucaaaccucgccauagaccaaaagccuguugcuugacgauuuaacuugcuuuuuuuucucucagauaauggagguacauuaaagucuuuggggaaaauaaaugaucuuuaaggcacuaaagcuaaccuuuuccuccaggauauaggucuauauggcuaccuggugguagcuaccaacuucuaagcaaauccaacaacagugcuaagaauguaugaaaaaugugcuaaaaauguaugaaaaaaugcugugcuaauaauagcacuaucaaucaugacuugcuuggaccuaaagaguuuccacagacacagaacuucuaguguuaaaacucggaaagucaggcuggggcucaguggcucaugccuguaaucccuuugcaaagcacucugggaggccaagguggacgaaucgcuuaagcccaagaguucgagaccagccugggcaauguggggaaaccccaucucuaccaaaagaaauacaaaaauuagcugggcaugguggcacacaccuauggucccagcuacuggggagccugggagguugaggcugcagugagcaugagauugugccacugcacuccagccugggugacagagacccugucucaacaaaaaaaagcggggguggagagauggggagagggguccuagauaaaccaggacaagguguggucacccaaauuaguagugacuggaauacaaauuacauacucaggaaaaugaaaggguggaacugcuuggugauauuuaaguuuuacacuuauaguuacugguacaaaccacaugaaaaauaaucaaauguuuuaaaacucuugcucuucaugcuuuuuccccauaaaauaauuuuugauaacucaagguuuauuagaacauaauauuacaucauagcaaaauauacaauacuuacaaaagacuagcugcuuccuggaaugcauugacagcugcuggaauaucccccaucaccagauguuucuguccuaaacccaauaguuucuuagcuucacuauccacauccagacugcaaaaaaaagauuuuuucuagugucaaguacuguuuaaaucaguauuuuuugaauaccugcuacauuugagcaauaguuucauuuuuuaaaacuuuuggacuacucuggcaaggccuggcuaacacacuuauuuaccaucacaaaaucaaaagaaaucuuaaaggcaacauucccagaagccugacuagaguauuuucucaguugggugcggugacucaugccuguaaucccagcacuuugggaggccgaggcgggcagaccacgaggucaggagaucgagaccauccuggcuaacauggugaaaccccgucucuacuaaaaauacaaaaaauuagccgggcgugguggcgggugccuguagucccagcuacgggaggcugaggcaguagaauggcaugaacccaggaggcggagcuugcagugagcugagaugcgccacugcacuccagccuggucaacaaagcgagacuccaccucaaaaaaaaaaaaaaaaaaaaaaaaaaaauucucuuaacggcucaucuaaucacaaagccuguauuguauauuacuauaaauauuuccuaauugauccacaaauaaaaaagguaucauaaaagaaccauaaauucauacaaauugcacuagcuaaaagaaauauuaaaauuaagaagcauuuagguaaacagggcaagaggcagugauuucaagauuaagacaauguaguauuggcauaaagaaaaccaaauggaucaaauagaacacagaguacaaaaacagauccaugcauauaugacugacugaaauuuugaaaaagguaccaaggcaaugcaaugaggaauggauaaucuaacaaauggugcuggaguaauuauaaauccacaugcaauaaagugaaccucaacuguuaucucauaucucauacaaaaauuaaucugcaauggaucauaggcuuucuaaauauaagauuuaaaccauaaaguuucuacaagaaaauacaggauaaaaucuuagugacuuuggcuuuggcaaagacuucuugaauaugaaagaaaaagcacaaacuauuaacaagaggaaaaaaaaucaauaaacuagacacaccacuaaaaugaaaaacuugguuuugaaagacacuguuauaaaaacaaaaaaggcaggcccaacugggagaaaauauaugcaaaacuucugauaaaggacuugaauauauaaagaacucuuagaacguaguaauaaaaaacaauccaauaaaaagggggcgaaagauuuuaacaaacaugucaucaaagauacacagauggcaaauaagcacaugaaaagaugccaacauuauugcucacucaaaaaaauacaaacuaaacccacaauaagauacugcuauauucacuauaauagcuaaaauuuuaaaagacugaccacauaucaaaugauggugaggauguagggcaacuagaacugucaaacacugcugguaagaauguaaugguagaaucacuuuagaaaacaguuuggacguuucuuaaaguuagauauauaccuaccauaugaucuagccauucuacuccuaggugugaacccaaaaaauggaaaugaaugcccauacaaagacuuguacacaaauauucacagcagcuuuauuuguaagccaaaaacuggaaacccaaauggauaaacaaauugugauauaucuacaucauaaaaugucauucacuaacaaaaagaaugaacuauuaauacaggugguaacauggaugaaucucaaaauaauuaugcugaaucaaagaaacuauacaaaaagaaacaguacuuacuguaugauucuauuuagauaauauucuacaaaaugcaacccaucuucagugacagaaagcagauuaaugguugcuggggagggaaugaaguacaaaggcacaugaggaaaaaacuuugaggugaugaaaauacucauuaucuugauugugauaaugguuuacagguguauacauauguagaaacucauaauuguuacuuuaaaguuaugugcaguuuccuguaugucacuuagacuuucauuuaauguuucuuauagcuuuaagaaaaaccugggucaaaagagcaagagucagugacauuuuaaguuccauuaaugaaaaccaaauuauuuggaaggauaaucccucuucuuaauucaaucaacaauacuuggguaccugauauugcugggcacaauuccagacacugugauuauaacaagaaugagcuaagaccacagggacaaugucaaauugaagcagagaacuuaagaaggcaagccaaaaaaaaaaaaaaaaaaaaaauacagaggaaaagcacucuaggacagaggcaauaguaaguucaaagcucuaaaagaagcuugcuuaaaauauuugagaaacagaaaacucuucuggcuagaguaagcuggggaagaauuaugggaaauaaaggugaggaagagggagagagcagcaucacauuaguauagacuuuaagauagaacaagaacagaacuggggagaaaaccaguuggaaagaaagucuggccgggcagcaguggcucaugccuguaaucccagcacuuugggaggcugaggcgggcagaucacaaggucaggaguucgaaaccagccuggccaagauggugaaaccccccucucuucugaaaauacaaaaguuagccgggcgugguggugugugccuguagucccagcuacucgggagacugaggcagaagaauugcuugaaccagggaggcagagguugcagugagccgagauugugccacugcacuccagccugggugacagggcgagacuccaucucaaaaaaagaaaagaaaagagaagaaaagaaaaagucuaaggcugagcaugguggcucaugccuguagucccagcacuuugggaggcgaaggugggaggaucacuugagcccaggaguuagagacuagcaucucuauaggaaaauacaaaaauuagcugacaucacgguaugcaccuguaguccccguuacucgcaaggcuaaggcaggaagacuguuugagcccaggaauucaaggcugcagugaacuaggaucacacugcugcacuccagcgugggcaacagagcaagacccuauguccaaacaaacaaacaaacaaacaaacaaaaacacucuuucucuauuuaaaaaaaaaggaaagaaaccguaaaaaucuagacaggaaccugaggaguauuagagaggguuagauucugaauauacuuauuuuaaaauuugcuaauggacuagauauauaauuuauugaaugaaagaggugaagcaaauguuuuuuuggccggggcaacugguauuaaguguuaauaauggacuauguagaaauuuuaucuacauuuaaauccuaggaucuacaccucauaaaguuauugaauuauuacccccacuuuacagauggaaaacugaauauuaauggcagcgauucaaaucuacacaaucuagaugaaaaguucuagaacaacauugccacugacugauuaaaaagucaacugaaggaaaagccagugagaaacaaggcaaucaauuacuguacaguauuuagcuuuggauauguuaauucugagaucccuauuagaccuccaagauauuaaaagggagaaauuugggagagauauggggacuggagauacaaaugggagagucagguacuuaaagccacuggacuuaacagaggagaauacacagggaguggcuacuaauaaagacguuguaggacugacugagcccugggagccuuccaacauuuagagguagggacgacaaggaagaauggggguugaggggaauagccagugaaggaaaagagacaagaaaauaguaugaagaaaacuaauggguccaggcacagugacuggccaacauggcgaaaccccgucucuacuaaaaauacaaaauuagccgggcaugguggugcacaccuguaaucccagcuauuugggaggcugaggcaggagaauugcuuaaaccugggagaaggaggcugcagugagccaagaucgugccauugcauucaagccugggugacagagcaagacuccaucucaaaaaaaaaaaaaaaaguaacaggaguaauggauugggucaaauguuacugacaagauuaacucagagagcugagaaaugacuacuagaguaaggaauauggaugguacuaaagaccauaaacaagacuauuuuaguagaaugguagagaaaaacuugauugaagcagcuucaauuaagaacaaaaguaguagcagauaaacagaguggacaccuuucacauuuuccugucaaagaaacugaugugagguaauagacgaagggaaguaugagggggucaacaaacgguuaaaucugaugauaccuagugggcugauauaaguaaucucauaggaaacaagaagaguauuguugcauaaagaacuaaaggaguucuauuauuaaguaaauaaugagugggaucuugugaacaaacggagaugcugguguuauguaagagcaaagaaacuaugaugucaggauccuuuacacuguuacguuacugaagccccccaaaaagccucuguguauccaaguuauaucugucaguauuugccauacugaaauuaaaacuaaaauaauuuuaaauaguuuaaaauguuacauguuaauaacaugacuuucuuugaaaaauaacucuucaaaacaaaaauuugguaagaauaguggcacuguuuuacauuuuuacaaaucuccuaaaugucuguuaguagaagagaacaggauuuucauauucacuacucuaccguguuuucuuuucauuaaaguacaggaauaucugacuugauacagauauguaguuggaaacagaauauuuaaacaguccuuucagauaacuggauauucuucuguuaccacacccaaacccaacaaguggucauuugucuuaaaaaaaaaaaaaaaaaaaaaaaagucuugcucugucgcccaggcuagagugcaguggcacgaucucagcucacugcaaccuccaccuccuggguugaaaccauucuugugccucagccuccccaguagcugggauuaaaagcgggcaccaccacacccagcuaauuuuuguauuuuuaguagagacgguuucaccauguuggccaggcuggucucaaacuccugaccucaagugauccgcugccuuggccucccaaagugcugggauuacaugcgugagccaccaugcccagccaacaagugguaauuucuuuuuucuuuucuuuuuuuucuuuuuuuugagacagcgucucacucuauugcccaggcuggagugcaguagugcgaucucagcucacugcaaccucugccucccagguucaagcgauucuccugccucagccacuuugaguagcagggauuacagggacaugccaccaugccccgcuaauuuuuguauuuuuacuagagacaggguuuuaccauguuugccaaacuggucucgaacuccugauucucucgccucagccucccaaaguacugggaugcaggcgugagccacagcacuugaccaacaagugguaauuucuuaaagguuaguuguacuguauaaucugaaaacacugaugaacuucucauacugguacauuaaaaaccagucuaucuuguauucuagaucuucuacuuaugaacgauuacauaaacccaacgucacagcagcaguacucacaauaaaaagcaaggaaauucugacacaccacaacauggaugaacguuaagaacacuaugcuaagugaaauaagccagucacaaaaagguaaauauucuauuauuccauuuauacgagguaccuaaaguagccaaauucagagacagaaagcagaauggugguugccaggggcuagggaagacagaaagagggaguuguuuacuggguaauaguuucagauuugcaagauaagauuggguauacgacaaugugaauuuacuuaacacuacugacuuacacgcuuaaaaagauggaaaauuuuauauuauauguguuuuaccacaacuuaaaaaucaauuucaucagaacagucaaaguauuaggauacugucagucucacaacagcaguugauauauaacuuauccaaaauuuuuauuuuucaugugaaagcucacauucuaucacuagcacccaauacugucaguuauuucccuuaaagugacaggcucacuguauucauuuuggagaaaacaucugcuaaguaucaagucuaaauaaaaguuugucuguuggucauucuuucaaaaauaaaacuuucaaauaaaacauucuuucgaauaaaagccaguaaaguuacaugaaaaaaguagcucaaucaacucuuaaucacacaagggcuuuucauaaagaaaaccaugguagccacuuuugauaugcugaagcgcuccauccauaauuccuauuuugccagguuaccuuaaaaccauguagucaaggacugagaauuaauaaacuucaguuuguaacgcuucaucauggacauuuucuaagugaaggugauagugaagaacacaagaauugcuaguacuauuuguugccacugccuugauuuauguuaagguaacagcagguuuauccaccauuacuuuugcacaaucacugccaguggucaaaaaggcagucuuguuauuacaauaacaguuuugaucuuacauuaucccugaaagaguacuggagaccccaaagguauacaagaaaaaaacuuugagaacugcugaauaagagcaugaacaggcauucaaaaggagagacuauaugggcacagauuuauggcacaguguuaagaaauuucucuucauauuguuuauucagugaacaaacaaaaauccagaaccaaauauaaaacaaaggaaaaucaucagguaaaagcaagaugacggguaugguguugaauguuuaagaauauauaaagaaaaaguugaucagcugggugcaguggcucaugccuguaauuccaacaacucaggaggcuaaggagggagcaucauagggagggcagaaguucaagaccugccugagcaacauaauaagacccugucucuaaaacacacacacacacacacacacacacacacacacacacacacacacacacacacacacaaaacuuagucuggcaggcugaggcaggaguaucucuugguccaggaguuugaggcugcaccaagccaggaucaggacccacuguacuccagccugaguggcugagcaauacccugacucaaggggggaaaaaaaagaaggaaagauuaagcaguuccgcagaaugggaaaacaacuugaccggagaaaugcgguauaacugccaaucaaaacuaaaaacccacuucaggucagagguuauaaauuuaaggugagacuaauaauguguuuuccaaccauccuucauguuucucucagaaucagaauauucugguccucuaaaaaucaaaugcuuaugccaagcauaguggcucacaccuguaaucccagcacuucagguggcugaggugagaagauggcuugagccccagccugggcaacgugacgaaaccucaucucuaaaaacaaaauacaaaaauuagccaggcauaguggcacacaucugugauccuagcuacccaggagucuaaggcaggaggaucaccugagcccagggaaggucaaggcugcagugagccacgaucgcuccacuguacuccaaccugggcagugaaguuuaauacugaugauuacauaucaagcacuguguuuuggauagccuagcuacauuuagucaguccagaaacuuaaauacuaugguacauccuaugaguaacccccuugaaaguauuguguuuaggaucaacccuaaacaguauucaguauucauaccacccaaauaccagauuaacucacaagaaauuuuguuguuguuuguuuuuuuuuuuugagaguuucgcucgucacccaggauggagugcaguagcgugaucuuggcugacugcaacuuccaccucccggguucaagugauucuucugccucagccucccaaguagcuggaauuacaggcgcuagccaccacgaccggcuaauuuuuguaucuuuuuuaguagagacgggguuucaccauguuggccaggcugaucuugaacuccugaccucaggugauucacccaccucagccucccaaagugcgugagccaccgcgccuagcccuauuuuguuucuuuccuuuuuuuuuuggagacagggucucacucugucacccagacuagagugcaguggcaggaucauagcucaccaccaccucgacuuccugggcuuccgcaauccuccuaccucagccuccccaguaucugggaccacacgcaagugccacaacgaacaguuaauuaaaaaaaaaauuuuuuuuuuuuguacagauggcgucuugcuauguugcccaggcuggucucgaacuccuggggucaugugauccucucagagauggaggucuugcuuggccucccaaaguguugggauuacugguguaagcuaccacacccagccaagcaguauuucauaagacuuauuuuaacccuuuucccguuuaagagaaaaaaaaaaaaguacagcucauugccagcacucauuuaauuuuacauaaacauguucuuugaagcugaagcaaaucugacuuucagcaugaaaauaaaaauauaaaacuguucucggaguuuuuuuuuuuuuuuuuuuuggggggggacagucucacucugucacccaggcuggagugcaguggcacaaucuuggcucaaugcaaccuccaccucccagguucaagugauucucuugccucagccucccgaguagcugggauuauaggcgcccgccaccacgcucaacuaauuuuuguauuuuuaguagagagaggguuucaccauguuggccaggcuggucuugaacuccugaccucaagugaucagcccacuucagucucccaaagugcugggauuacagacaugagccaccugccuggccggaguuauuucuaaacacaacuaauaucagaaucgccuauuucauaaaaauuggauucaucaaaugaaucuuuggccaacaaccauuugagaaugauguuaacaucauacauaggaaugcuacguuuucuaggauuugacauuuacagcaaucgagaauuacccuauuuuguaaauggaaauaaccauuacuaaaaacagagugcuauaaacagaaugaugucuuuuuauccaaaaucuauauauuagagugaugugaaaauaauaauaaaggagagcuauuucauggcaguuuucacuggguaaaugcagcagccccaagcaccaccagcaaguauucucagggcaaaugggaaaaggguuaaauaaccaagaugacaacaggauuucaaacaugaaaaacauaaaacccuauggacgcuuaaaaaauguauuuguggccgggugugguggcucacgccuguaaucccagcacucugggaggccaagacgggcagaucgcccgaggucaggaguucgagaccagccugaccaacauggcgaaacccugucucuacuaaaaauacaaaaauuagccgggcaugguggugggugccuguaaucccaacuacuugggaggcugaggcaggagaaucgcuugaacccgggaggcagagguugcagugagccaagaucaugccauugcacuccagccugggugacagagugagacuccaucucaaaaaacaaacaaacaaaauauuuguaagauauucuaacaguaauaauucucaaucuuaucagaaagcuuuuccauaacacaugaacccaaauuuuaucucaagcucaacaaauaaaaucagcugggcaugguagaucaggcugguaaucccaacacuuagggaagccaaggcagggggauugcuugagcccagguuggagaccacccuggccaacaaagcaagacuccgcuucgaaaaauauaauucgggugggcacaguggcucacgccuguaaucccaacacuuugggaggccaaggcgggcagaucaccugaggucgggaguucaagaccaaccuggccaacauggugaaaccccaucucuacuaaaaauagaaaaauuagcuggguguaguggcacccgccuguaaucccagcuacuugugagacugaggcagaauugcuugaacccaggaggcagauguugcagugagccaagauugcgccacugcacuccagccugggcgacaagagugaaacucagucuaaaaaauaaauaaaauaauuagccagaugugguggugcaugccuacagucccagcuacucaggaggcugaggcagaagaaucccuuuagcccgggaguucgaggugguggugagcuaugauaacaucacugaacuccagcuugggcaacagagcaagacccugucucuaaaaaaugaaacaagaaaucucuagggauguaaccuaccaucuaccuuuuggguaagcuuuuuaguuaauuauuaugcccaccucugauuaagaaacauagucacuacggguguagaucugagauaaagaaaaacaaaaaaccauagccauaucaagauggaaacguuacagggggaggaggugagacgggccugguaguucacaccuauaauccuacacuuugaaaggcuuaggcagggaggaaugcuugaggcuaggaguuugagaccagccuuggcaacauagcaagaccccaucucuccaaaaaauuuaaaaaugagcgaaguguaguggcaugugccuauaguccuagcuacucaggagguugaagugggaagauugcuugagcccaggaguucaagguuguagugagcccugauugcacacugcacuucggccugagcaacaaagcgacaccuugccucuaucaaaaauaaauuaauuaaaaaauaaaaauaacuuuaaaguuauauugcucuuaguuuauguuucugauacgaaucuaacuaccauguaaauaaucuuaccucuccacuuuaucugcagauguagaaggagcaggaacaucuucaauucuguaauaaaaaauuaaaggggaaaaaauguaaaacuggaggcaauuauuaagccugaaaauaaaauaaauucagaaaaauauaaaggaauaaaagagcugucauuuauuaaauacucaaguauuauuuacuuacuuacauuaucaaauuuaauucauuuaauucuuacucacucaaauauccagggcugaaaauaaguggcaacuucacagcuauaaccacagggaugaggaacaacuuaaagggcagugcuuucagcuacagguuguaagcuaucugggccauuugccuagaaucuugaaauggucuuggauccuuaucuacaaacuccgucacagccagucauguauaucgaauaguuuuauuaagaggucauucugaccaaauggucuagcacagagccucucaaacuaccugugguuaagggacuaggucuuuuauuucccuauauaaccuucuauaacacacagguuuuuuuaaauacaaugucagggagauaucacagcgagacuccgucucaaaaaaaaaaaaaaaaaaaaaguuacacuaugacugcaauauaagacucugaauugaauaccauuaaaagcaaggaaccaguaaaaacacuauuaaguaucauuguaaagcauuuaucagugauaaauuucuuuucuuuuuuuuuuuuuuuuuugagacagagucuugcucugucgcccaggcuggagugcccuggcacgaucuccggcucacugcaagcuccgccucccggguucacgccauucuccugccucagccugggccuggugccaggccggugccugugcaccggccaccaugcccggcuaauuuuuuuguauuuuuaguagagacaggguuucaccguguuagccaggauggucucgucuccugaccucgugauccaccugccucggccucccaaagugcugggaauacaggcgugagccaccgcgcccggccgauaaauuuauuucuauucuugcuuagcacaagccuagacaaauagaaaagagggugaacuaaggcaguacuuguauaguuggaaaaaaagaugaauuaaagcaguguuucucaaauuuuagucuguaugcaaaccauuuggaggaacgguuauaacaguuugagcuccacccccuacaguuucugagucagaagguuugagguaagguugaagaaucugcauuucuaacaacugcccaggugacacacugcugguuucuagaaccaugcucugaggacuacuggaucagaauaaaaauuauaaauggauguucauguccuaucugggcaauagguaugucugauucaguuuuguuuuguuuuugagacaguccuucucuguugcccaggcuggagugcagugguaucaucucagcucccugcaaccucugccuucuggguucaagccauucuccugccucagccucccaaguagcugggauuacaggcgcccaccaccacgccuggcuaauuuuucuguuuuuuaccagagaugggguuucaccauguuagccagucuggucucgagcuccugaccucaagugauccucccgccugggccucccaaagugcugagauuacaggugugagccacugcgcccagccugauccaguuauuuuuuaaaauguuaauucuaauagucacuacauuuacaacuaugaagcuauggcuucauaguuuuaugacguucauuaugaauuuuuagaaugagcaugaauccagagaaguacuagaggaaaugauagggaaauuacuugguaauuuguuuggagaaggccguuuuaaacccagaaaccagacugggugcaguggcucucuccuguaaucccaacacuuugugaggccuagguagguggacugcuugagcucagggguucaaaaaccaaccugggcaacacagcgagaccuaucucuaccaaaaauaaaaugagaugggcauggugguacaugccuguagucccagcuacuccagagacugauaugggaagauugcuugagcccaggagauagaggcugcagugagcuaugaucauaccacuauacucuagccugggugagagaguaagaccuuguuucaaauaaauaaacaaacaaaccagaaaccauaggauauugacagauucuacuccaucuaauucauuucacaaaagguuaacuuagcaaauauacauagaaucuuagucaacaggauaaaaaagcccaaugggaauagauuaauggauuuaauauaaacacucacaaacaaacaaacaaacaaacaaacacuugaccaccugcuacugcucauucuuuuguuuuugagacggagucucgcacuguugcccaggcuggagugcaguggcgcgaucucgaucucggcucacugcaagcuccgccucccggguucacgccauucuccugcgucagcuucucaaguagcugggacuacauuuuuuuuuuguauuuuuaguagagaugggguuucaccguguuagccaggauggucucgaucuccugaccucgugaucugcccaccucggccucccaaagugcuggauuacaggugugagccaccgcgcccggccgcucauucuuaagagaaacaaaaaaacuauacuuagaaaguauguuuuacccaucgaauagucaaagauaggguuaaggagaaauuguacucccauacauugcuaacagaaauucaaggcuaggcucacagcuauaaucccugcacuuuggaaggcagaaggacuguuugaggcuaggaguuugagaccaggcuaagcagcaaaaugagaccccuucucuaguucaaaaaauuaauuuuaaaaaaagaaguguagccugggcacgguggcuaacgccuauaaucccagaacuuuggaaaggcaaggugaguggaucaccugaggucaggaguucgagaccagccuggccaacaugguaaaaccucauuucuacuaaaaauacaaaaauuagccaggugugguggcgggcgccuguaaucccaacuacuugggaggcugaggcaggagaauugcuugaacccuggagguggagacugcggugagccuagaucgcaccagugcacuccagccugagcaacggaguuagacucugaaugacuacagucaugcgcaaccacgccuggcugauuuuuguauuuuuaguagagacgggguuuugccaugucagccaggcuggucucgaacuccuggcuucaagugauaugcccguguuggcuucccacaguguugggauuaccacgugagccacaccaccuggcccuuuuuuuuuugagauggagucuugcucugaggcuagagugcaguggcacaaucucgacucacugcaaccucugccucccgguuucaagcgauuacaggacccugcuacccaugcucggcuaauuuuuguaaacuguagucucagcuacuugggaggcugaugcacaagaaucgcuugcacaggggaggcagaaguugcaguaagccaagaucuggccacuacacuccagcuugggcaagacaacaagacucucucuccaaaaaauuaauuauauauauauauauauauauauauaugaaaaaacucaagacaaaccucauagccuagaaauguugaauuaacaaaauguauguaaucaaugcauaaaagauauguagguacuagucuucuucacuaccauaaaauacaaauuauaaaaaguuaaaauucaucaaaacacacagaccauacacggcaccauccacaguugagauauguaaaugaacaaagaugcaguauuaaaucauaacugcagccgggcacgguggcucacgccgagaccggcugaucaccugaggucaggaguucgagaucacccuggccaacauggcaaaaccccaaaaaauuagccagguguggugguacacaccugcagucccagcuacuugggaggcugaggcaagagacuugcuugaauccgggagggcggagguugcagugagcagagauugugccacugcacuccagccugggugacaaaacucccucucaaaaaaaaaacaacaaaaaaaaaccaacuaagaacuaguuagaaagcuaagaaugacaggauuaauuuagcauguagauauacaucaccuuaaacaauacugcuuuaauggcacgaggggacaaaagccaaccuaagacuuuuugcagacgacaaaacugugguccaauaucacuacugaagcaaugaagcugcuaucaaagccaauucuaagccaggcgaggugaugcaugccuguagucccagcuacccagaaggcugagauggaaggauugcuugagacuaggaguugggaauccagccugggcaacauaguaagauccucaucuccuaaauuuaaaaaaccugaacugagguuuauuucucauuccauuuuuuuucuuucuacugguuuggaaguuauauuuauucuuucaauggucauccucgaauuauaauguacauucuuaccuaaagucuaaauucaagucauuuucuuuauccuacccuuaaacaugaggaccuuauaaacuuuaccucuaaguguccccacuaacuuacuuaacugagacacacugcuuucauguucucucacacuaauuagauggggaaacgaagaaugaaaaugaaaaugaaaauacuagccaggcuugguggcucacgccgguaaucucagcacuuugagaggcccacguggguggaucccuugagccuaggcguugggagaccagccugggcaacauggcaaaaacucgucuuuacaaaauaaauacuagaaucagcugggccuuguggugugcgccugcagucccagcuacucgggaggcugaggccggacaaucacuugaggccaggagguaggggcugcugugggccgagauggcaucacugcacuccagccugggugacacacacacacaccacacacacacacacacacacacaccacacacacacacacacacacacacacacacacacacacacacacggcacgguaggggcugcagggggccgagauggcaucacugcacuccaaccugggugacagagacccugcccccccacccccacacacccagcacauauaauugcucaguuuuagcuuucaauuuaugcugugaggaacuaaaugguuugcuuucuucuagccacauauacauaaacuuucucuauguauaaccugccaggaaacuaaauucacuaaugaccuaacucuggcuagacacaggggaccugcaagagguauuuguugcauacuucuaccucaaaaaacaaaaacaaaaacaccuggcccugcgccgugccucacgccuguaaccucaacacuuugggaggccaaggcgggaggacugcuugaguccaagagucugagaccaaccugggcaacauuaagaccuuguaucuacaaaaaauuggccagguguaguggcacaccuguagucccaagcuacuagggaagaucaguugugcccaggaguucgagguugcagugagcuaugaucacaacacuacacuccagucuggaugugagauccagacccugucugcaaaaacaaaacaaaaacacacagcugucagugaaauacugacugcuagagcugucuaggaaacauuauaaaaagcagcucuuuuuauaauagcuauagcacgacucccaagcccaaucuauacugcuuauaucgaaucaauggggaaagaggcagguaaugggaguuugaaauuaaaauuguauuucccaugaguucccaaaugauucucagggugacuugagaaccacugcucuacaagaacgcagagagaaaaggugguaagcagagauauacguaaaucucuaacuauaaacaaacaaagacauaaucaugacagaguguaagccuauagaauaucaauuuaaaaaacuucacagcaaccauuccuuuuacagggaaggcaacuaaccucuaaagcgcacaagauuagaaaaaaaaauagaaccagaugccuaaaaaaauauggcaagauugggaaaucagaccuacuguaugggaaacagcacuuguuuccuugaacucguguaguguuucccuccacuguucaaaaaacagauuacgccugaguggcacugugccgcuuucaaaacaauccuaucuuguuucccuccaguccuucuccacuucgugcauacuacugccgauucaccuagcaaccaaacagugcuggugagagcuccagacagcgcuuccugaagacgcuuuacguccgguaauguuccccccaaacagacaccaccuccaaagucuaaagaacgacaauccuccccaccacaggcaggggcucacggagucgcggggagcgauaacuaucucccagcacaagacgugagcgaggugucggggggaacuagccucgccggccccacggagauaguccaaagcuccugcuggagccgcagcggccccaaacaauggaguuuucccgccuccucaaggccccgcccccugccccagggccggcgagggaagcgaacgcacgcgcgcaaaaccccgcccucagcaaggccccgcccaccccgaccccucagguccagccuccuuccucgugcaagguuuuuuuucccuuuuggcgccaaaucuucguugguuauauucccggguuauccagggguucuaccagaggcacacgcuggggacagaaggggcgugaaggccaacccgcgcgccagggccccgccucccggccaaccgccccgggcugggggaggaaggagaggggcaggcgaaggauacagccgccgcugcccccggcaagauggcggccgcgaaaagcggggcagggggcgccagccgaccgccguuaccgcugcugcgcgaggcucucagcaaaagaaggacugcuccagugaccaggccuucccgaacagcgacagcugcucuugggaaggcaaguacucccgcccaccggucugccccuucuccggagcccccguccauuagcccuccccgcggacuggccagugccuuaagcuuuccacagucccgcuuacuugucggcagaaaccagcuccgcggcgacggcggcaguggcuguggacuccauggccaucguuccccugagguggcgaaccagcgaacggaauagagccugcgagaaaaacaggcaauuugggacgccagagacucacucagggacagaaaauggcagauuagagaccccgcgcggccggggcccuuuuauauacgaggacccuucgccccgcccauc

SEQ ID NO: 191401 - RNA, 112170 nt, Homo sapiens
aucgcucggcggucuucucuucuccaugggucugcucugcgcguuccaucgaguuucucggccaucgcgcgccugcgccauugggcugucagucagaggcggcguggagaucgcugggagcgguugcggcgugccgggagcugaguuauagcugugacuucugcccugccaggccgcacacaagcuggcugacccgggugagcagugcgguggggccacucaucugagggaggcgggcaugucgaacugggccgagguggacccgaagggguaggagagggugcugagccccgaaguugucagcucgacucccugcucgacccgguguagcuguguccgaaguagaagggagguuggggaugagaauccgagccaaccaccuuaugcaacagauggaggaacuaaguuucuaaucucagcuacucgagagucugaggcaggagaaucguuugaacccaggagguggagguugcagugagccuaauucgcgccacugcacuccagccugggcaacauagugagacucuccguuucaaaaaaaaaaaaaaaaagaaaagaaaagaaagaaacgaaguuucggggaggguucugcuuaaagucacagcgagugagcgagcaccagaccgguaccagacgccuuuagcacugugccugcacucuuucagccucagcccuucauucauuuguucagccugccuuuaguuguuuggaugcagggcagugaaauauagggaggagcagugaggucucugccuucaggcagcacacguggaaugacagaccaauucugauacaguuuucuuaucuauuuacaacuggaaaaggcaugagugcuaugaugcaggcaagucugagaugcggugaacacccucuccaaagcuugggaggcagcgagacucguugccaugauucccgucagccauagucguggcagugacaugagcauuugacagucugccugguagcaugauuaguuauguucaugauuacuauucaugcuuccuagguugccuuucuucacccagggccuccuugagagcuggaaccucaguuccuagugaccuggguucuaaugcccuuaugcacauguuugaguuugacucuuauacaguugugaaguucacagguccucauuccacuuugauuucuggcaucugacugggaauacagugaugaugcacacacaguccaagaaagucacucuuacacucuuauguagacauuuaagagacauuaauguuacacuuaaguagacauuuaaacacauacgugcaaugaaacccguaaaggcuaagagaaucugcacauggcagaauggaagcacuucgggaaaaggagucacuucuggaggggugggaacgguuaggaauggcuuuguaggcaagaggauucuugagcugucuucaaaguuuaauaggugauuacuagacacaagagaaaggcagacuaggaagcaacaguagcagugcagagaccagaauuaugaagcagcauggcucaauuaguacgaagguuuuccauaaucuagucucugucuaguaaagcaaauacaaauauagugcuucucauaagauggacauuauuggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggugccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaagauggacauuauuuugucugcuuuacguagaauaacaaauuuaaucuuaacaacaacucugugaagugaaacuauaauuauccccaucauaaaaugcaaaaauugaggcauagaaaauuuacguaguuugcccuaguucacacagcuaauaauaaauaguagagcuagaauucaaaccuaggcauucuagcucuauggucugugaaccuaaccaccaggcuuccuucuagaagcugaggacacugagaguuuuaaaugucaggccccugaucacaccuaugagugucagaaucaugacucaaacucaucuuuugacuuuuuuuuuuugggacagggucucacucuguugcccaggcuggagugcaguggugugcagccuuaaccucccaggcucaggugauucucccaccucagccucccgaguaucugggacuacaggcaugcgccaccauaccuggcuaauuuuuuauagagauggggucucaccauguugcccaggcuguucuagaauuccuaggcucaagugauccucucaucuuggccucccaaagugcugggagcaugagccacugugccuggcgcucuuuuggcucuuuuuuauuuuauuuuauuuuuuuugagacggagucucacucugucgcccaggcugaagugcgaguggugugcucucagcucacugcagcugcugccucccggguuccugugauucuccugccucagccaccugaguagcugggauuacgggugccugacaccaugccuggcuacuuuuaaaaauguuuuugguagaggccgggcgcaguggcucaugccugaaaucccagcacuuuaggaggccaaggcagguggaucaccuaagguuaggaguucaagaccagccuggccaacauggugaaacccugucucuacuaaaaauccaaagaauuagccaaguaugguggcggaugccuguaaucccagcaacuugggaggcugaggcaggagaaucgcuugaaccugggaggcagagguugcagugagccaagaucaugccauugcacucaaccuggggaacaagaacucuguuucaaaaaaaaaaauuuuuuuuuaguagagacagaguuucaccaaguuggccaggcugcucuugaacuccugaccucaggugauccgcccgccugggccucccaaagugcugggauuacaggcgugagccaccacguccagcucaucuuuugacucuuaaggguccagugcucuuuucauaauaacauuugaugugguggauguuauauaauaccaaaaugaaauuaaauuacacuuugaggcaaugcuugcuagaaucuacaugaccauaucuuuacauugugaauguuaugcaggagccuucacuuugugccuuggguauaguagguguuaagugcugcacuuuagauguugaugugcugggcccaggaguaauaauaauuauaguaaaguugcaacauuauuuggcaauuugauguugaauagauuguuucuucugaacguuacauuuuaacacauuuguucuuaaaauuacaucauuguaagagaaaguacuuucaguuuaaaucaguaaagaucggucaggugcaguggcucaugccucuaaucucagcacuuugggaggcccaggcaggaggccugaggccaggaguuugagaccagccugggcagcauagugaaaccccaucucuauaaaaaauuaauuaaaagaauuagccaggcggccaggugcaguggcucauaccuguaaucccagcacuuugggaggccaaggugggcagaucaccugagguugggaguucgagaccagccugaccaauguggagaaacccugucucuacuaaaaauacaaaauuagcugggcagcugggcgugguggugcaugccuauaaucccagcucuuugggaggcugaggcaggagaaucacuugaaccugggaggcagagguuguggugagcugagaucgugccacugcacuucagccugggcaacaagagagaaacuccgucucaaaaaaaaaaaaaaagccaggcauggugguacccaccuguagucccagcugcuccagagguuggggcaggaggauugcuuuagugcaggagguugaggcugcagugagccaugaucuuaccacugcacuuccagacugggcaauggagcaagacucugucucuaaauaaacaauaaauaaauaggaugggcacguggcucacaccuguaaucccagcacuuugggaggccgacuccgguggaucaccugaggucaggaguuugggaccagccuggccaacauggugaaaccccaucucuacuaaaaauacaaaauuagccaggcaugguggcccaugccugugaucccagcuacucgggaggcugaggcaggagaaucgcuugaacuugggagguggagguugcagugagccgagaucacggcauugcacuccagccuggcaacaagagugaaauuccaucuccaaaaauaaauacauaaauaaagauuuaugaccuucuacugugccucuguucugugguaguuucuguaaagagauucuuuucaaagucaaauagguuuguuuauuaccuugaguuugaaaaaaggaauuaacaguuugguuuguuuuuauaauuguguucuguaaaucuagguucagauacaagccuacguuuguguuuauagugauaucuuuaaaaauuggaggaauaagaugagccgauggcugaauuauuggaggagucuuaagucauuucauacuuuucagaagccuaacaugcuuguguuucugcuguuaauucuagucaggcaucuuuuaauauuuucuuuuuucucucuuuuuuuuuuuuuuuuuuugagacaggaucucacucugucacacagguuggagugcagugguccaaucucaaucucggcucacugcaacaccugccucccaggcucaaaugauccucccacuucagcuucccaaguagcuggaaccauaggcacaagccaccaccccuggcuaauuuuuuguauuuuugguagagauggggucucgccauguugcccaggcuggucucgaacuccugagcucaugugauccacacaccucagccucccaaagugcugggauuacagaugugagccaccucacccagccuaauauuuucaaagaauaaaaauucacacaucagaaguccacuugguaaacucuuacuucuucagagucagcucaagcaucacuuucuauaaaaacuucucuguguuuucaaugaaaacuagguguuccuuuuauuguaugcccacuguaucuuggauauuuuucugcuguggcacuaaugacauauauugugauuuacugaauuugucuucuccacuuaauugugaauaacucaagggcaaagccccugcauuccuauccucccacuuuuaccaaggauagaacugagaauacauauugguagacauaauguuuaucugcagcuaagcuuuucuuacugugauugcuagaguuaggaauuaugcauuugacauaguggguaucaguaaccuaaauaaaaauaggcuaguaguaugugugcuuugauuuuuguuacauuguuuuuuuucuguuaauuguuuuuucuguacuugcaguuuguaaaaauggaauuucaagcaguagugauggcaguagguggaggaucucggaugacagaccuaacuuccagcauucccaaaccucugcuuccaguugggaacaaaccuuuaauuugguacccauugaaccugcuugagcguguuggauuugaaggugagcuaugacaaagugagcugugaacucauaaaacuuuuaggagauuugauccccaugauuugucagcguuaugagaaugagagagggugacuagaacucguuggcugaagacugccuucuuuaaggaauguaggaguacucuauugcugugugaaaaagguugagaggauagcacuaaguguuguuguuauggagcugauguccacaaugauccaagacgaacucuguaaagauaucagaaagagcagauugagacucuuaaaugccucauagucaguacuuacugagaaucuauuauguaccagguaauauuuauauuaucugauauucaauauauauauguuuuaaauuuuguuuugauguaaguaccagguuauauauuaaacacggagguacagaauugaaaagacagcucaggcccugacuuccagaacuuuaaagucuagugauccucucuacuuuuugcuuggguagcuagguagauaguuaugccauuaaguaggaaaaggaauaggagacaaggaacagguguuuuuuuuuugagacagagucucacgcugccacccaggcuggagugcaguggcacgaucuuggcucacuacaaccuccgccaggguucaaccucucccggguucaagugauucuccugccucagcuuccuguguagcugggacuacaggcauuuuccaccaugcccggcuaaguuuuuguauuuuuaguagagacaggguuucaccauguuagcuagaauggucucgaucucaggaccucgugaucugcccaccucggccucccaaagugcugggauuacaggcaugagccaccgugccuggccaggaaaagguuuuaaugaauuuuauuuucauuaaaauaaugaguucagcuuuggucacauugaguuugagguguccuauauuuagauguaauaaaucagggugccaaagccugaggcccagucuugugauccaguguucauuccauuauuagaguugccuccaauaggaagggugguagcuuaauagcucucucuuuguauugaaugaagauuuaaaauguuggagucucacccugucgcccaggcuggaguacaguggugugaucucagcucacugcaaccuccaccucccagguuuaagcaauucuccugcuucagucucccgaguaccugggacuacaggcguguaccaccacucccggcuaauuuuuuuguauuuuuaauagagacaggguuucgccauguuguccaggcuggucuugaacuucugaccucaagugaucugccugucucggccuuccaaaguguuggaauuacaggugugagccacuacgcauggcccccuuugguuuuuuuguuuuuuagagacagagucuugcucugucguccaaggcuggaguacaguggcaugauuucagcucauugcaaccucugccuccugggaucaaacgauccucccaucuuagccuccugaguagcugcaacuacaugcaugccaccacaccuggauaauuuuucuuuccuccuuuuuuuuuuuuuuuuuuuuuuggcagagacaggguuucgccacguuacccaggcuggucuugaguuccugggcugaaguuaucugccugccuuggcuucccagaguguuuuuuauauuucuucccauuuguauuuuugauuaauguucuucugaauucuucauaucaaggagaaguggcauauaauauauuaaagugugggcaccauucauauagaccugagguuuuuuuuuguuuguuuguuuguuuugagacagacucacucuguuacccaggcuggagugcaguggggugaucuuggcccacugcaaccuccaccucccagacucaagcaauccucccaccuaaaccucugguuuuuuggaguuuuuuuauagagacaagguuuugccauguugcccaggcuggucuugaacuccagggcucaagugauccgccugccucggccucccaaagugcugggauuuacaggcaugagccacugcgcccagccagcaugucuuuuaauccaagauuccucauuuguaagaugagauuguucuaagaauuaauuggggggaggccagaugcagugguucacgucuguaaucacaacacuuggggaggccaaggcuggcggauccuuugagcccaggaguuggagaccagccugggcaacagagcgaaaccucaucucuacagaaaauacaaaaauuagccaagcaugguggcacaugccuguagucucagcuacuugggaggcugaggugggaggauugccugaucuugggagguugaggcugcugugaacugcgacagugccacugcacuccagccugaguggcagagugagacccugucuguaaaaaaaaaaaaaaaaaaaaaaaaaaaaaaaagaauuuauugggggaaugcagguaaaauauauugaaaaggcacaauaauauuagcaguuguuauuacaccuagaaauagaccaaaucuaauugaaauaauggaaccacugucuauaugaguaaguuuuuguuuuucuuucuuuuuuucuuuuguccuauagaagucauugugguuacaaccagggauguucaaaaggcucuaugugcagaauucaagaugaaaaugaagccagauauuguguguauuccugaugacgcugacaugggaacugcagauucuuugcgcuacauauauccaaaacuuaaggugaaaagcaauuuuuugacucuucuuguuuauugaagauagaugauaucuuauguuuucccagugcauuauagucuuuuuuuugagacagaaccucgcucugucaccuaggccggagugcaguagugugaucucaauucacugcaaccuccaccucccggguucaagcaauucuccugccucagccucccaaguagcugggauuacaggcauacgccaccgugccuggcuaauuuuguauuuuuaguauagaugggauguuggccaggcuagacucgaacuccugaccucaggugauccacccuccucggccuuccaaagugcugggauuacaggcgugagccaucacgccuggcccccagugcauuauaguuuacaaaacuuuauuucugauauauuuuuacaucacauacuuuguuacccauguacucuucaguugcucuuugauuugguuacuaguaaagauuuagacauuaauuugucauagucacugguuuccaauguuuuugaguaauagcacauuuuuauuaaaaaagaaaaaaaagacauacucuaggccaggcacaguggcuuaugccuguaaucccuuugggaggccaaggcagguggaucacuugaggucaggaguuugagaccagccuggucaacgugguaagacccugucucuacuaaaaagacaaaaauuagcugggcauggcggugcacaucuguaauccuagcuacuggggaggcugaggcaggagaaucgcuugaacccaggagguggagguugcagugagccgagaucaugccacugcacuccagccugggcaacagagugagaucccaucucaaaaaaaaaaaaaagauauacucuaaauguacuucaaaagauuccauucauaugaaguuugugaacaagcaauguuaauguauaaaucagaggagcaguugacucugcaggugaggauugacuagaaagaaguacaaaggaacguucaaaaauucauagaccucccauguaauauuugaacuuuuaguuaaccuuugguuaagaaacuaaggagcacauagauaugagaacauagucuccccaaugguuuguggcccaugagcugagaaagauccacuguagauuguucuaaaauuguuuuucuuuggaaaaaauucaaucguugugauguugccauauuacuugaaaugggagacaaacuuucuucuguuauuucuggugauuaaacggauguguuauuuucaaccgacuuuuguacuauaaaacaaaaaauuaaugcaaauauguacauggcuuucccaccccuuuuauugaggaauaauuuauacacaguaaaaugcacagauacuaaauauacaccuagauuaccauuauccaaaucuagaacaauuccaucaccccugaaaguuccuuugugcuucuuucuaguaagucucugaucuucugagucaaccacucuucuguuucuaucacuauguauuaauuuuauuugcuuauaaacuucauauaaauggaaacauacaauuuuguucuggcuucuuuuguucaacauauuuuucagauucuuucauguuauugaaaguauaacuaaucuguuccuuuucaugcuuaguaguauuccauugaaugaauauacuacuauuuauuuaucuauccuccuauugacaguuauuuggguuguuucuaauuuuuggcuaucaugcauaaagcuauuaugagcauuguucugcaggucuuuuugugaaaauauucuauaggcuguaagguuuacuuuauuggaaacuagcaguuuucuaaagugauuguaccauuuuauacuuucaucaacaguuuguaagaguugcguuugcuucacgucuucaucaacacuugguguugucagucuuuuuaauuuuaaccauucuaguagguauguauguagugguaucucauugugguuuuaauuuacauuucccugaugguaaugaugcugaacaccuuuucauguguuuauuggccauuuauauauguucaugaagugucuguucaaagcauuugucuauuuuuuaauugaguuguuugccuuuccauuauugauuauaggaauucuuaauauaguccagaugcaagucguuugugagauauguguugugaauauuuuccaccagucuguggcuuuuuauuuaauggugucucuugaagaaaaguuuuuaaugaugaugaaauccaaauuacugauuuuuucuuuuaugguuauugcuuuuuguguccggccuaagaaaucucugcccaucugaccuuuguguagauguucuucuaugguuuugucuuuguuuuguauucuuuuugagacagagucuugcucucucacccaggcugagugcaguggugcaaucuccaccuccacugcaccuccucaccgcaccaccucacugcagccuccaccucucagguucaacugauucucgugccucagccuccugaguagcugggauuacaggugugugccaccacaccuggcuaauuuuuguaguuuauagagacaggguuucaccauguuggccaggcuggucucgggcucccagguucaagugaccuacccaccuuggccucccaaagugcugggauuacacacaugagcgaccucacccagcucagauuugacaucuuaauauugaaucuuuugauccuugaacaucguauauauaguaaugugccacauaacgauuuuuggucaaugacuggccacauauguggucccauaagauuguaauaccauauuuuuacuguaccuuuucuauguuuagauauguuuaaauacacaaauacuuaccauuguguuacaguuaccuaugguauauaauaacauacagguuuguuaccuaggaacaauaggcuauaccauauagccuagguauguaguaggcuauacuaucuagguuugaguaaguacauucuaugauguucgcacaacgaaaucaccuaacaaugcauuucucagaacauaccggauuucucagaacauaucgcugucauuaaguaacacauaauuguguaucuauuuauuuaaguuucgcuuaauuucucucaacugaguuuuguaauuuucagugaugauuuuuuuuuucuugagacagccuugcucugucguccaggcuggagugcaguggugugaucaaggcucacugcagccucaaccuccugggcucaagugaucuccacaucagccucucaaguagaugggacuacaggcacaugcuaccaugcacagcuaauuuuuuagauuuuuauuuuaguagagaugucucacuguguugcucaggcuaguuucaaacuccagggcucaagcuguccucccacuucagucuccuaaagugcugggauaacaggcaugagccaccacacccagcccaauguagaaauuuugaacaugucuugauaaauuuauuccuagguaaauauuuuuaaugauauuguaacugguauuuuuucuauuuucaauuguuuauugcuuguacauagaaauacaauugauuuuuguauuuuggcauuaugcgcugugaccuuuuaaauuauagauucguuuaggaccuuaucaucauauugccugcaaauaaaaacaguauuauaucuuccuucuuaaucuuuauucuuuuuaaaaauuaaauuacauuaauuuuauuuuuugagacagucucacucugucacccaggcuagugugcaguuguguggucacagcucacuguagccccaaacuccugggcucaagcaguccucccaccucaggcucccaaguaacuaaguaacuaggacuacaggcaugugccaccaugcccggcuaauuucuuuuuuuuucuuuuuuuuuuuuuuagaccagggucuuacuuuguuguccaggcuggagugcaguggcucgaucacggcucacuguaaccucgaccuccccaggcucaggugauccuccuaccuaagccucccaaguagcugagacuacaggcaugcaccaccacaccuggacuuuuuuuauauauagagagaaaggaucucacuguauugcccaggccuggucuggaacuccuggacagaagugauacccccaaccuugcccucucaaaaugcugugauuacaggcaugagccacuaugcccagcucuuuaaaaaaaaaaaaaauugucucauugcccuggccaggaccuccaguacaauguauauaggcauuuccauucacuuuuggccuuccuucuacuuuucuguauuuucucucaaguggauuuugggugcuucugauuagagugggggcuuccaauacaauaaugugggguguguugcuuucuggaguaccgcugauuauuuguuuagagaauauuuggggaauuccauuaggguaaugagaagaaaauuugggucaaguguacaguucagugguauuaagcacauuuauaauguugugcaaccauuaccacccuccaucucuauaaccuucaucuugugaaacugaaacucuauuaccauuaaauacuaacaucccccuccuccuagcccauggcagcuaccauucuacuuccuauuucuaugauuuugacuaccucuaaguaccucauguaaguggaaucauagaguauuugucuuucuuuuuuuuugagacagagucucacucuaucacccuggcuggggugcaguggcaugaucucagcucacugcagccucuaccucccagguucaagcaugucuugugccucagccuccugaguagcuggaacuacaggugcaugcccuaccuacuacaccuggcuaguuuuuguauuuuuaguagaaaugggguuucgccauguuggccaggcuagucucgaacgucuggccucaagugaucugcccaccuuggccuccaguauuuauuuuuugugauuggcuuacuuagcauaacauccucaagguucauccauauuguagcauacugcagaauuuacuucguuuuuaaggcugaggaauauucuauuuuauggauaugccacauuuugcuuagccauucauccauccacggacacuuggguugccuccacauuuuagcuauugugaauaaugcagcugugaauauggauguacaaauauuucuuugagacccucuuucaguucuuuugauuuauacugagaaauguaguugcuggauuauaugcuauuucuguguuuaauuuuuuaaugaacugccauacuguuuuccacaguggcuauaccauuuuacauugccaccaacaguguacaagggcuccaaccucuuucucucuuucuuuucuuguuuuguuuuugagacaggauuucguucugacauccagguuggagugccauggcgcaaucauggcucacugcagcauugaccucccagggucaagcgaugcuccuaucucagccuccugaguagcuggaaccaugggcauauguugccacacccagcuaacuuuuuauuuuuuguugagaugaggguguuucacuauauugcccccaaaauacaaaaauuagccacgcauggugacacacaccuguagucccagguacucaggaggcugagguugaggacugcuugugcucgagaggugaagguugcagugagcugagaucguaccacugcacucuagccugggcaacagagggagauucugucucaaaaaaauauauaaauaaauuaaaaucaguguguguguguguguguguguguguguguguguauuuauuuauuauuauuuuuuaaaacggaguuuugcucuuguugcccaggcuggagugcaauggcgugaucucggcucaccgcaaccucugccucccagguucaagcgauucuccugccucaccuuccugaguagcugggauuacaggcaugcgccaccacacccagcuaauuuuguguuuuuaguagagacaggguuucuccauguuggucaggcuggucucaaacucccgaucucaggugauccacccaccuuggccucccaaagugcugggauuacaggcaugagccaccgugccuggauauauauauauauguguguguguguauauacauguguguguuuguguguguauauguguguguguguguguuuguguguguguguguguauuuuuuuuuagagacagagucucacuauguugcccaggcuggucucgaacuccugggcucaagugauccuccaccuuggccucccaaagugcugggauuacaaguaugagccaccaugccuagccuaugguuccaguuucuccacauccuucccaguauuuauuuucugcuuauuuuuguuuguuuguuuuuuuguuuuugagaaggagucuugcucuguugcccaggcuggagugcaauggugcaaucucggcuuacugcaaccuuuccucccagguucaagcgauucuccugccucagccuccugaguagcuggaauuacaggugcauaccaccacggccagcuaauuuuuguauuuuuaguauagagacgggguuucaccauguuggccagguuggucucaaacuccugaccucgugauccacccaccucagccucccaaugugcugggauuacaggcaugagccaccucacccagccuauuuuuuucuuaauaguagucaucccaauaagcaugaguuaguaucuuacuguaguuuugauuugcaaagagcuugggauuuuugguggucuucucagagcuguauuagcuaccaucuaaaaguuuagaauggauguguaaacuuucuuugcucuauaaucucugaauuuuagaaaaguuauuuuuggcccaguaagcuagagaucuugaaagucccaggcaaauaaguuccucuaauacuuggaggcuugagaaguaauaguggcaacuguuaggagagaaggcaugagaaggaaaguaaaguaaccuccaaaggggcauuuuacucuccaaguuacugccuuuuuguaugacuuugauuuuuuuuuuuuuuuuuucuggagacggagucucgcucuguagcccaggcuggagugcgggcucacugcaagcucugccuccuggguucacgccauucuucugccucagccucccgaguagcugggacuacaggugccugccaccaagcccgacuaauuuuuuuguauuuuuaguagagccaggguuucaccauguuggccaggauggucucgaucuccuacuucgggauccgcccgccucggccucccaaagugcugggauuauaggcgugagccacugcgcccggccaugacuuugaucuuuuacuccuuauuuuagggcuuccccuugcaccuaaaaucagaaucuuuacuaaguccuucugcagucuaauuucuguuccuccguuacccguucccccacaucauuuacacagaaucucuuacauauaauccuaccucugagccaucuuccaagcugugacuuuggccagcaagucuuugcuaucuuuacuugguuuuuucuuacuacaauagccccugaaauccuggcuucauaucagauugccuuccaaccaggaguagaaggcaacaaggcuaacuguuggaagaacguaaauaaaugcccaaauagcuguuaggaacugagcuaagccaaaauucagaauuaacugauuagaauuaacauaaacuuguagaaagggcaguggaagugcguauaaacaguugaagaaagugagacagccuaagaaguaaguugucaguguuugcuaagggaugucgguuaucucucuaaaggagaaaguugcacugagcagcugugccaugcaugacacaguggcccuuuaagcccauguuuuuucuucccgugugcccacaaaagagcuccuaaacauuaauaggcucuuuuggucuguuuccaauaagauuuuagguaagauaagaacauucccuaaaaguuugagguuuauuggcuuuugguuuuaucuuuacccacuuccuccagauugaguuucccagcuauuauugugaggucuucguguuugacuucuguucucagacaaaggccagaguaguacauucacuuuauuuggcuuuuuuuuguuaaaacaauuuuuaacuuauaauguuuuuccuuuaccuuauauuugcuaaauguauugcaguccuacuuauauguggaaaccuccaucacaugugcuuauaggauauugaaguuagauaccauauuugcuaaguuauguuuuuucacuuaaaggacacauauuucauuugguuuuauacuuucuggcaccauuuucuacuucauuuugcuuuaucuaaccccacaauuuuacugauuuacugguucucacuuuuuauuucagcuacccaaaccucuuucccugacuuaucaagagagauuauugguucauucauucucccaggcccugggugagugagcuccacucuuacaacugacguugauaacaugaaugcucuuagauuucauauuuucuccauaauaauguuucauauuuguugauaaaucauucauucuuaucuaugucuaaacucauucauuuaguaaauauucagagucaacuaauaagaauaaugauaauugccauuguuaaacacaaguuguagaccagacauaguuaauauuuuaacuucuuauauggaaauuuuaaaacuuguacaaaaguaaucaacauugcccauuuaucugucacccagcaucaacaguuaacaaccuauagcaaaucuuauuuuaucuauauuuuacccaacuugcuuucucccauauucuuuugaagcaaaucuuagacauauaauuuuaucuguaaauauuuuagaauauauuauaaaaauaagggcacuuuuuagaaauaccacuaucacuucuaaaaaacaguaaaaaaccaaaucaauaauaauucuuugguaucauuaaguaucuaaucaguguuugaguuuucaguugccucauaaauauaauuucagcauguuuuuucaaauguguuuauuuaacuuaggaagugaauaaggauuacacauuacaauugguugaaaugucuuuuaagucucuugauauauagguuuucccuccauuucuuuuuucccccuuguaauuuaauuguugaagaaacuagguuuuuguugauuuaaugaguguuucucuguauguauagucuguaaauuaguaguugaacuugaggcuugauuagguuuagguuugaauuuuuggcaaggcagugguguguucuuccaucugcagguacaugauuaucugguugucuuucauuuugugauguuagcagccguugaugaucacugcacacgaguccccauuccuugugucuccagucauuugucugaagcuuauuucuaauagauuccuaaaggagggcgcauauaauguucaacaaguaaucugccaccguuauguuucaaagccaauuuauuuggauauagaauccgugacugacauguuuuccuugaguauauuaaauguaucuuuuuuuuuuuuuuugagauggaguuuugcucuugucaccuaggcuggagugcauggcgcaaucucaacucacugcaaccuccgccucccagguuuaagcaguucuccugccucagccuuccaaguagcugggauuacaggcacacgccaccaugccuggcuaauuuuuguauuuuuaguagagacggggcuucaccauguuggccaggcuggucucgaacuccugaccucaugauccgcccgccucggccucccaaagugcugggauuacaggcgugagccacugcaccggccuaaauguauucuuucauuaucuuuugacauacagcguuguugucaaaacaguccagauaaaaucuguuuuucuuucccuuaugagugacuugguccuuuugucuggauucccaaaggaguuuuuauuuuucuuuaauaucuugugguuuuucuauauaauguaucuuauugauuguucugaaucauguuuuuuagauauguaguaaguucuuuucaugugaaguuucagucuuuuuuuuuuuuuuccuuuuuuuaagaggcagagucucacucugucgcccaggcuggaguguugccgaacgugacucacuucagcccugaccuccugggcucaagccauccucccaucauagccuucugagugacugggacuauaggaacaugccaccacacccagcuaauuuauuuuucuuuuuugcagagacaggguuuugccuuguuaccuaggcuggucucacacuccuggacucaaaugaucugccugccucagcuucccaaaguaaugggauuuacaggcaagagucacugcaccaggccuuuucuuuuauauuuuuauuuuuauuuuuauuuauuuauuuucaaaauggagucucacucugucgcccaggcuggagugcaguggcacaaucucggcucacugcaaccuccaccucccagguucaagcgauucuccugucucagcccccugaguagcugggauuacaggcaugugccaccccgccugacuaauuuuuguacuuuuaguggagacaggguuucacccuguuggccaggcuggucucgaacuccugaccucuugauuugcucgccucggccucccaaagugcugggauuacaggcgugacaccgugccuggccuuuuuuuuuuuuuuuuuuuugaagacagcaucucacucugucgccagacgggagugcaauggcacagucuuggcucacugcaaccucugccuccuggguucaagcgauucuccugccucagccuccccaguagcugggacuacaggcaugugccaccacacccggcuaauuuuuuauauuuuuaguagagacaggguuucaccguguuagccaggauggucucaaacuccugaccucgugauccgccugccucggcaucccaaagugcugggauuacaggcaugagccaccacgccuggccuuuuuuuuuuuugagacagagucucgcucuguugcccacgcuggagugcaguggugggaucucggcuuuucgcaaccucugccucccagguucaagugauuccucugccucagccccucaaguagcugggacuacaggugugagccaccaugccuggcuaauuuuuguauuuuuauuagagaugggguuucaccauauuggccaggcuggucucgaacucuugaccucaagugaucugccugccucagccucccaaagugcugggauuacaagcgugagccaccacgcccagccacauuuaucauuuucuuacuuuagcuuauuuugaaauaugaggcuauggaaggccgggcauggugucucacaccuguaaucccagcaccuugggaggccgaggcaggcagaucacgaggucaagagaucgagaccauccuggccaacauggugaaaccccaucucuacuaaaaauauaaaaauuagcuggccauaguggcgugugcucguagucccagcuacucgggaggcaggagaauugccugaaccugggacacggagguugcggugagcugaggucgcgccauugcacuccagccuggcaacagagugagacuccgucucaaaaaaacagaaauauuagucuauggauuucaucuguuugugggcaugucuuucuuauaugugcuuucauuauaggaauguuauuuuaaucuuuauuaucuuuuuugauaauaacuuuguauaggauuugacuguaauuguuuucuguuuguaauuuuuaucugaaguuggucuuucuacauuuucagaagagaagagugagucagaauugcuuuuuuagcuucacagcucuagagcccccucuuuuaagaucuuccuccacuguuccuuuaucgccguuuuaucugucuuuucugguuccugugcucuuggauugucuuuguccugcuuaauuuggauucuacuccuggcaauuucuauuuagugccaggcuucuucuucuucuuuuuuuuuuuuuuuuuugagacagagucucgcucugucgcccaggcuggagugcaguggcauaaucucggcucacugcaagcuccgccccccagguucacgccauucuccugucucagccucccaaguagcugggacuacaggcacccgccaccacgccuggccaauuuuuuguauuuuuaguagagacaggguuucaccauguuagccaggauggucucgaucucuugaccuugugauccuccuuccucagccucccgaagugcugggauuacaggccugagccacugcgcccggccuucauuuuuaaagacaguguugguuuguuaguuuugagaguucauagggcuaagacugcucuagccuuuucauaucuuacugugaauagauaaggggacugagucuucagaguuuaauggaagaguuagugauugaaccgguucucuuccuucagaggcuaugcuuuuaacuacgcuuuacagucuaggagagaaguaagaauaugguauacacuuuuggccaggcaugguggcucacaccuguaaucccagcacuuugggaggcugaggcggguguaucacuugaggucagguguuccagaccagccuggccaacauggagaagccuugucucuacuaaaaauacaaaaauuagcugggcauaguagugugcaccuguagucccagcuacucaggaggccgaggcacgaagaucgcuugaacccgggaggcagagguugcagugagcugagaucaugccacugcacuccagccugggccacagagugagacuccgucucaaaaaaaaaaaaaaaaaaaaaaagaugcauuugugcaucucagauacccaggccuuuuugacuauuguauugccuccaaaagcauuaguacuuuaguacuaauuaguacuuuuaguacauuaguaguauuaguugccuccacuaagcauuaguagucuuuauaaucacucuaacucuagacuuuuggcuuuagaacacguuuaguucuaaaccuguucuaaagauucuaccagguuuacuuggucugcuauuuucaaaauuucuuuuuuugagugguguucuuuucugugguguucagauauguagaauuuuauauguagauuagauaguuguauguauguauagaacucuuuuaaaguguacaauucagugguucuuaauauguauaaacucuuaauuaguuuuguguaaaacauacuuagaaaugagcaaaucuccuaacaggacucauguaguauccuugucuugcaggugugcagcuauugcuuguugaucucuuucucuaaguggagggaauuccaggcuuauaggagaaauuuuuguccuaugucuagagccaugugaacaagaaguguuguuaaguaaaggugcggucugugagcugcacauaaagcaaagcuggcugacuccuuggauauggauccugacccauauuagagcuguugcucuaacuaucugggguaaccagccauuggugcuguuuuugugugcuuuagaaacagacugcgauuauuccucgagaacaaguuagugagguauauuuuagaggcuucaagcagacuaaauccauaauagaguucuguagccuauguuuaaaguauuuguuuuauauugccggucucauugcuucuuuuaauuuagaaauuccagaguugauaauucucuauuuaaucuagacaggaaucuuuggcuucaagcaagccucauuuacccugugccucaguuucacaaccaagaaaguagggauaauaauaccaacacacuagucguuagagguauaguuccuuaaguccuuugauguagagaaaggacuauuguuaugucuuaugaaacagcuaacauguuacaacaaagaacaaacuaugccaaugaaauccccaugcuggagacagcuuauuagaaagacugagcauauguacuauuuucagauguucaaaaagcuaaaugcaaguuauuuucaguugaguguuugaugucuuuuaucaaauuacaaaucucugucauucuuuccuggaaccuuucauuuuucccagagauuuuuauuugucagauuucuaucaucuugaaaagaguaaauacaguuggucaagggaagaucugagaacuuggucccaacuugcuuaaagacuuuauuaaguggcaacguuccuuaagacugcuuuggugggccaugguugcuuacgacagccucaguguaauccugaugaugccuuccuggagucuacugguggcguagugaaaagcccaacauuacuggcagaaacgaguuggauauaaaaauuuuggagucuuuuuuuuuuuuuuuuggccaagaaaucucaauggagcuuuucuuuugauacuaaccuauuuugauacuaaccuaguauauguaucuacaacauugaaauguuuucaccuuacuuuuucagacuguuacuuuuuggaacucugaucugugggauaggacuucuguagcccuguacuuaauuugacagccaaaaaacuugcaagcccuguguuugagucugauucuuuuaagucauuuuccuuccuuaggacccugucaggggaugaagggcuauaggguagagggaaaaguuacuagcuagcaacugugauaacacagacugucaucacaaacuuacugcaucauuggauaauaagcagccugcaugacuuugauuuuuggaaacucuuaguagggccacuuauucuacucugaaucaugaaguaacauuacagcccgaguaguggaaaggugcaguacaauuuaugggaagucaguaagcauucugucaccaugaccagagaguucauuugaaguagccuguagcuacuuaggcucuuaacuuaggcaucaucugugccaacaagacuucccugguuggccaggcacaguggcucaugccuguaaucccagcacuuugggaggcugaggcgggugaauugcuugagcccaggaguuugagacuagccuggacaacguggcaaaacccugucucuacaaaaaauguaacaguuagccaggugugauggcaugugccuguagucccagcuacucaagaggcugaggugggaggaucaccugagccugggagacagagguugcagugagcugagaucagccacugcacuucagcccgagcaacagagugagacccugucaaaaaaaaaaaagauuuccccccugguuuucugggguuuuuuuuuguuuuguuuuuuuuguuuuuguuuuuguuuuuugaguccagaucucacucuugcccaggcuggaguacaguggcaugaucucagcucacugcaaccucagccuccugggaucaggugauccucucaccucagccuccccaguaacugggacuacaaguguguaccaccaugcccaucuaauuuuuugaagagaugggguuuugccauggugcccaggcucgaacuccugggcucaagcagucugcucaccucccaaaauguugggauuacaggcaugagccacugcacccagcugucuggucuuuuaagacugaauccggugucauuuuucuguauuuacacagggauuagaagacaucugucauauuguugcuauacugugaggcaagaacuauaucugggccuggcacaaagaguuuguccaauauuauuuguugaaugaaugaaugacagccggaagcaaguuauuuguaaacauuuaaaauaaguuccuuaaguuccuuacucccuuaauauagacacacauguuuaggucagguacaguggcucacaccuguaaucccagcacuuugggaggccaaggcaggaggaucacuugagcccaggaguuugaggccaaccugggcaagauggugagacucccucaucgcuacacaaauuuuuuuagauuagccagguacaguggugugcaccaguagucacagcuacuugggaagcugaagagggaggauccccugagcccaagaauuuuaggcaacagugcugugaucgcgccacugcuccccaaccuggccaauaaagugagaaacucaucucuaaaaaauaaauagaugcauguuuaugugaaccuaaggaugaauuucagugacuguagauuagaagaacugauuauagcauuggcugcuugguguucacuuuauuugcaucugugaguuuccaacaagcccuaaguuuacugacauggcugguccucuaccccaagaauguucucccagaggaaggaugaugaugaugaugaugaugaugaugaugaugaugauguugaugaugauugagacggaguuucgcucuugucacccaggcuggagugcaguggcgcagucucagcucacugcaaccucugccucccagguucaagugauucuccugucucagccuccugaguagcugcgauuaugggugcaugccacuacacccaguuacuuuuuguguuuuuaguagagacaagauuucaucauguugcccaggcuggucuugaacuccugaccucaagugauccacccgccuuggccucccaaagugcugggauuacaggugugagccacugugccuggcaggauuauuuuauuuuuugugauaagguagggugauguggugaaaagaacacaggcuuucauaagagagguagaccuagauagauaauucuuguucugucauucacuagcuaugugaccuuggaaguuaugagucccuuucaaacuugcauuugauucaucuauaaaauauuaauauuuuuagcuuauucaacaaauauguguugaauacuuaguauauauccuauucagagaugcuauaaauauagugguaauccagauaaaaaagauaccuguccucuuagaucuacucuauaaggagagagaaauaaacaaggcgaucuucccacuucagcuccaaguagcugggaauacaggcacacaccaccacaccugccuaauuuaaaaaauuauuuuuguggagaugaggucuugcuauguuacccaggcuggucucaaauuucugggcucaagcaguccuccugccucugccuccuaaagugcuaggauuacaggugugaugagccaaugcacccggcccuguuuuucacuugacaguauauccuggaaaucacuccauuucaguuaauggagacuuuuuuuuuuuuuuuuuuuugagacagggucucacucuguugcccagguuggagugcaguggcaugaucauggcucacugcagccucgucuuccugggcucaagccuguagcugggacuagagguacucaccaccacucccagcugaucuuuuuuuuauuuuuuguagaaagggggucuugcuuuguuguccaggcugcucuugaaguccuggccucaagcaauccuccugccucagccucccagacugcuaggaugacaaguguaagaaacugcuugaccagauuuuuuuuuuuuaacagcuacauaguaccucauuguacauauauuuuuaaaaaucuuuuaaauuauuuuaauacagucucuugagaucaguaacacauugguaaacuuucugcagaaguauauuccugaauaaguaaaccaaaggcaacaguugacaaaaagguaaggaaagaaguagcuuuauuuuaaaauacagucguccuuugguaucuuugggguauugguuccaggaacccucacagauaccaaaauccuuggaugcucauguugcuuuuauaaaauggcaugguauuugcauauaaccuacaaguucucccaaauacuuuaaaucaccucuaaauuauuuauaauaucuacaguguaaaugcuauccaaauaguuguuauccaguauugguuuuuugucuuuuuuuuuugagacggggucucgcuguguugcccaggcuggagugcaguggcgcgaucucggcucacugcaagcuccgcccccggguucacgccauucuccugccucagccuccggaguagcugggacuacaggcgcccgccaccucgccuggcuaauuuuuuguaucuuuaguagagacgggguuucaccguguuagccaggauggucucgaucuccugaccucaugauccgccugccucggccucccaaagugcugggauuacagaugugagccaccacgcccggcccaguauugguuuuuaaacaguauuaguuuuuaguuuguauuuuuuauuguuauauuauuauuuuuauuuuuucucgaauauuuuugauauaugguuggcugaaucugcagaugcaguaccugcagauacagagggccaacuguaaaugucaaaaaagucaacuuuaaaaaauaacuuuaucaaugugaguuauuuuuaaauacauauagggacugaacauacaugcaucaaauuguacucucauucacugacauaagcacaccuccaaacaaguuaauaugaagguaaauacauaaauauauacaaauaaauacacauacccaaauaacaagccacauaucacccaccauuuuccaauuuucacauaaacauacuggcaaauacagcaaaauaucaguguaaauuaacacacuuacauauacagauaugcauaaauacuagaauucaaagugacguguagcauauaacacagguacuuaaggcauaaacaacacagcucagucagaaacagcccagaguugaaacaaauacuauugugaccuucucacuagggaugaagauucagcaguucacaaugaaauugagauuaauaaaaugcucaugcuuuaauuaauaggaacagagaaaccagacucuaaaccauuccccauugccaaugaguuuguuauguugauaauuugaugacaacuucagagacuuaaaagcacagggaggcuggggagucguaucuagauaaaagauuugcuaaaugaaauuacugaaggugaaccuggaaacauucuguaaaguuagcuaaauuaucuuuacguuuuuuagaaauagggucucacucuguugcccaggcuggagugcaguggcaugaucuuagaucauuacagugucauacuccugggcucaagugauccucccagccucagucuccuaaguagcugggaucacaggugugugacaccaugccuggcucaaauucuuuuuacuuugaaggcccugcuagaaauugcugcugcucuaauucaccacucagagaggagaggcaaaacuaaauaagcuguugcugguuucaggugcuguggaagaacccacaaaaaaaaaggucugaacugaaaaucuccaucuccaucacccugauuuaaacagguguacuauccaaaggaaacuuggaguuguuauuccuaaugggaagccaaaaacaccagacugugcaaucguagaugguucaagggugccuucacgguuagcaauagggauguuacguagccuaaggcuaucauagaggccuuggagcuuuugaugcugaagauggcguuccauaaguuucucagaugucacugaacuuuuucuuguauucuucuagcacuuucuucauggaggugacuuccccuuucauagaggucaauucuacauccucgcuuuguauuugcugaguauauauuuucuccgucuguuucagauggcccucagccuugaugaaauuguguucuugauagagauguuccugauguaccugauauguccagaagcccacugcucaggagcuaacguccaacacgaucucuugucgcaguccugccaauaccauagcuuuauauuucucugauggauugaguucugugcggacaauaucuagcuuuccagaaaggguacuguuucaggcagcacagauagcuggugagcgacuaaacucaccacugccaugcugaucacagaauaugugagagcaggcagugacccaugcauagccauagaguuugaugccacacuuuugauaauuacaaaguagcaugucuucacacaaagacauaauaggauagugaggucuccagaagcuaaagacagcccauaaaagaaaaacgcaguaaucaucuacuguauauccaggauuuacagcaccaaagagguccagacuggaacagugagacuccgaucugguuucggucucuuaaaauuuuacuucucuggcaucacaugaauccagcuucuaucuagaaaucaaguugaaccacaggaucuaucaauuaccuaggaucaucuguguaaugaagagaacuuaaggcagcguaucuugaucaaaauucaaguaccaggcuuuaggucccaucagccuuuaacccuuuuuauugagaauguccaaauccaagcccauuugauuuucagggggucuguagauaggccaguucuggacuggcacacagggugcugaagacccaggccuucccuucucaguggauuucaucuucaaccggcccaccaaaauggaaaggaaaaaaagucauuguacauauuuuacucaaccaacuccuaugguuggguuuuuagguagcuuccaauauuuugcugcaaugaauaacuuugcaauuaguagugguauuguugcaugauaaauucuuacaagugggauuacugggucaaaggauaaaacugcauguguagcuuuguuaaaaaugaccaaauuuccauccaaaaguguuguacuaguuagcauuccuagcaacaauauaugacaguguuuauuuccacauggacucaccagucuaauuggugagaaaugguagcucagagucauuugaauuuuaauuugcauuuuucuuuuuuuuuuggagacggagucuugcucugucauccaggcuggaaugcaauggcgcaaucucagcucacugcagccuucaccucucagguucaagugauuauccugccucagccuccaaaguagcugggauuacaggcacaugccaccacgcccagcugauuuuuguauuuuuaguagagaccagguuuugucauguuggccaggcuggucucgaacuccugagcucaagugaucugccugccucugccuccuaaaguacugggaucacaggugugagcugcauuuuucuuauuaugagugaaguuaaauaucuuuuuauauguuuaaggaccauuuaaaaauugaauacauuaugaucuuucuuuguaaauuguucauguacuuuauuuuuucucaauuuuaaaaguaccuucaguuuuuguuguuuuccuucuugaauuuuagaaguucuguaacuguagcaguuugaugucuuuugacuuugugguguuugggggcauagaaaacuuuuaggucuugcccugucgccuaggcuagagugccauggcacgaucucgccuuacugcagccuccauccccugagcucaggugaucuuccuaccucagccuccugaguagcuggaaauacaggcacacgucaccauacccggcuaauuuuuuuucuuuuuuguggagacagggucuggauguugccuaggcuagcuagucucgaacucaugaguucaaguaauccucccaccuuggucucucaaaaugcugggauuacaggcaugagccaccacucccagccuuguuuuuauauuuauguagucaaauuuaacaaucuuuaauucaucuggauuuugaauaacaauuagaaaguuucuucccacauuuagguuauagagaaaccuacuuuuguuuccuucuaguacuuguauaguuucacuuuuuuacauuuaggucucugauccauuugauguuugucuuguguacgguaugaacagugaaucuaauuuuauccuuuuuccaaaugcuuauucaguuucccaucaccauuuauuaaaauauucauuuugcccuuguuauuuaaguuucacgauuaucauauacuaaauucccaagcugagucaauuuauauacacacauauauacauauauguauauauagccauaagaucuuauugaucauauuuuuaaauuuucuauauccauuuuuauuuuuuaucugcuucaucuaucuuuuacuaauaguaguguguuaaagcuccuuauuauuagugguuucuauugauuuuuuuuuauacuuuaaguugcagauuuguuacauaugaauacaugugccauggugguuugcugcacccaucagcccacaucuacauuagguauuucuccuaaugcuaucccucuccuaguccccccaccccccgacaggcccuggugugugauguuccucucccuauguccacguguucucauuguucaacucccacuuaugagugagaacaugcaguguuugguuuucuguuccuguguuaguuugcuaagaaugaugguuuccagcuucauccaugucucugcaaaggacaugaacucauccuuuuuuauggcugcauaguauuccaugguguauaagugccacauuuucuuuaucuagccuaucaucaauggguauuuggguugguuccaagucuuagcuauugugaacagugccgcaguaaacauacgugugcaugugucuuuauaguagaaugauuuauaauccuuuggguauauacccaguaaugggauugcugggucaaaugguauauuucugguucuagauccuugaggaaucaccacacugucuuccacaaugguugaacuauuuuacacuaccaccaacaguguaaaagcauuccuguuucuccacauccucuccagcaucugguuguuuccugacuuuuuaaugaucgccauucuaacugaaauuagaugguaucucauugugguuuugauugggauuuuucuaaugaccagugaugaugagcuuuuuuucauauguuucuuggccacauaaaugucuucuuuugagaagugucuguucauaucguuugcccacuuuuugaugggguuuuuuuuucuuauaaauuuguuuaaguuccuuguagauucuggauauuagccuuuuugucagauggauagauugcaaaauuuucucccauucuguagguugcuuguucacucugaugauaguuucuuuugcuaugcagaagcucuuuaguuuaauuagauuccauuugucaauuuuggcuuuuguugccauugcuuuugguguuuuagucguggagucuuugcccaugccuaucuccugaaugguauugccuagguuuucuucuaggguuuuuaugguuuugggucuuacguuuaagucuuuaauccaucucgauuuaauuuuuguauaagguauaagaaagggguccaguuucagcuuucuacauauggcuagccagucuucccaacaccauuuauuaaauagggaauccuuuccucauuucuuguuuuugucagguuugucaaagaucauaugguuguagaugugcggcguuauuucugaggccucuguuccacuggucuauauaucuguuuugguaccaguaccaugccguuuugguuacuguagccuuguaguauaguuugaagucagguagcaugaugccuccagccaccacaaucaagucggcuucaucccugggaugcaagacuggcugaacguaugcaaaucaauaaacauaaucugucacauaaacagaaacaaugacaaaaaccacaugauuucuuaacagaugcagaaaaagccuucaauaaaauucaacaccccuucaugcuaaaaaacucucaguaaacuagguauugauggaacguaucucauaauaagagcuauuuaugacaaacccacagccaauaucauacugaaugggcaaaagcuggaagcauucccuuugaaaaccagcacaagacaaggauacccucucucaccacuccuauucaacauaguauuggaaguucuggucagggcaaucaggcaagagaaagaaauaaagguauucaaauaggaagagaggaagucaaauugucucuauuugcagaugacauggguguguauuuagaaaaccccaucgucccagcccaaaaucuccuuaagcugauaagcaacuucagcaaagucucaggauacaaaaucaaugugcaaaaaucacaagcauuccuauacaccaauaauaaacagccaaaucaugaguuaacgcccauucacaauugcuaaaaagggaauaaaauaccuaggaauccaacucacaagggaugugaaggaccucuucaaggagaacuacaaacuacugcugaaggaaauaagagcggacacaaacaaauggaaaaacauuccaugcucauggauaggaagaaucaauauugugaaaaugcccauacugcccaaaguaauuuauagauucaaaucaagcuaccauuaacuuucuucacaaaauuaggaaaaacuacuuuaaauuucauauggaaccaaaaagagcccauauagccaagacaauucuauugauuucguaauucaucuccugauguuuuugcuuuauaugaguuguuuugucuuuuuugcugcauagauaugaagaacuauuguauuuucacuuuuaauuuuggcuucuagcauuauaaaauaaccuuuguuuuauuuaaugauuuuggcguaauucuacuuugucugauagcaggaucacuuucuuauuguuuccauuugccugguauaucuuugcuuuuuaaaaauuuuuuagcguuucuaaaucucugauuuaggucugucucuugcauacagcauagaauuagauuuuacuuucaagcaaauugaaaaccuuuugcuuucaaugagugaauuaugcucauuuccauuuauugaugugacugacaugccuguuguaaaugcuguuguuauuuuaauaauuuauuuuugagacagaaugucacuccagugcccaagcugaagugcagugaugugaucauggcucacuguagccucgaccuccugggcucaagcagucuucccaccucagccuccuugguagcugggacuacaggcacacaccaccacaccuggcuaaauuuuuguauuuuuuguagagauggcuaagucuuuguguuuuuuucgccauguugcccaggcugaucucgaacuccugggcucaagugauaugcacaccuuagcuucccaaagugcugggauuacaggcgugagccacugcacccggcaagaacugauauuaauaaagagaauuggcaaguuagguucagugaugacuuaaacccuugcuggagugguagggacaaaagccugauuagagagaaugggagaggaaugagaaaaugaagacagugagacagcuaacuuuuuuugagaaauuaugauaugaaggaagaagaaaaacagggcagaaauuggaccagaaauuggaccagagugaggcugguucuuuuuuuuuucuuuuuuuucaaugaaaaauuucauaccuauaaaagaaugugauauaaauaagugcuuccuugcccagcuuauaaaaauaaauuguguguuuucugguuuuuuuuuuuuuuuuacacuuauggaggcaaguuggguuuuuuuuaagguagguauuuuuguauguucuauacugacgggagugaucccaaagaggagaggaauaaauugaugauagagaaaauaaagcauucaauuauucgauucaacaacuauauuuuugcuaccuacaaggaacuaaucacuguaugauguaugcuuaggaugaacagugaguaaaacaaaguuccugcccuuguggcauuuuuagaguagaugagagggacugugaucuggugcacgaguggauggguuucccuuaaauuggagaaaggacggccaggcgugguggcucaugccuguaaucccagcacuuugggaggccgaggcgggcggaucacgagguaaggagaucgagaccauccuggcuaacacagugaaaccccgucucuacuaaaaauacaaaaaauuagccgggcgugguggcgggcgccuguagucccagcuacucgggaggcugaggcaggagaauggcgugaacccgggaggcggagcuugcagugagccgacaucacgccacugcacucuagccugggugacagugaggcucugucucaaaaaaaaaaaaaaaauuggagaaaagacauuuaauuuauuguacaggcagaauguauaauauguaaugcauauagauuaauuaauuuugugucagaaagauguuugcugcuucuaauugcuuguauuuucuuauugaaauaagauguaaagccaccaguuaagagucaguagggccaggcucaguggcuuacgcugguaaucccagcacuuugggaggccgaggcagguggaucaccugagaucaggaguucaagaccagccuggccaaaauggcgaaaccccaucucuacuaaaaaugcaaaaauuagggccgggcgcgguggcucacgccuguaaucccagcacuuugggaggccgaggcgggcggaucacgaggucaggagaucgagaccauccuggcuaaaacggugaaaccccgucucuacuaaaaauacaaaaaaauuagccgggcguaguggcgggcgccuguagucccagcuacuugggaggcugaggcaggagaauggcgugaacccaggaggcggagcuugcagugagccgaguucccgccacugcacuccagccugggcaacagagcgagacuccgucucaaaaaaaaaaaaaaaaaaaaaaaaaauuagccaggcaugguggugcgccccuguaaucccagcuacucgggaggcugaggugggagaauugcuugaaccugugaagcggaggcugcagugagcugagauugagccacugcacuccagccugggugacagagcgagaccccgucucaaaaaaaaaaaaaagaggaagggagaagcugcugaaguuuuaaggaaggaugagaauauaugaaauuaucucugagaauguaaaaguuaauuggcuaggaaauguauugcuggacagugugaaggauccccuugagauuuggguuaucaguuuaaaaggagacuagccaaugcuguuaccaguuuucuauccauguuuagcuucuuggguucauaugcaaaguaggcagagaguuaggauauaacuagcaucuuuaccuggugaguacaagggaugagaguaguaaggaagacagugauguauauuaaggaguauuuauagugauggaccacauaagcuguguaaacgagaccaccaaaggaauuagggugcuauaaaucaguguaacaaauggauugaggauccuguuagaaucagaauugcuggagccagaguaaaaagucagugaguuggaaaaauagaagguggugaucagacaauaggauguaagcuuuuugaggucagggauuuuuguuuguuuguucauugcuguaucucuauaaugccuggccauauucaggguucaauauaugugugucacaugaauuaauaugauauuuuaaagugagauuuuggaguuggugcaauuuuugguaaugccaaggaguagaguauaacaaagugguugagugacuaaggcgagaaggagaaaaaaaauaauugaacgugaugaggucauggagucucagccauaaggauguuaaagucacugaaguaauuuuuuuaaaaaacagagauaagaaaauaguccuaaugucuuuuuuaaaaaacucauacuggucaggugcaguggcuuacgccuguaaucccaacacuucgggaggccaagguggguggaucacuugaggcuaggaguuugaaaccagccuggccaacauggcauaauccugucucuacugaaaauacaaaaaucagccagguguggugacacaugccuguaauccuagcuacucuggaagcugaggcacaagaaucgcuugaaccccagagguggagguugcagugagccaagaucgcaccauugcacuccagucugggcgauagagcaagacucuugucucaaaaaauaaauaaauaaauaaacaccuuauacuuauugaaguuauauguauauaucauuuaaauaauucaauaucauuuaauaaauuaauaauuuaauaauuuaaauaauucaauaguucaagcuuuguuccuaaaaauauuaguccccugaccacccccaccccauaucccuaacccgaaagguucucuucuuuuagcuacuuuguuuuuuaucuguaugucucuaaauaacaugcuaaaauuguuacuucuugaauuuucuguuuuguuuguuuguuuuuuagaaacacgaucucacucugucacgggugcuggagugcaauggcacaaucauagcuuacugcagccugaaaccugggcucaaaugauccuccugccucaaccucucaaguagcugggacuacaggcaugcaccaccaugccuggcuaauuuuuaaaauuuuuuguagagauaaggucucgcuauguugcccaggcugguuucaaacuccuggccucaaacaguucucccaccuuggccucccaaaaugcugggguuacaggcaugagccauugugcucagccaacccuaaguuuuaaaaagauuuauuaguuguauuuuuucucauuguuaugaacuucccuuuagagugaaaguuugauuugggagaacaaaaaaaaucucuuguuuuuuucuauuccaagucagugcauuuagagaugaaaauuaaauugcauauaucuaaauccuagaagagacgugacaggcauuuuuauagggaacucauuugaacauaauuaaaaauuaauauaggugcuucuuuccuagcuucacacaguaaggaagaauauaauuccucuauuuguucuuaaucugaagaggaaaauuuccuuggaggacgugaaugaauuaugaauauuagaaccauaaauguugagccuucauuuuaaguuguaaaucuagcaagcauaucaucauucuucagccgugcccuccaggacagcugcuuuugacuucuuuccuuucagacaucucugccuuuugcuucuuugguaguagcagguucauuuccuaccuucuugcauuagggaacugcaaaguugucucuguggccccuguccuaacucugaacagucagucucuacaaagggagcauucaccucugucagaauguauacuguuucuaaacauuuaaaaucagauguuuuaauauuugagucaaauuaaacaaagagaaggagauaacaggaaaaguacuaacauuuacucaugcguguuugccagcacuagguugaacucugaauauacaaagauaaaagggcuccuuauggagcucaaagucuagauggaaaaaauauauauguaauccaauuagugauuuaaggucuguaauggaucagaaaaugcaucaucucuaggggagauaauauaucggcucugcccuuucuaguaacugugacaagaccugaauuuugauggauaaauauauaauagaguaggaagacagacuaggguauacauucuuggcagucgacucuaucaaauuaacacuggcggccaggugcaguggcucaugccuguaaucccagcaccugaggaagccaaggcaggaggaucacuugaggucaggaguuugagaacuagccuggccaacauggcgaaacacugucuguacuaaaaauguaaaaauuagcugggcaugguggcauguaccuguaaucccagcuacuugggaggcugaggcacaagaauugcuugaaccucggggggcggagguugcagugagccgugaucgugccauuuuacuccagccugggcaauagccugggcaauagagcgagacucuuucucaaaaaaaaagaaaagaaaagaaaagaaaaaguuaacauuggcuauguggaggggaguugggggagagaagacugaauuagguagguggagucauauuuugaagacccuuaaaaucaugcuaaggaauuccaacuuaaucuuguugagcagcaaucuccaaaauaggcuguacucaaagccaggugguguacagaauuaaguaccagaggaaaauguuagaauuucuuguuuuuaaauguuuuauuuauuccuuuuuaaaugucuaucuuuauauauauuauauaaagagcauaucauauuauagugaucuauauauuuuuuuaaaaauuuuaagguaaguggcaauaaguucaacuuuuuugauguuuggaaaacacuguuuuagggugucuuugagcagggaaaagacauaugcaguagaaauuagaguauggauuagaauaagggaaaacuggagcaagagagacaccagccaagagacuggaagaagauuuugagaccugaacuaaggcagugcaauaggggaagaguaggggacagggcaggagaggaaggacuuccauccuggacuaugggcggauuucuggcaucagauucuggaugguagcaacagcaugauuaaacuaaggaauauaguaaggauauuuagcugugagcccaaggauuaucacauuucuuacuuacugacugaguuggucauuucccuuccuagagcuacugccccaaccucagugaaaacaauguggcaguuggcccuuggccuugcacuuugaggacuauagacuggaaucuuuuccaagcauuuuaaaccaaaacugaggucuccauugcaguuagccuuugguguuuauucaagcacacaaacuaugccaggugcaguggcucaugcauguaaucccagcauuuugggaggcugaggcaggaggauugcuugaguccaggaguuugagaccagccugggcaauauagggagaccccuugucuaaaaaaaaagaaaagaaaagaaaaagcacacaaacuacucuuggggauuugacugggauuggaccacauaggaaaauguaaaaugugaccuucauagucacaccaaguagcugaauucaugaguuccauaugggcagggguggcaugcaggcuggugauuuggaucauagccauuauuuguggaagcacugggugaguagagaagcaugguaguuaccuugcccugacaguuuuuuuccaagggaguaaauguguuuuucuuucuccuugucauaagaaaucgguugccagauuguguuauuuauaacaaucugucauggaacagcugccaggaaaagaaaagaggcuauucccaguagcucuccucaccucccgccccaccacuacagccacacacacacacauccgguuuucugauuuaaccuuuuuuccccucuaauuuuacucagugguuuuggcuugaucgaaaauguucuuguaaugagagauuucugggcuuugccauggcuugguaauuggguuuucugagcuuaauuuguuuacuuuagucaagacuaacuggcagcaguuuggauuuugaauuccuggguguuuuggacacuuuaaacacuaaagugcugccuucccuugaaaccuugcauguuucuauauugucaagagugcacacaucugcuuuccuucugaguugugcuuucugcccuugacauugcccuggcuucucuagaggagcaggcuugggaugaggcauaccaaugacuguuggaauagugaguagggagaucuuuggagaggccaguuggucucugcagaagaggcauacuguuggcauuagaaaagaaguggguccaugaaacaaaggcagcugaguguuggcauguucagggaacuuuaaaauuaacugcauuucugacacacaguugcuucacaguccaaacaguccauguuuauucauggcuuguggucacacaugaucaaaaauacuucucugggucuuaucaguuuuucuacuuucucucucugggcuccaguuacuagaaagccauuugcauuccuagaaugggcuuuacauuuuagaauaaaaauaaaaacaaugaucauuucuuucuguuacagcguuuauaaaaucaggccaggcucaguggcuuaugccuguaauuccagcacuuugggaggcugagacaggaagaucacuugagccuaagaguuugagaccagcccuggcaacauagugagaucccgucucuacaaaaaaaaaaaaaaaagaagaagaagaagaaauuaaaauuaguggacauaguggcauguggugccuguagucccagcuacuuaggaagccgaggugguaggaugcuugaguccaagaauuugagguuacagugagcuaugaucacaccucugcacuccagccugggcaacagacugagacccugucucaaaaaaaaaaagguauuaugaagguauaagugugauuuagcuuuccuuucuuucuucuucugagauuuccagcuuuggaaauugaucagacaacaaacacuuuccuuuggaagugauggaguugcacagaggaugagauguguuuggucucagugacucuuacauggugcauucucugggaacagaggcaggagaggggcugauggaacagcaccuccgucuguaugcuaggcccuguucuuucagacccacgccuuucuuuucacacuaagaacagauggcaaccagacauugaguggaggggucuguuccuugugauccuuggggauuuugcauucaguuuagcaaaaagucaucaaaacgcaaagagagaaaugagccuacagccuguucacaauuaugcaggacuuguuuggcauucacuguacugacagauuuaaacacuuuugcagauaucgaaugauaacagcauuuauuugccaagacaacauuguuaccacuucugaggcaucugcauuggagucauuuucuugauuuuggaguauacuuaauaguucaauuuauuguagaucaguaaacuugcaaaaaaacagccaucuuauuagagaaacuuagaaaaauagaaaggggauuuuuuuccucagcaaauugucauuuucauucugaugaaauggggcaacuucuguacuguuguaaugacaacucugugaaugucuuuaguaaugauuugucuccuugucuuucuaagcauuguucuaaguaggauucugcaggcuguuucuuuaguuuguauguauguggucugauuuguucacguuugcugcuuccugcauggugaguugcagguguaggguuuuuuuuuuuccuaaagagauguuuaugggaacuuuuuuuuuuuuuuugagacggagucuugcgcuguuacccaggcuggagugcaguggcgcgaucucggcucacggcaagcuccgcccccuggguucaugccauucuccugccucagccucccgaguagcugggacuacaggcgccugccaccacgcccugcugauuuuuuguacuuuuaguagagacgagguuucaccaugguagccaggauggucucgaucuccugacguugugauccacccgccucggccucccaaagugcugggauuacaggugugagccaccgcgcccagugggaacuuuuuuuuuuuuuagucucagaguuaaaaucuaaaaagaauuuagagagccuuaagcagaagaguaggaaacaauccgaauuugagcuuaacuuuaaaaggccuucaaaagaaauuguucaggcuauaaauaacaaguuacauguggaaaaagaaauggugauucuguugcagauucuauauucagaauaagaaauuucaggcaguaacauaaggcauucugaugguugagucucacuuucugagcaaacaagacucuuugauuugguagacuaugaguugaaaucauccauuuucccacccaaaccaggaaucaugauuuuaaauuaaaauauuaggaaaguuuggaguacuuacaaaaaaaaaaauacauguagacucacuucauucuugaacccaaaauaauuugguccaauguuuuccagacuauuuauuuauuugagacaaggccucacucugucacccaggcuggaauccaguggaguaauuguagcucacuagagucuugaacuccucugagguuuaagcaauccucuugccucagccucccaaguagcugggacuauaagugcaugccaccacaccuggcuaacuuuuaaaaaauuuuauuugcuaauuuaaaaaauguuuuauguauuuuuagagauggggucuuacuguguuguucaggcuggccucaaacuccuggccucaagugaugcuccugccucagccuccagaguagcuuggcuuacaggugcaagacacugugccaggccuuuuuuuuuuuuuuuugagacagcaucuugcacugucacccaggcagaagugcagugaugugaucauagcucacucuaaccuugaacuccugggcucaugcaguccuccugccuuggcaucccaaagcacugggauuacaggugugagccacucugcccagccuagacuuuuuuaaaguagcauaauugguuuuccaagacaaagcuuauccagaagccuggaaaauaaaauuaauaaaagaggagcugccuugguugauucacgaagggcaaaucagaaccugccuuucccugaggcaccucugggauuacaggcaugugcuacugugccuggcccuaaacuauguuucuuuuuuuucuuucuuuggagauagagucuugcucugucacccaagcuggagugcaguggugcuaucucggcccacugcaauuuccaccuccuggguucaagcaauucuccugccucagccucccgaguagcugggacuauaggcaugugccaccaugcccggcuaauuuuuguauuuuaguagagauaggguuucacuguguugcucaggcuggucucaaacuccugaacucaggcacuccgcccaccuuggcgucccaaaaugcugggauacaggcaugagccacugcgcccagccuaaacuauauuucuuuaacacuauucaguaauacagauucuuuaguuauacaaauagccauuacuaauuguuaaaucuuaguuacauaacuacuauaaaucuguuucuucguugguaaagugcuaauaauaacagcucugggcuaggcgcgguggcucacgccuguacuccuagcacuuugggaggccaaagugggcaaauugcuugaguccaggaguucgaguccagccugggaaacauaggaagacccugucucuacuaaaaauaaaaauaaaaauuagccaggugugguggggcacgccuguagucccagcuacuagggaggcugaggugggaggaucacuugagcccaggaagucgaggcugcaguaagccaugaucaugccacugcacuccagccuggguaacagaacaagacccugucucaaaaaaacaaaaauuuagauauagauauagauauagauauagauauagauauagauauagauauagauaguucuuccugcauaugguuguugugaagauugaaauauguuuuuggccaggcgugguggcucacaccuguaaucucagcacuuugggaggcugagacaggauuguuugagcccaccaguucaagaccaaccuggacuacauagugagaaacauagugagacccugucucuauuuuuuuuuuaauuuaaaaauaaaauuaaaauaaaaaauaaggccgggcgugguggcucacaccuguaaucccagcacuuugggaggccaaggcagguggaucacgaggucaggaaaucaagaccauccuggcuaacacggugaaacaccgucucuacuaaaaacacaaaaaaaauuagccgggcgugguggcgggcgccuguagucccagcuacucaggaggcugaggcaggagaauggcaugaacccgggaggcggagcuugccgugagccgagaucuugccagugcacuccagcuugggcaacagagggagacucugucucaaaaaauaaauaaauaaaauaaaauaaaauaaaauaaauaauguuugcaaaguguuaucacaauuccuggccaauaguaagcauucaguaaacauuaguuaucauuguuaguuuuuauuauaauuaaucugagauauuagaauuauaaucaggcaugguagcucaugccuauaaucccaacacuuugggaggccgaggugaguggaucauuugaacccaggaguuugagacuagccuaggcaacauagggagacaccaucucuacaaaaaauguaaaaauuagccaaguguggugguacauaccuguagucccagcuacuugggaggcugaggcaggaggaugacuugagccuggcaggucgaggcugcagugagcugugaccgcaccgcugcauuccagucuaggugacagaguaagacccugucuggaaaaaaaaaaaaaaaaaaaaaaaaaaauauauauauauauauauauauauauauauauauauauauaaaaucagaaagcccaccaauaagagaaaaccuuuucuucguugauuuauucauucauuuguuaaacaauuauuaaauaccaacugugugucagacacugguaacaggccuuauuuuucucagcuauaaaaauagaggccaguaauauuaauaauaacaaugccuuucugucauucuuaugcuauuuuuauaagauugaaugggugccuuguacauaccugagguuacauuguaauuauuuacuauagaauguuaaguuccuaagaaugaagcauuguauucuguucauccuguuauuuccuaguacuguaguaaagugauuguucuuugccauauuaagucaucaaacuaugugaaaaugcucuuuuaaacuauaaagagauguauaaauauaagaucauauauuccauagucauagaaauagacaauguggugguuuucagacuguuucuuagaaccuaggguuccagagaugucucagggacugcccacacaguuccugagguacacaagggagagguagaguuuccagacccuauaccagcacaauucaaugagaacaaccccauuuauuuuacuuguuuggcuaugaaaaaugcuugaagaguauugucugauuugugugguuuuaagccauccuaauuuugucuugugaugauuuguguaauccauuguccuuuaugauauugacuuuucccaucuccauuuaacagacagaugugcuggugcugagcugugaucugauaacagacguugccuuacaugagguuguggaccuguuuagagcuuaugaugcaucacuugcuauguugaugagaaaaggccaagauagcauagaaccuguucccggucaaaaggggaaaaaaaaagcagguaaggaagauuggaguuuguuuuguuuguugaguuuucguaauuauuauucucacucaugcuuucccugaaaaaacauuuauuaagaaucuacuauacaucacagauucugugcuaggaguugaugacauaaagucaaauaagacacagucccugaauggaaaaugcuuagaacuauugauuagauucuuuaauguccuuuuguaugcagagaggaacauucagaacuauuugcauuguauuuaaggcucaaauaauugaauacguauaucuaagaaacaaacaaacaaaaauccaauuuaaaauuaacuuuuaaaaauaggccaggugcgguggcucacaccugugaucccagcacuuugggagaccgaggcagggggaucacaaggucaggaguuugagaccagccuggccaacauggugaaaccccaucucuacuaaaaauacaaaaauuagcugggcgugguggcgugugccuguaaucccagcuacucaggaggcugagggaggagaauugcuugaacccaggaaggggagguugcagugagccgagaucacgccacugcacuccagccuaggcaacagagcaagacuccaucucgguggggggagaaaaggaauuaaaguuacuaucacaaauuuaguauggcugguucuuucaaugcuucagucacccuaaaugaccaauaaaugugauaguuguuucuuuuucuuuuucuuuuucuuucuuuuuuuugagauggagacucgcucuguugccaggcuggagugcaguggcaccaucucgguucacuccaaucuccaccucccggguucaagcacuucaccugccucagccucccgaguagcugggacuacaugcacaugccaccacacccagcuaauuuuuguauuuuuaguagagacgggguuucaccauguuggccaggauggucucuuacuuaucucuugaccccgugauccaccugccucugucucccaaagugcuaggauuacaggcaugagccacugugcccagcugauaguuguuaaucaugcuuaucuuccuaggauuauaacauacuuauuuugauuguaacauacuuauuuugauacuuauuuuccuaggauucuaguaguccuuuuauggguuuaaauuuuccugaaugauguguuuuuuuccuugaaguuuuccucuggaaugauguauucuuuagguuuugcuuugccagcauuauguaacccacuauuuugucauuauuauauguuggcauauuuuguuacaauuauuagacuauguauagcuuauuaauuucuuacuauuauuaauagagccacugagagccuucauacuuaggauuugaauaaucuaguuaauauuuuaggacguuugguuaaauuauaauuuuccaguauaacauugaaacuuguuucuaguugcuuuuuguguucagaugaucacuggugcagauuaauuguuggauacuuuuucuacauuauuguuaugugaugauacucaugcugaucagucuuuuuguucuucauauaguuucugcuuuugcaaggucugguuuacuuacaauucccuguauucauucuuuucugccuacacagauagaaauaaauauauaaccagauuuuauaaacagauauauguuucauaauuaauuuuuuuguuuccuuuguacucuauuuauaaaaaucaauuaaaaaaucaacuuauucuucuugucauuagaacuuuucuuuaaauuuucucccuuuucauaggcauugauaaaacuuuuuaauacacuuuauauauaguuuuuaugucuuaaguaucauuauaaaugcacagauuuucacaauuccuuuucuuuuauuguaaauuuaacaauuuauaauuguauaaauuuaugggauacaaagcgauguuauaauuuauguauacaauguggaauaauuaaauuaaacagguuaacauauccaucccucaaauacuuaacauuuuucauggugagaacauuugaaauuuacucucuuagcaauuuugaaauguacaauacucuuguuaacuauauuuacaacauaauucuauuuuaaauuaacuguaacuauuagcuaccuaccauccauuuuuaaauguuuucaugcuuaaauugucaguuuggccaauggaaguccuuuaagcuggauccuuuauccucugaaaaaguaugauguauacugguaacuuucuauagcuggagugugaauauaggaggcagagaagcagauaggacuggagaagagccagauaucagacgaaagaguuugaauucuugcccaaaacagugaggaaguuguugaaguaaacaagauagugucauaauuagauuagauuaauguuuuaagaagauuuuucuuuccuuuuguuucuuuuuuuuuuuuuuuuuuuuuuuuugagacagggucuuacucuguugccgaggcuagagugcaguggcucaaucuuggcucgcugcaaaccucugcuuccugggcucaagcaauccucccaccucagccucccgaguaacugggacuauaggcacucgccaccaugccuggcuaacuuuuuguauuuuuuguaggcacaggguuucacaauguugcccaggcuggccucgaacucuugagcucaaaagcaaucucccugccucagucucccaaagugcugggauuagaggcaugagucaccacacuuggccucuuucuuucuuucuuuuuaaaaagauacuggggggcaccauggcucaggaccguaauccuagcacuuugggaagcugaggcaaacagauggcuugagcccaggaguuugagaccagucuggguaacauggugaaaccccaucucuacaaacaauuuuuuaaaaauuagcugggcaugguggcuugugagccucuagucccagcuaccugggaggcugaggugagaggaucacuugagcccgggaugucgaggcuacagugaaccaugaucaugccacugcacuccagagucucacucugucccaaaaaaaaacagagagagagagagagagagagaaauuaggucucauuauguugcccaggcuggucucaaacucuugaccucaagcaauucucccaccucagccugccaaguagcugguauuacagguaccagccaucacuccugucaaguuuucauucuuaauaugaaauuuuaaacuucucaauaccuauauuuuguuacauuugaaggcuaagauucaccuaaauaauugaguuuuaaauuccucccauagaaugcuaugcauuuccaucauaagcauuuuuuaaagaaucguaaguuuuucagauuauauauuuggcaugccucuuggcugcuguugugugccagaacagccugcaguccacuguuucccagauauuguuuaauagucuagaucuucuagacccaacuuccucaaauggcguucuuacugacuuauaggggaauggcuaaucucuggauguuucuggagccaccuuucuuccccuugcacuuucuucucagaaaauuuauaggagauacugauacuaagagggcaggaucaaauucauguuuagacuuuuuggaguauuucauuccugcugcaggucuuuuuuuuuuuuuuuuuuuuuuuuuuuuuuuuuuuuuugagacggagucucgcucugucgcccaggcuggagugcaguggcgcgaucucggcucacugcaagcuccgccucccggguucacggcauucuccugccucagccucccgcguagcugggaccacaggcgcccgccaccacgcccggcuaauuuuuuguguuuuuuaguagagacgggguuucacuguguuagccaggauggucucgaucuccugaccucgugauccgcccgccucggccucccaaagugcugggauuacaggcgugagccaccgcgcccggucugcugcaggucuuuacacagcuuccuugccugaaaugcucucuagucccuuucuccuccgaacacauauauuccaaauccagcuuagccuucaaguuauuucugagaaagaccuauccugaccuuuuaauauaaacuauauccuuuuguuugccuacauauagcagccugcucucuuauuuacucuuuccccuacuggacuauaagcuccauaagggaagggaucauaucuguuuuguuuauuuuauucccagcaccuggcccaguuaugucccauggugaacaaucaauaaauauuauugaauggccugcuuauaaaggcagcucuucuugccccccaccccagguaagugaagauagaccugagcacuagcaguuuaaaauccuaaagauguuagucugagcuauaguuggauucauaaguagguauuacaagagcgcgugagcuuguaaugcuuuuagcaauauggaucuagcagacugauacugacuacauugucuauuaauuuuauguuuagaaaugguuucaagauuuuuaaaaaaauacccagcacugcaccaugauuguuaagagcacaaggucuauagaguucagacuggguuucagugcucaaaagcugugggauuuugggcaaauuaccuugaucuucaugaauuucauuuucuucuguuguaaagugagccugaauccuuucaggauuuuugugagaauuaaaugacauguuuauaaggcauguggcccauucguuaccugaaagauaguagaugcuuaauaauuuguaauuacuauuguaauuugguacugaaacuuaacaaaucucauuuaauaacuuuguaaacauucuauaucacauauuuauuucauguaaaauggcaguacuuuaaaaaaccacagaauaucagaguguuuuuguuugcauuuuuaccauaauagcuuguaaguuugaagggaaacucauagugacaaaugucuagacaagccucucuggaaggcucacauguaacuuuuuuugagacagagucucauucugucacccaggcuggagugcaauggcgcgaucuuggcucacugcaaccucugccucucggguucaagcaauucuccugccucagccuccugaguagguggguuuacaggcguccaccaccacgcucagcuaauuuuuuuuuuuuuuuuguauuuuuaguagagaugggguuucaccauguuggccagacugguuuugaacuccugaccucaagugauccacccgccuuggccucccaaagugcuaggauuacagccaugagcuacugcgcccagcccacauguaacuuuucuagugauucaaacagcccugcuuucuagcauuuucuagaauguaccaacuuuugaaaaaaaaauuuuuuucucaggaaagaaauggacaacuuagaaguguaagcaagacccagaaacccagcuaaggcugugcggggaaaugggguucuaaacucugagaaaccucauuucuuuuuuuucaucaguagauaccauuauuauucagccauugucucgccauugcuugauacuacuuacugagugaaagggugaagagaucagcuuaccacaguuacugaguauguauuaugccaacuccugaacuaggcaccaaggcuauagaaacagaaaaaaaaaaaaaccaaaaugccacaauaucccuacccucaaggagacacaaaaaaguguucauuguacucuccccagucauagggcauuuuaagaaacuuggagucugauggggaaaauuagacuagguauuguguuuuuaaaagaauuuacaggcugggugcaguggcucacgccuauaaucccagcaguuugggaggccaaggugggaggaucauuugaggucagcaguuugagaccagccugaccaacauggugaaacccucucucucuaaaaauacaaaaaaauuagcugggugugguggcacaugccuguagucccagcuacucgggaggcugaggcaggagaauugcuugaacccgggaggcagagguugcagugagccaagaucacgccacuguauuccacccugggcaacagagcaagacuccaucuccaaaauaaaaaaagaauuuauaaaagccucucauuuguaauuguuuacauucacaaacaucaaacaguaaagacgacacauagagaauuucagugacaccguauaugcauauauaucuuaaacuugcaauaauauguaaaaauaauuuguuuuccaucccuuguuagaaacuuuccuuuucucaauuucagugagaagauaauauauuuauauugcuuuauugcagauaauauguuuauuagggggcuuuuuuuccuguacauuccucuauguaauuguuuaauacuaucaugauuuaaugacacaaaucauugacuauugucucuauagucccacuguaucucuuggaauacuugaaauagaaaauguucuaggaaacuuuauuuaaccaauccaauucacuguaguauuucccaaacuccuuaguucucagaguuauauggccuuggcccagacuagaaucaguacauguuaauguacuucagaaccaugagugaaaacucuuacuuggcugucaccucuuaaucggcuuagcucccucugcacuaacagauguuggcaggcaguucugagccuguacaguauuucuuuugcuacagcuuucuuuacuucucuugaagcuguacuaccaaaaaaaaaccuguuugggcuucuguguuaacuauuuucuccucucagucuuccaaaucccaccccauuuuaaaaaauaaagugggccaggcguguggcacacaccuauaaucccagcacuuugggaggcugagguggguggaucaccugaggucaggaauucaagaccagucuggccaacauggugaaacccugucucuacuaaaaauacaaaaauuagcugggcgugguggugggugccuguaaucccagcuacuugggaggcuaaggcaggagaauugcuugaaccugggagguggagguuguagugagcugggaucaccacugcacuccagccugggcaacaagaacaaaauuccuucucaaaaaauaaaaauaaaauaaaaaauaauaaaaaauuaaaaaaauuuaaaaaacaaaauaaaaauaaagugacuugaaauuccuacauacucaaaauugaauuuuguuuuguuuuguuuuguuuuuugagacagagucucacucugucacccaggcuagaucgcaguggcacaaucuuggcucacugcaaccucugcccuccgaguucaagugauucuccugccucagccucccgaguagcugggauuacaggcgccugccacugcaccuagcuaauuuuuuguauuuuuuaguaaagacgagguuuuaccaucuuggccaggcuggucuugaacuccuuaccucgugauccaccugccucagccucccaaagugccgggauuacaggugugagccacugugcccagccuguuucacucuuguugcccagguuggagugcaauggcacgaucuuggcucaccgcaaccuccaccuccuggauucaagugauucucuugccucagccucccuaguagcugggauuacaggcaugugccaccaugccuggcuaauuuuguauuuuuaguagagacgggguuucuccauuuuggucaggcuggucucaaacucccaaccucaggugaucuucccgccucggccucccaaagugcugggauuacaggugugagccacugugcccagccauaauuuucuuauuuaccaaguguuugucuuguuuuuuauggccuaauagcauuuugaccuaauagcauuuauggccuaauagcauuuuguggacaguugcucgagauaacaucagugguaagugguaagagccagaacucaaacccaugccuucugauuccauaaccugugcuauuucuuuuuugaauuuaguuuuuaucuuuaucaaaguuuuauaugcccaaaauuuaaagaguaucuaauuaucuaagauauauuauaauaaauagcagccccucacccuaucuauccucaccccacuuagagaugccacuuucaacauuuucagcuaauuuuuuggcauuuaacuccauaucuccaaauaacgugcuuuuauuuucugugucuuaauuuuuuuagcuuuaagaauuaucuguucacuucuuacuauagaauguaaagauuugguucuauuuuaccacaugcucugcccccacuacauguaugcaaccuuguauuuggcccaauuuccuaauauaguuauucauauuguauuauuaauuaacugaauauuuuauguuuauauuaucaugacuguauaaauaguauucacaguugagccuuguaguauaugauuacuuuucucuuuccuccuuuuguuuuccuaaagauugucuuguuuuuucauuugcuuguuuuuuauguauuugucacuaauucaacccaagcuccaauugugugaauuuccucuccuuacauugcaacacacuagauguccucucaauuucaaauucuucaagguaccucuccuaaagcuuuucuaaccugaguuaguugcccugcuguagagcugucauuuuagguucacccuucacugucauaucuugaaccucacguuuucuucuuucuuacuuuauacccacauuuucuguaggacacauccucuggaagccuccugagguacagauugugagaaguaaauuuuugagcuuuuguaucccugaaagugucuuuauucugcccacauauuuguuucauauuuuggcuggauauaaacuucucuuggaaaucauauccccucaaaauuuugaagguuuuuuguuuuguuuuguuuuguuuuguuuuacugucuucuagcuuuucuuuuaagaaguccaacaucauucugauucuugauucuuugcaugaaacacuuuuuuccucuuuuucuugggaugggagggggagcuuauaggaucuuuuuguuuccgaaguucuucaagugagaacacuuaaaaucuacucucuuaggaauuuucaagaauacaauacauuguuacuaacuagucaccagguuguauuaggucucuuuaugagcuuauuccuccuaagugaaauuuuguauucuuugacaaaggucucacaauaguuuuuuguuuguuuguuuguuuguuuaucacaugguauuccuaagcagacuuccaugcaaguacuaacuaggccugacccugcauagaucagaugagaucagaugccuucagggugauauggcuguagacuucccacccccacccaguagucuaaguuucugguuucuuuuucuugucuuacugugcuggccaggaccuccaauaaaauuauguguacaaaugaugcuaguuggcacccuuuucucauuccugauuuuaaaaggaauauuuucaacaucucuccaguuaaaaugauguuuauuacuauagggguguguguguguguguguguguguucguuuugagacagucucucucuguuguccaggcuagaaggcaguggcacaaucuuggcucacugcaaccuccgccuccuggguucaagcaauucuccugcuucaaccucccaaguagcugggauuaccagcaugugccaccaugcccagcuaauauuuguguuuugguaugagguuuugccauguuagcagagaugaucuugaacuccuagccucaaaugauccaccugccuuggccucccaaagugcugggauuauaggcgugagccaccaugcccagcguacuauacauuuuuauagguacuuguuaucagauugagaaaguuccuuucuaguucugguuuauugggagcuucuuggccuaaggauauaaauuuuaucagaugcuuuuucugcaucuaucaagugguauaugauuuuucucugaugaugugaugaugauaccugggauaaacccaacucggucauggcuuauuauccuuuuacauguuguguuaguuuuuacuacauaacaaauguucguaaacucuaguggcuuaaaacaacaaacauuuacuugcuuaugagucuguagguuggcaguuuggccuaaguguagccaagauggcucaucucuguucaagugauaucagcuaguguuuuaacaauuaauuacuuauaaaaguugccacacauuuaacaguuuaaaacaacacugugggccaagaauccaggcaugacuuagcugguccaccagucuuucagaaggcugcagucaagaugucagcuagggcuggagucucaucugaaggcucaacugggaagggauuugguuccaagcuuacuugguuauugggagaauuucauuucccuaggacuguuggacugaaccucaguuuccaccaugcuguuggccagaagcuacccuccuuucuuuaucacuugggccuuuccaacuuggaaacuuacuucaucaaagccagcaagggagaaacucuucuagaaagacagaagucacaaucuuauguaaccuaauuauagaaguaacauuuuauuaccuuugccacguucuguugguuagaagcaagucacuaggccagcccacauucaagaagggauauacaagaaugugaauaccaggaggcaacuaucauucuuaucuuagucuccuguaacugggcucauuaauauguauagagccuugguugggcacaguggcucacaccuguaaucccagcacuuugggagguggguggaucaccugaggucaggaguucgagaccagccuggccaacauggcaaaaccccgucucuacuaaaaauacaaaaauuagcuggacaugguagcacaugccuguggucccagcuacuugggagguugaggcaggagaauugcuugaacccgagaggcggagguugcagugagccaagguugcaccacugcacuccagccugggcgacagagcaagacugcaccuccaaaaaaaagaaaaaaaauauauagggagagccucagccuugacagcuggauuuuucuuuucaucuagucucuuaccauccaggggguuagcccaggcuuguuuacaagguagcagcagcagguucuaagcaugacagcagaggcuacaaagucucuugaagucuaaacucaaaacacacacugucacuucagcugcugcgcucuguuaguucaaagcuaguuauggagcaagcccagauauaaaggauagggaacuaaccuuaccuuuggauaggaggagcuccaacaaguuugugacccuuuuuaaucuacucgacauacuauuuugacuugcuaaugaguaaauuugccuguuccuuucucauaauauccuugccugguuuuggcaucaggaucaugcuggccuuauaaaaugaguuggaauuccuaacucuagacauagcaccuaccauaggguagguguacaaagauauuuauugguagaaugaaugaaucaaugaaugaauggauaagcaaaaugccuguagaugagacagaagaaucagucagaaaaguaaaaaucaacuagggaaaaaaacgugaauacuugaauaugacggacuuuuuuuuuaauagaaguucaguuuugucugcuuucuuaaguuuguguagccuuucuucuuaggaagacauucuacaauuaccugcucugcucccaaagugaaauuccuauuuugcuaaagcagaacagaaagaaaccuuuccaaguuucuauaauuuguaucacauucugaagucccaguuacuguaauagcugcaaagaagcaauacaagguggagggucugagagggagagaaaaaugacuaaagugcaacauagcugaaaaauuggcuggcuggaaauuauugcucccaggacaucagugauucaagguuucugugagccuuaggacuugaguaggggaagcauuccaaauuauauccaaaaauaacaucuccguguuucuuuuguuaaauggcuggcucauaaugagacccuuacagacuuuguuacauucucaaguuuccauguaauguauaaguugauauaugucuaagcugcuauguggcauuugaaauucucugcaaaauuuagcuucagauuggcagcauuugcucuuccuuuuuuggauuucauuugguuauugaacuaaaaaaccccaacauauaauuuuuuauaauuguuuuuccucauuuauauuaaaacacugcauauaagaugaccagagaccaucugauuggugaucuugaauacuuucaaguaccugagcuaaacguauuguacaauugaaucauauauuugguuauagguauacaggcagcuuuagccaacagcgaaacauauucuguuauuuagcagccauugucugucaguaggaagcaaauucaucuuuacagaucucauuuuuccuagagcuaaacuuucuguuucuccuauguaaagagguauugaggcauugcuuuaugugguuguugugaggauuaaauuagaggguguauuuuguuuaauuuuuaaacuuaacauuuuauuuaauguuuuaguuaauaacacuauuauaaauucuuuacaaauauuaauucacuuauucugcauaauaaaccugugagacaaacacuauuauuauccccauuuuauagaugaaacugaggaagagagguuaaguaacuugcucuaacauaaacugguaauuggcugagcugggauucauaccuaggcagucuggcuccagaaguucuguucuuaaucauucugcuauuuugucacuaugagaaaauguuucuguaagcuauagauacuguacagauguuaguagcacauauuauuaaguauguaacacuguacuagauguuaugggagauagaaaagaaucagaagccugccuuugaaaaguuuauaaucuagucggggaagagaaguaugacauagaaaauagcaauaauauagcagccuguaagaucacugucuaccaagaccucuucacacauaauaaaauauagacuauacauagcauagaaucuacugccuguaguuaauguugguugaauguggaugacuuuaaauaauauuauucccauuuucacaguaagaagaccuagguuauuauuugcagagagaaaauucuuuaaaaaaaaaaaaaacgaagcgcccuaaauaaauaaaguaacuuuacuuaauuaauuaauuuauuuauugagauggagucucacucugucgcccaggcuggagugcaguggugugaucucagcucacugcagccucugccucccagguacaagugauucuccugccucagccucccaaguaccugggauuacaggcgccugccaccacacucggcagcugauuuuuuuauuuuuaguagagacgaguuucaccauguuggccaggcuggucuggaacuccugaccucaggugauccaccugccuuggccucccaaagugcugggauuacaggugugagccaccaugcccggccuauuuauuucugagagaaggucuuggucugucacccgagcuggagugcaguacagcagucauggcucacugcagccuuagccucccaggcuaaagggaucccccugccucagcuuccucacuauaggugcaugccaccaugcccagcuaauuuuuuuauuauuuguagagaugaggucuugcaguguugcccaggcugaucuugaauuccugggcucaagugaugcuucugccucagccucccaaagugcuggaauuacaggcaggaaccacugcccagccacucucucuuucuuuguaauauauauucaauauauauaaugcauacauaauauaauauauaugauuauuauuuucugagcuaucugagaauaaguugcagauaugauuuuccuuugccuuuaaauacgucaauaaguauuuccucccucuccuccaaaaaugauagucucucaaaacaggaaauuacauugguaccauacuuuaacauacagaccuuguuuaaacgucaccaauuaauaauauccuuuagagcaguacaaaacaaauuugaucaccuauguuuuaaacaccauggcaugugcuauaggacacucauugguauaguuuggauguucccccaaaucucuuguugaaauguaauccccaguguuggagguagggccuggugggagguguuugggucaugggugcggaucccucauggcuuggugcuguucuugugauagugagugaguucucauuuaaagguguauggcaucucucccccagcucucucuuauucccucucuugccaugugaccagccugcucucgcuuuaccuucugccaugaguaaaaaguucccugaggcuuccccagaaaccuccuguaugcuuccuguauacccugcagaaccaugagacaauuauaaauuauaaaucuuucuuuguaaauuaccuaguugcagauucuuuauaguaacgcaaaauggccuaacgcacuuauuauagcuccucucucaucucaauccuguuuuuuuuuuuugagauggaaucucacucugucacccaagcuggagugcacuacaguggcacgaucucagcucacugcaaccuccaccucccggguucaaguaauucuccugccucagccucccaagcagcugggacuacagggcguaacaccacacucggcuaauuuuuguauuuuuaguagagacagucuuucgccauguuggccaggcuggucucaaaguccugaccccaggugauccacccaccuuggccucccaaagucuugggauuacaggcgugagccacugcacccacccuucaauccuguguuguuuccaagagcacugagcagauacuguguucccugguguauucauacaggcagggcaaauggcuuuauuugauuuuuuuuuucuuuuguaugauucaguggagcagcgugacuucauuggaguggacagcacaggaaagaggcugcucuucauggcuaaugaagcagacuuggaugaagagcuggucauuaagggauccauccuacagaaguaagcccuaggguuuuuucuucuggcaauucuccuugucuuaaaacaaaauaaaaccacccaguggaugggaaagagggaaugaaaacuagacuauacugugugaaauugacaaaaguaugugaauauuuuucccaugagacaggaugaaggcuuuucuucacugcauaagccuguuucccugucuuuucuugccaagguagagccaaauccugcaaaagaguaaagcaaagcagcugugaggagaacaggacugucuuucugacaguguuauaaauccccuuuaaaaaaaaaagugguaaaaaaaacacaugacauaaaauguaccauuguaaccuuuguuuuuuuguuuuguuuugguuugguuugguuuggcuuugguuuuuguuuuaaguuuuuugagacugagucucacucugucacccaggcuggaguacaguggugcaaucuuggcucacugcgaccucugccuccuggguucaagugauucuccugccucagccuccugaguagcugggauuacagguaugcgccaccacgcccagcuaauuuuuguauuuuuaguagagacggaguuucaccauguuggccaggcuggucucuagcuccugaccucaagugauccgcccaccucggccccccaaagugcuaggauuacaggcgugagccaccgugcggcccauucuaaguggccuuuuuuuuuggagagggagucuugcucuguugcccaggcuggaaugcaauggugcaaucuuggcucacuguaaccuccgccucccagguucaagcgauucuccugccucagccucccaagcagcugggacuacaggcaugugccaccacacccagcuaauuuuuguauuuuuaguagauacgggguuucaccauauuggcugggcugguauugaacuccugacccguaguccacccgccucagcccccaaagugcuggggauuacaggagugagccaccgugcccagcccuaaguggccauuuuuaagugaacaguugaguaguguuaaauguguucacauuguggugaaacagaucucgagaacuuucaucuugcaaaucugaaauucuauaccuaucaaacaacagcuccccuccccauuuuuuucuccccgcaaggccuugcuacccacgauucuacuuuaaauaucuaagugaaaucauacaauauuggucuuuuugugacuggcuaauuuuacuuagcauaauguccucaagguuuguccaugccguagcauauaacggauuucguuuuuuuuaaggcugaauaauacuccguuguauguauguagccacauuuugucauccauuuaucuucugacagacauuugaguugcugccaccucuuggcuauugugaauagugcugcagugaacguggguguacagacaucucuucaagaccuugcuuucaguucuuuuggauauauauuuagaagugggauuacuggaucauaugguagagaacuaugauguuuaauuuuuugaggaaacuacauacuguuuccauggcauuuucacuauuuuacaaucccaccaacagugcauaagagccccaguuucuccacaccaguacuuacaugguagcuggucucagauacagaaggaaaagagaauucauuuauguuauaucaaaacaaauaaaacaucugggcagagccaugacucaagcaugaguaagcucaaaagaaucagaaugucagcuguacaaauauacuacagaaaacaaaaugaaagcaagaaaaaugucccguaaaagacaaagaagcuauccugaaaagaauauaacucaagaaacagaagaaauuuucuuaaaacuaugcaacuguauaaccauaaaacuacuuauuacaacaugaauuuaauaaauaaaaguucaguaaugagaugauaaaaaagaggauauuauagaaccaaaaaaaagaggauuggccaggcaugguggcucacgccuguaauuccagcacuuugggaggcagaggcagguggaucacaaggucgggagaucgagacuauccuggcuaacacagugaaaccccgucucuacuaaaaauacaaaaauuagccaggcgugguggcaugugccuguagucccagcuacuugggaggcugaggcaggagaauugcuugaacccaagagucagggguugcagugagccuagauugcgcugggcgacagagugagacucggucucaaaaaacaaacaaaaacaaacaaacaaaaaaaggauuaaauuauuacagaguuaauaaauuuuaaaauagcuaaagaauggcauagacaccacugaaaaucaaauuauugacaaagaggaauggucugagauaucagugaucuagguaaaaaagaaaaucguuuaagaaauuagaaucucuggcugggcgcgguggcucacgccuguaaucccagcacuuugggaggccuaggcggggggaucacgaggucaggagaucaagaccaucuuggcuaacacggugaaacccugucucuacuaaaaauacaaaaaauuagcugggugugguggcaggcaccuguagucccagcuacucgggaggcugaggcaggagaauggcaugaaccugggaggcagagcuugcagugagccgagauugcaccgcuguacuccagccugggugacacagcgagacucugucucaaaaaaaaaaaaaaaaaaggaaagaaauuagaaucucugagguuggaggauugcuugagccuaggagguugaggcugcagugagccaugauuguacuacugcacuccaggcugggugacagagugagacccugucucaaaaaaaugaaagaaagaaagagagaaagagaaggagggagggaggaaggaagggaggaaaagaaagaaauuagaaucucauagaaaugaaauacaaagaugauuaaauguaauuaaugaauuaaugccucugaauuagaacauggauuucuagaaagaaagaaauggagagaagaaaacaucagugaaauaauuuuuaaaauuuucugaggauaaaaggaacuggguuucuagacugaaaggaaacugaguucccaguaaaauggagaaaagaaacauaccaagguuaucauugugaaauuuuauaacugcuaacaaagagaucuuacaagcucccggagaggagagaggauaucauauacaaaggaauuaaaauagcuuugaacuuccuaacagcaauacuggcaacuauaaacaaugacuuuaacauucuuauuucuaucuaaucaaacuaucaaucaaauaugagaguagaaugagaacuuuuuagacauuuguuuuccaugcaucuauuuugagaaagcuuacuagacaaggaugcccacuuucacugcuguuacccagcauaguacuggaaguccuagcuagagcagucaaacaagagaaggaaauaaagggcaucuaaauuggaaaggaagaagucaaauuaucuguguuugcagaugaaauaaucuuguauuuggaaaaaacuaaagacuccaugaaaaacuauuagaacugauaaauauaguaaaguuccaggauacaaagucaauauaugaaaaucaguaguauuucuauaugcuaacagcaaaggaucugaaaaagaauuagccaggcauggugguaugugccuguagucccagcuacuugggaggcuaacgcaugagaagugcuugaagcugggaggcagagguuacagcgagccgagauggugccgcugcacuccagccugggcaacagagcaagacucagucucaaaaaaaaaaaaaaaaaaaaaaaaaaaucugaaaaagaaaucaagaaaguaauucuauuacaauagcuacaaauaaaauaaauuaccuggggauuaacuuaaccaaagaagcaaaaggucucuacaaugaaaauuauaaaauauugaugcaagaauuugaagaggacacaaaaaauggaaagauauuccauguucauggauugaaaaaaucaguauuguuacaauauccauacuccucaaagcaaucugcagauuuuuuuuuuuuuuuuuuugucuugagacagagucucgcucuauaucccaggcuagagugcaguggugugaucucagcucacugcaaccuccaccucccgggcucaaaugauucuccugccucagccgcccaaguagcugggauuacaggcgcccaccaccaugcccagcuaauuuuuguauuuuuaguggagaugggguuucaccauguugcccaggcuggucuugaacuccugaccucaggugacccucccgccucggccucccaaagugcugagauuacaggcgugagccaccaugccuggcugcaaucuauagauuuuaugcaaucccuaucaaaauaccaaugacauucuucacagaaauagaaaaaacaauccuaaaguuuauauggaauuggcugggcaugguggcucacgccuguaauuccagcacuuugggaggccaaggcgggugaaucauuugagaucaggaguuagagaccagagaccagccuggccaguguggugaaaccccaucucuacuaaaaauacaaaaauuagcugagcgugguugugggcgccugugaucccagcuacuugggaggcugaggcaggaguaucacaugagauggagguugcagugagcugagauugcgccauugcacuccagccugggugacagagcaagacuccaucucaaaaaaaaauaaauaaaauaaaauaaaauaaaaaaauauauauauauggaauuacagaagacccagaauagccaaaguuauccuaagcaaaaagaacaaagcuacaggaaucauauuaccugacuucaaauuauacuacagagcuuugguaaccaaaacagcaugguacugacauaaaaacagacacauaggucaguggaacagaauagagaaccagagauaaauccauacaccuucagugaacucauuuuugacaaaggugccaagaauauacguuggggaaaggacaaucucuucaauaaauggugcuaggaaaacuggauauccauaugcaaaagaaugaaacuagaccccugucucuugccauauacaaaaaucaaauaaaaaugguuaaagaccuaaaucuaagaccucaaacuaugaagcuacuacaagaaaccauugaggaaagucuccaggacauuggucugagcaaagaugucuugaguaauaccccacaagcacaggcaaccaaagcaaaauggacaaaugggaucauaucaaguuaaaaagcuuuugcacagcaaaggaaacaaucaauaaaguaaagagacaacccacagaaugagagaaaauauuugcaaacuacccaucugacaagggauuaauaaccagaauauagaaggagcucaaacaacucuauaggagaaaaccuaaucugacuuuuaaauaggcaaaagauuugaauagacauuucucaaaagaagucauacaaauaaaugccaagcagauauaugaaaagguguucaacaucacugaucaucagagaaugcaaauaaaaacaaugagaugucaucucaccuuagguaaaaugccuuuuauccaaaagugagguaguagcaaaugcuggcaagguuguagagaaaggggaacucucauauacuguuuaugggaauauaaauuaguacagccacuauggagaacaguuuggagguuccucaaaaaaguaaaaaauagagcuaccauacaauccagcaaucccacuccuagguauauacccacaagaaaggaaaucaguauauugaagagauauuugcguuccuauguuuauugcagcacuguucacaauagccaagguuuggaagcaaccuaagcguccaucaacagaugaauggauaaagaaaaugugguacauauacacaauuaaguacuauucagacauaaaaaagaaugagauccugucauuuacuacaacauggauggaacuggaggucauuauguuaagugaaauaagccaggcucagaaagacaaacugcauguuuucacuuacuuguuugugugagcuaaaaaucaauggaacucauggaaguagagaguagaaggaugauuaccagaggcuggaaaggguagagaguguggggguggugggaguggggaaugguuaauggguacaaaaaauuaguuagaaagaaugaauaaaaccuaauauuugcuagcacaacagggugacuauaauaaaaaauaauuuaauuguacauuuuaaaauaacuaagagaguauaauuggauuguuugucacacaaaagauaaaugcuugagguaauggauacccccauuuacccugaugugauuauuacguauugcaugccugugucaaaauaucucauguaacccaucaguguauguaccuagcauguacucacaaaaauuaaaaauuaaauuaaaaaaggaaagcugcuagaguuuauauagcaccaaaaccuuagcauaaacuaagaaagaggaagacacaggauauaagaaaaagggcacugaugcuugaaccugggaggcagagguugcagugagccuagaucgcaucauugcacuccagccugaacgacagagggagacucugcucgaaaaaaaaaaaaaagaaagaaaaaggacauucaggccgggugcagugguucaugccuauaaucccagcacuuugggaggccgaggugggcggaucacgaggucaggagaucaagaccauccuggccaacauggagaaacuccauaucuacuaaaaaaaaaaaaaaaaaaguagccaggcauguugucgcaugcguguaaucccagcuacuugggaggcugaggcaggagaaucgcuugaacccgggagguggagauugcggugagccgagauugcaccacugcacugcagccuggugacagagugagccuccgucucaaaaaaaaaaaaaaaaaaaaggacauucaauuaagaugaaaugaauccccaguaugaugaugaagggagauuccaggcuaacacauguacacccaguauaaauggcaaccagaccacacuggaauaggucagaaaacuugggaaugauuucuucaagaugaucauauuucuucugaugaaaaugacacaacaugugauguguuucaacauuuugagacgauuuggagcacuuaaguaguuaguuuggaguugaacuauugguaagcaccuagaaaacuaagaaauaagacaauuauucacaccaaggcaaaccacaaaaaugugcaggugaaaaaauucuuagugacugugugguucagcuguaacuaauuuuuuuuuuuuuuuuugagagggagucucagucuguugcccaggcuggagugcagugccgugaucucagcucacugcaaccuccaccuccuggguucaagugauucuccugccucagccucccgaguaguugggauuacaggcgugugccaccacgcccagcuaauuuuuuuguauuuuuaauagagauggaguuucaccauguuggccaggcugguuucgaacuccugaccucaagugauccacccaccucagccucccaaagugcuaggauuacaggcauuagccacugagcccggccuguaacuaauauuuaaauaugcauacuaaugcagucacugauacagucuaacccaaauuaugauuuaauuacuuuggaaugaugagaugagguuaguauguuggaagcaugagggaauaaaagagugaaaucguccuuuucuauaguaaauagcuaauacguagagcugaagucauaauaacuuaagcauugauuauugagcugaccaaaauaauauaacaauuauugggaagguaaaacgcauaaggaaguauggguguauaugaugggagcaggguugaugaugaaaauaaguuaaauccuguuuuccacaauggaaaaucagauuauuccugaaauggaaaaccugaaaaauaccaauauaagaaugcuauugguuaggugcaguggcuuacgccuguaaucccagcacuuugggaggcagaggcagguggaucaccugaggccaggaguuugaaaccagccuggcuaacuuggugaaacccuguuucuacuaaaaauacaaaaaauuagccgggugugguggugugcacugguaaucccagcuacccaggaggcugaggcaggagaauugcuugaaccugggaggcggagguuacaguaagccaagcuggcgccauugcacuccagcuugugcaacaagagugaaacuccgucuuaaaaaaaaaaaagcuacuaugcuauugcugggcacagaggcucacuccuauaaucccagcacuuugggaggccaagacggccaggucacuugaggucagaaguuugagaccagacuggucaacauggugaaauccucucuacuaaaauuagaaaaauuauuugagcguggugguggaugcauguaaucccagcuacucgggaggcugaggcaggagaaucgcuugaacuugggaggcagagauuacaguggagccaagauugugccacugcacugcauuccagccugggggacagagcgagacuccaucucaaaaaaaaaaaaaaaaaaaaaaaggcugggcacaguggcucaugccuguaaucccagcacuuugggaggccgaggcggguggaucaugaggucaggagauugagaccauccuggcuaacacggugaaaccccgucucuacuaaaaauacaaaaaauuagccgggcgugguggcaggcgccuguagucccagcuacucaggaugcugaggcaggagaauggugugaacccgggaggcggagcuugcagugagccgagaucgcaccacugaacuccagccugggcaacagaggaagacuccgucucaaaaaaaaaaaaaaaaaaaaaaaaaaaaaaaaaaaagaguguuauugguggcaaaauaaauacuaaguggaucugcuaaaagaguuacaaaugggcauaucuggggaacagaaaaugggcaggaaagggaauagaugauucaguuuuuuucauuaaaagccuugagaaacuacuugccucuuuauaugcauauauaacuucaauuuuaauuuuuuaaaauaagagcaagauauauaauacauuaaaauuucugaaucaaguaaaaucugaagauuuuuuuuucuuuuuuuuuuuuuugagauggaguuuuugcuguuguugccuaggcuugaguauaauggcgugaucucggcucaccgcaaccucugccucccggguucaagauauucuccugccucagccaccagaguagcugggauuauaggcaugagccacuaugccuggcugauuuuguauuuuuaguagagacgggguuucaccauguuggucaggcuggucucaaacuccugaccucaggugauuggcccgccuuagccucacaaagugcugggauuacaggugugagccaccgcaccuggcacaucugcagauuuuaagaguauaguguguucuaagauaauuuggccagauuuauccuaauguacuuaugaagcuucagggauaaagagagaauucaaguauccagaggcaaaaagcaaaucauuuacauggaagaaaaaaauuaggcuuaccucugaguuauucccaacauuuaauacaagaggaacaaugucccguccacagacuuuucagggaaagcaaguggaacucgagaauauuauaaacugaguaugcagauugauagauaaccagaaaaaaaagaauauuauaaacaaugaagauuuuauucaaauauaaaagcaguaggcauucucaggcaugaaaagacuuaugacauaugagcccugagcccuuccuuuucuuuuuucuuuuuuuuuuuuugcgacagaaucuugcucugucucaaggcuggaguacaguggcucacugcagccucugccuccugggcucaaucaauccuccuaccucagccuccugaguagcuaccacuaugggugugcaccaccacauuuggcuaauuuuuguuuguuuuuuguugcgaggaagucucauuauauugcccaggcuggucucaaaccccugggcucaagugauccucccaccuuggccucccaaagugcugggauuacaggagugagccaccaugccaggccugagcccuucuugaaaauaaaacuucaaccagccuguaauccuagcacuuugggaggccaaggugggaggaucacuugagcccuggaguuugagaucagccugggcaauauggugagaucuugucucuauaaaaauaaaaauaaaaaaaaauaaccaagcauggugguguaucccuguagucccagcuacuccggaggccaagguaggagaauugugugagcccaggaggcagaggcugcagagagccaagaugaugccacugcacucuagccuggacaacagagagagacccugucucaaaauuaaaauaaaauaaaaugccaagaauugagucaaaauaaagaauaugguaauagagaaaccauguucauuaacauuuagcccauuuauauguagaacugacacacaacaacuauaggaauuaugguugcagaauguaauuuaaauaucuugaaccuggacaacauaaaaauauaacugccaaaaaucaagagauaaaagugugggaagaaaaaacauugcuagauauuaauaacaucaucuuucauaguaggaaguuagaaaacauuaacagaccuaaaaaaaccauaauaauuucaaccucuuaauauuuuguucuuaaaaucuguuuuuaggcacaagaucuucuaagaaauaguaucuuuaauggugaagauauauuaaguuuacuauuuccuucauuuuuacuuuuucuuuuuucuuuuguuaaauaccaguaaaauugaauagucauuuuuauauuaaaaauaaaauuuuuaaaauagcauuuuguuuuuuauaacaguacaucuauuuguauauguacauaaagaaaugucuauaaugauuguuauuccuggguaauaagaauuaaagccaggcacaguggcucacuccuguaaucccagcacuuugggagaccuaggcuggagaaucacuuuagcccaggauuucaagagcagccugggcaacauagcaggaccucaucucuauaaauauuuuuuuuuaauucgcugggcauggcagcacaugucuuuaaucccagcugcuuagguggcugagacaggaggauugcuugagccugggaggccaaggcugcagugaacuuucaucauucuugagaggaauuaccggggaguucgaggcugcagugcguugugaucaugccauugcauuccagccuagaugacagaacgagacccuaucucaaaaaauaauaauaauaauuuuuuuuuuuugagacagggucucacucugucacccagacuggagugcagcggcacaaucucugcuugcugcaaucuccgccucccaggcucaagcaauucuccugccucagccucccaaguaggugggauuacaggcaugugccacuaccacucagcuaauuuuuguauuuuaaguagagacaggguuucaccauguuggccaggcuggucuugaacugcugaccucaaaugaucuaccugccucggccucccaaagugcugggauuacaggugugagccaccacgccugaccaaaaaauaaaauaaaauuuaaaauaaugggcggggcaugguggcucacaccuguaaucccagcacuuugggaggccgaagugggcggaucacaaggucaggaguucgagaccauccuggcuaacacgguugaaaccgcaucucuacuaaaaauacaaaaaauuagcugggcgugguggcgggaacuuguagucccagccacuugggaggcugaggcaggagaaugucgugaaacaggguggcggagcuagcagugagccaagaccgugcuacugcacuccggccugggugacagagcgagacuccgucucaaaaaaggaaggaagggagggagggaagaaaggaaggaaggaaggaaggagaauuuuuuaaacucuuaguaauucucuaaaauccuugaauucuguaaaauaaguacaucuuuuuucauaaaauaaaugugauguuucuuuuuuaaaaacaacauuuaugcugagauaguaacaauucuggaauguggaaguauugaugauuauuauuuuuuucuuuguacuuuucuguauuuuaaaaaauuuucuggcugggcacaguggcucacgccuauaaucccaacacuuugagaggccgagguggacggaucaccugagguaaggaauuugagaccagccuggcuaacacagugaaacccauuucuacuaaaaauacaaaaaauuacccaggcaugguggcgcacaccuguaaucccagcuacuugggaggcugaggcaggagaaucacuugaaccugggaggcggagguugcagugagccaagaucacgccauugcauuccagcuugggcaacaagaguggaacucugccucaaaaaaaaaaaaaaaaauucccaauuuaaaaaguuuuaaaagcaaguaaggcugggugcgguggcucacaccacuaauguccacuuugagagaccaaggcaagagaauaacuugaggccaggaguuugagaccagccugggcaacauccugagacuacaucucuacaaaaaguuuuugaaaaaauuaccugggcauguugacgcgugccuguagucccagcuacuugggaggcugaggcugcagaaucacuugaacccgggaggcggagguugcagugagccgagauugugccauugcacuccagcuuggacaacaagagugaaacuccaucuaaaaaaaaaaaaauucccaauuuaaaaaguuuuaaaagcaaguaaggcugggugcgguggcucacaccucuaauguccacuuugggagacagaggcaagaggaucacuugaggccaggaguuugagaccagccugggcaacauccugugacccccaucucaguuuuugaagaaauaccugggcauggugacgcgugccuguagucccagcuacuugggaggcggagacgggaagaucccuugcacucaggaguuugaggcuacagugaacuuuuuucaugccacugaacucuagccugggugacagagugagacccuaucuguacaagauuuuuuuuuuuuuuccauuaaaacaggcaacagggccaucuaacuggcaggcuguaguuugcugaccccacucggauucuuuuuuuucuccauaaagaauaucugugacagagccuugugagcacagcuuguuucuuacaguggucaggauauagcugacuagcucuggaauucugcgaagaaagaaguaaggguuuuguuuuggauuuuuuuuuccuaaauccauuuaucaaaauaaaaacguaggaagcagagggaguuuuuuuguauuucagaaaagcucgccacaagaugcaauuaaacaauaucucuuaauguauuaaaaaauaugaucuuauuuguagcuauuagguuggugcaaaaguaguugcgguuuuugccuuuuuuuuuuuuuuuuuuuuuuuuuaacaaaaaccgcaauugcuuuugcaccaauguaauauuucuagaauuacgaacugccacagcuggaaggucauuuaguuagucuagucuucuauauuucaggcaaugauucugaaagcaaggaagaagggguuuuguucaauguaucuaguuagggacagaacuaguccuuauucaugaggacauucuacuuucaggaacacauccuucaaaucuggucaaaccacuguuuugguauuuaaggcagaagacuuuuuccuugaggcaggggacuuuaucucaaauagcucaucagccuugguggaagauucaauuaugcauggaaaagguuaacaaacaauagcaagggauaucagauacugaacaguuauguccaacagacaguguucuaagaauucaaaggagguaucuaauccuaggcgcugagguggucagggaaacagaauagaauaauucagacuugaaggauugauuugguccggauauggaaagggacaugggaagccagcugaauccuauaugccgagaaugccacgagcaaagguggggaaggacaguuugaccugaauggaagguucauguugggaaacuugaggagauaaggcugagauguuaaguuggucuaaaaauagagagccuugaauaccagggaauuauuaaaaacuuuugaggaaggaaaugauuauucaaauauaggauucugaaaaaaaauaaucugacagaaguauguaggauagauuuaagguauauaagacuugaaaaguaucacaguguuggauugcuaaauucaagacucucaaggaauucuguccuuuggaauacagaaaggaaaacuaauugugauuagcaauuauuaugugaaaugaggguccugacucacaugcauccaucaagcacugauguuuaugcuuuguucuguauuagagauagcagcccuagacauuaaguucuuaaaagcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaccaaacaccgcauguucucacucauaggugggaauugaacaaugagaacacauggacacaggaaggggaacaucacacucuggggacuguuguggguugggggaggggggagggauagcauugggagauauaccuaaugcuagaugacgaguuagugggugcagcgcaccagcauggcacauguauacauauguaacuaaccugcacauugugcacauguacccuaaaacuuaaaguauaauaaaaaaacaaaacaaaacaaaacaaacaaacaaaaaagcaagacucauacguuucucugguuacaacuaaaggguggguggagguuguuuucuguuuucuuuuuaaccucugugggaacuaguuuauggcuccauacaauggaguguuaguaacugccuuaauuguaauuacauuugacaaugagagcaaggcuugggcaugaugggagcaaagaagauggaccuagucagaggugaggugauaaugaagagcagguggaugugucuuuuuccuucauagaugucaagcucagggccuugacuaagcacuggggucauugagagcagaucuucuaucaguuuccuaagacuaggcugcauuuuuaguuguuggcagauuuuuuuccuuguucuucugauuuauaauccacaccccagugauucaggaucuuugguguguaguuauaaaaggguugcaggcuggauaaauaugcauaaaaauauucucucauuccuaugacccucugggguguugugcuccuccugccucaagugagaugcugguuaaaagcuaauuagauucagauuuucaagcacuuucugauuaugagaauacaguacuuccuucuguuuuuaucuuuuuuaaaacgcugaauuuccaaagauggagguuagcuccuagugagcaaacaccaguuaucuuggauacggccuucauguauauaggaaaaucagaaacuucuuguaaaguuuuuuuaacuuuuguaaauuggguucagucuauacugcucaggagaugggugcgccaaaaucucagauuaccacugaagaacuuacucauguaaccaaauaccaccuguucccccaaaaccuauggaaaaaaaauuuaaaaaagaaagagagagagaaaaggacaaugacagaauguacaucccaucaguuuucucuuucugagagagaggcugggugugguggcucacaccuguaaucccagcacuuuaggaggcugagguggaaggauugcuugagcccagaaguuucagaccagccugggcaacauagcaagacccauuucucucuuuuaaaaaaaaaaaaaaaaaaaaaaaaaagcauuacuuggggggguggggagggauaaaauguuugcuugauuucaaagacaccuguuagaauauggucaggugcagaggcagccuccccagcaagcuagucaucagucaguacuaguaacuuuaccucaaagggcccagauucuuaugaccuuguuggauuuaaacaaagcacaacaccuuuccuacaugucugauuguugcauuucugacuuggagaggcauuacauguaguaggaaagaauguucugguagaaggagcuuguuacugaaaauucagguucagagaauuugcagucuagucuggagacaaaccagcugugugaccuugagcaaauaacuuuauuuuucuaagccucaguuucccccagcugaaauuggcuuaguuggucuuuaaagaaaccccccuccagcucuaaaauuccugcuuuauuucugacagacauauguuuuuaauaguucauaaguaaaagauauuugugccaaauauuuaauaagaaaaucauguagcuuuuccccaauguuacauuguuuucuuuugaauaguugucaagcuuuuuuacuggaagaguaaugaaaauauuaaaacaagcuccuaaaggauaucuuuaaaauggaauaaaauguucacaaggucaucuuggaagguuuagacaucuauaucuggggagucaaggacuucagucaagaccucaaagaucauggccagaucuguauuucugggacuacagaugaugagaaaugguuuaaacccuugauuauuuucccaauggugugggagucuugaaauacuauuuauguaaguuaguaccucugcugcuccuaaccagcccuaauucccaaaauaccucucuuaauuugcaguuugggaugggggcagguacagaagggaagaagggcuuguggaaguuaggaucacaaaccuuucccaagguaucuuguccaguguauucuuacucuuuuguacuuuuaauuuacuucuauaaaaugauauggcuguaagauaacccaugucaauaucuuuaagucuuugcuuuggagcuggccauauagacuucagagaaaaaucuuccaaucuccugccuggguggguaaaagcugugcugccaauuccugaucauuucagggcuccugagauacaaaucaagcugcuucuuagcuuuccuuauagaugguuuaggauucaccuuucuuggauaugcuaaaucuguuaccaccaccauccuuuuguuuuccagcuuccaaaauuuuguugucaucucuucuuguggucuuuguccuuguggguuuaugucuuuaaaaaaaaaaaaaaucuguacugacacuucagugaguuuucagaaagaggauggguuaacgcuuauguuuaaucugccaucuuuacccagaauccuguuuccuuauuucagccucaaaucuuucuagucccuuacuaccaccacuccuacccucucuuuuuucucucccucucucucucuuuuccccccucauuuccuucuucauccaaucuagguccugugccuucaggcauuucucuccaaguccaaagucuuuaggagaaauauuaugcacggauauaaauuggcagcacuauaaauucauggcuccuaucuuagcugaacccucagaaccacucuucauucuuccauuuguccugggccagcuuuccacuccucucagaagcuguucucuaccaucaccauucuccugucaaaacaugggccugcugauuuccccagcuaccccauccaugacuuugccuuuauucagacccaccuucgauuccuuuccuccagcauuagaagaaguuuggggccagucccuucauuuaugccuuuuacccccuuucuucugccacuccuggaaccuuuucuccauuaguuuuuucaacauucuccagaauuuucaacuuugcuuuccacuaucucuuuaucccaaaucuauaaauacauugcuuguagaauaaagcacacauuccuaaagcccucaguuaucuaaucaugcuuaccccuccagccuuauaucucaucuuucucuaacacaaccccauucucaacauucuaucaguagcuaugaaaaauugcuuauaguucuguuaacuucugcauuccuuguaaugucuuuguccuuuuacuuuucaccguuccugguaauccuucagccaaaguuacucuucucucccuggcuaagaacuuauuuuucuuucaagacucagcucaaauaucauuuuucugugaagauuuuucuaaucuuuccugucauaggcagaaccgugcuucuuccuuugugcuccccuauauacugaagaaaguucugugguaacauuuauaacccuguauugcucuggacuauaaguuacauaaggauagugguuguauuuugucuuuguaggccuaaggucuaauacauggccugacauaguaggaucccaguaaauuuguuggaagaggacauuaauggagccagagugucaccuuguguuugaaugugcuuuggcaacagagucuuuauaggcagagcugagacuucuuaaucuugugaauuggagaaagggcuggaacagcauuauuugcaccacauucuucagaucaaagcagucauaagcccagcccagagucaugagaugcaaaauagacucuaccucaugaugggaggagcugcaaaguuacuuuacaaaaggauaugaguacagagaggggaauaauuguggccaucuuuuuuuuuuuuuuuuuuuuuuuuuugagauggaguuucgcucuuguugcccagacuggagugcaauggcgugaucucggcucacugcaaccuccaccuccuggguucaagcgauucuccugccuuagccaccgaguagcuggcaugcaccaccaugcccggcuaauuuuguauuuuuaauagagacaggguuucuccauguuggucaggcuggucuugaacuccugaccucaggugauccccccaccucagccucccaaagugcugggauuacaggcaugagccaccgugcccggcugugaccauuuuuaaaacaaucuacuguagucccaacuaccaaagcauuuuuuguuuguuuuugagaaggaguuuugcucugucgccaggcuggagugcaauggcacgaucuuggcucacugccaccucugacuuccugguucaagcaauucuccugccucagcuucccaaguagcugggauuacaggcacgccccaccacgcccagcuaauuuuuguauuuuuaguagaaaugagguuucaccauguuggccaggauggucuccauccccugaccucgugauccacccaccucggccacccaaagugcugggaguacaggcaugagccaccgcgcccagccacuaccaaagcauuuuaagcagggaaugacacaaucaaauuugccuucgaaagauaacucuggauacaauauggagaaaggauuggaguuggguaagagaggaugcagagagaccaaguaagggaagguauuguaguaauccagguaagaaguaaugguaauuugaacuaggguauugacaguggaguuggagaaaaguagauaaguuagagaaggauuuagcagguaaaaucugaggacuugguguuugaaccuugggguugagaaguguaguggugucaaaaaagacucacauuucagguuugagcagcaggauaauaaucagauaggaagcacuggguuuguggcagggagauccgaaguucauuuggggauccagguaaacaggaguaagucauauauagacucgguguucagaggauaggacuaugcuucagauauaaauuuguaagcauuaauauauagaugucaacuuagugucuuguacauaccugguacuuaggagaaaguuauuugcccagcuguugaaccucaaggguggggaaugucugagcuagguuguuucauaauaucuuuuaucccgggcacgguggcucaugccuguaaucccagcacuuugggaggccgaggugggcggaucaccugaggucaggaguucaagaccagccugaccaacauaaugaaacccugucucuacuaaauacaaaaaaugagccggguaugguggcgcaugccuguaaucccagcuacucgggaggcugaggcaggagaaucgcuugaaccugagaggcggagguugcagugagucgagaucgugccacugcacuccagccugggcaacaagagugaaacucugucuaauuuaguauaacucuagccaugcagaagcugaaacaaagcuuugaggcaugaacuccugagugauccuucacugaaccuuugccgugaccaucuccuacacaaccagcuuggaaccaggccugaagacaguaggaauauugcuuguguacuugggauaauucuggucaaggcugucacaaggccagccuagauucaugagacgagaaaauagacucuaccucaugaugggcaugaccugcugaaaugucauauuagcuagaccagugagacuagaguggagugcaaauuaaugugucaguuuuccccacccagaguuguaugggccagacagcuuagaaggauagcuugaaagauguaacacucuugggcuuaucuuugaguagaagcuucuugucaguggugcugugcagaaugcuuucuugagcaccucuuggggagugagaugcuucuagaucucagcagguucuggcacgcugaguugagaugggugagggugaacagcagugugauucugccuaggaaggcuuugcuaauuccuguguuacuuauuagacauguggcucucauuagucugugugaugguuaguuuuauguaucaauuuugcuagucuguaguaccuauuuauuccaucaaacacuaaucuagguguuguuaugaagguauuuuuguauguaauuaauaucaacaauccauugauuuuaaguaagagagauuaucuuggcuaaucugggugggccucauccaauuaguugauaggccuuuaaaucuaaucagaucagagaaccaauuccaaauaacacagaacaaguucagcaaacccaucuuuaagauuuuuuuuuuuccaggaccacuucuaguagcaauuuuuauaucagagaaacagaaaugcugugagucauagagaauaaaggauuuauuacacaauuacggaagcucguagaguaguguauguaugcuguuguuucugugucuaguguugagccugaaaucacuaucagucagccagaccaucagucagaaaggaaagcuggaucuggacaagaacaagaacaaacccacaaggucaccuaaaaacuggaccuggagcagaacuuggaacucuuaagaauccuuccacuguuggcagucucugcugcuuugaguccaggguuuucaccucaacacaacugcuuuuuuuggagagggccugagcaccucagggcuauggugucauagccuacccugcugaacaggcagaccucuaguuugauaacuccauaugcacuccuaacaaucgagaaucuguuauuccuaccacuuacagugugaccaagaucaggcauugggaugguaugguuagugccuuccuauguagcaaauaccagauagccacaccacaggugcuugccccagcaccucuuguuaaaauuauagguagcuaguaaguaguagccauaggucauucccuuuucccuaguucugagaaaacuugauuauuucaagcauaucuuggucucuaguuucuucuaaauugcagugauuagggaguagugaauuagcucugauucuuuuagcgggagagaagaugcuucuuuguuggaauauguuuaagauugccaaaucuggcuggacaugguggcucaugccuguaaucccagcacuuugggaggccgaggugggcagaucacgaggucaggagaucgagaccauccuggcuaacacggugaaaccccaucucuacuaaaaauacaaaaaauuagccgggcacgguggcaggcaccuguaguuccagcuacucaggaggcugaggcaggagaauggcaugaacccaggaggcagagcuugcagugagccgagauugugccacugcacuccagccugggcaacagaacgagacuccgucucaaaaaaaaaaagauugccaaauaaaguagaaggugauuaucugaaggucuucaaauagaggaguuguuuauguugcugcauugaacacugcaagauaguuaaguuacuguaggaggcuuuuauccucaucugaauuguuaucucugguuuuaugaauaacuguuucaagcuccaguuccacuggcaucugaauucagaagccauccaugacacuuccuucucuguuaacauucauauucaugcaaagagaagccugugauaaaauuaauuuucucuuguauuugacuuuuuuuugugcaacuggguuuucuucauucuguucucacccaauaccauucucugguccccaaacuuugaacuuagcuugguuaggaaaaagucauucugugcagccauauaagcuggcaggacacacucaguuuuuuggguuuuuuuguuuguuuguuuuguuuuuuugagauggagucugcccugucucccaggcuggagugcaguggcaugaucucagcucauugcaaccuccaccucccggguucaagcgauucuccugccuuggccuccugaguagcugagauuacaggugugugcuaccacaccuggcuaauuuuuuuuguaguuuuaguagagaugggguuuugccauguuggccaggcuggucucgaacuccugaccucaggugauccauccaugucagccucccaaagugcugggauuauggcaugagccaccacaccuagccaacacacucaguuuaaauuaaugauggcuuuccuuucucacugaguaacuguggacuauaucaacaugcauaccaguucucccacuaggcuagaaauucuuacggucucauucacagcaaugcugaaaaucuaaauguguucacacagggugucuagaugaauuucaguuuuuaaacaugcagcuacuauaaacugcuucuuugccugucagcucuuuucuacccacccuucuaggaacuaagcauuguacaaugagcauauuggggaauagaacucccaguuggcuucugcuguacuuaggcagugagcaggauaaaaacaacucaguuccucccacacacaugaugaugcugggaauggggaagaagggagcagacuucaagaacauuuggcauugcccugagccuggggaccuuuguagauuugaagggaaugaggaucugaaaaucccuggagaucuuuugggggaaaauuaaagaucuuguuguuaacuaaagaccuuuuuuuagagucacuaagagcuuuggacauguaaaguacuaauuuugucuuucauggacauauuuccuucuuucaaggcugccuuucagaacugcuuuuuuuauucccuagcucuaucguucacagauguuuuguacaguguucaugguacauauaucuuuguguucagcuuucuuuaaauuaaagcaaaucucagaaaaguucaaaguaugcaguccugcauaaucucauagaccaguagcuguguguuagucuuucuuacagcuucccuagaaauccuaaagcuuugccccugacauacaguauguguuguuaauauuuggaacaaacuuggguaaauaaauauugaaacacggguacagcuugguucuugaacuacucgaaauuuaaaaguaaucugcccaaagcaggcagccgcuucuuugggagcuuucuuuuuuuuuuuuuuuuuuuuuuuuuuuaaagaaagagucucuuuucuguugcccaggcuggagugcaguagcacguucauggcucgcagcagccucgagcuccugggcucaaacaguccucccaccugagacacccgaguagcugggaccacaggcacaugccaccaugccuggcuaguuuuucuuucuuuauuuuuuguggagacaaggucuccuuauauugcccaggcuggucuugaacuccugagcuugagcaguccucccacacuggcaucccaaaguguugggauuacaugcaugagccacugugccugacuggaaacauuucuuucuuucuuuuuuucuuuuuuuuaauuauuaugagacagggucuugcuuagucgccuaggugcuggggugcaguagugcaaucauagcucacugcagccucgacuuccugggcccagguggucuaagagggcagcucucacagaucuauaggauuaucacaaacccuauuagaaucucaguuggauauuuuugcugaaauugacaaguugaucuuaaaaguuauauggaaauacaaagaacacagaauauccagaacaauguugaaaaacaacaaaaaaguugaagaaauuaugcuucccaagcucaaaacuuacuauaaagcuaugguagucaagacaaguaugguacuggcauaaggacagacagacagaucuguggaacagaacuaagaguccaaaaauaaacccuuagguuuauggucauuugauuuuuaccugagauguccaggcaacucaacaggaaaaggauagauuuuuacacaaauugugcuagaacaguuugauccuuacuugcagaaagauugauuuagaaccuuaccucacuccauacagaaaaaagaaaauggauuacagaccuaacaugagagcuaaaacuguaagaguuguauagauuuuauuucuuaaaaauuaaagauuuugaaccccaaagacacuauuaagaaaaugagggccgggugcaguggcucuugcagguaaucccagcauuuugggaggccaaaccagguggauugcuugaaccaggaguucaagaccagccuggggaacauggcaaaacccgucucuacaaagaaaaugcaaaaaguagccagguguggugucacgugccuauagucccagcuacucaggaggcugaggagggaggaucaccugagcccagggagguugagggggcagugagcugugaucacgccacagcacuccagccuggaugacagaguaagacccugucucaagaaaaaaaaaaaaaaaaaaaaaaaggccaggcccaguggcucaugccugucaucccagcgcuuugggagucugaggcaggaggaucgcuuggggccaggaguuugagaagagccugggcaacaaagugagacccuaucucuauaaaaaaaucuuaaagggacugggcgcaguggcucacgccuguaaucccaacacuuugggaggccgaggcggguggaucaccugaggucaggaguuugagaccagccuggccaacauggcaaaaccccaucucuacugaaaauacaaaaauuaguugggcaugguggugggcgcuuguaaucucaccuccuauggaggcugaggcaggagaauugcuuaaaccugggaggcagggguugcagugagccgagaucacgccauuccacuccagccugggcaacaagagcaaaacuccgucucaaaaaaaaaaaauuuuuuuuucaauuagccaggcauggcacgaaccuguagucccaccucuuugggaaacugaggcauuaggaucacuugagcccaggaguucuaggcugcaguuuugaucaugccugggugauggagcgaaacccugucucugagaaaagaaagaaaauaaggaaaugaaaagauaagaacucuuccaacucaaaaaaaucacuaacagccuaauuucaaaauaggcaaaagacuugaaugaacauuucaccaaagaaaauacacaaauggcuaacaagcacaugaaaagauccucaacaucaugucauagggaaaugcagaccaaaacuuugaugauacugcuucacacccauuagaauggcugcaguuuuuuuuaagugacagaaaaagcaaaucuauaaaucuauagagacaggaggcagauuaaugauugccugagaugugauaagaaaggggauugguuuuuuuuaaauuauuauuucaacuguuauuuagaugugcaaguauguuacaugguauauugugugauggugagauuugggugcgauugaacccaucacccagguagugagcauagaacaaaacagguauuuuuucaacucuugcucuccucccucccccugguuguguauccuuguugucuguuguucccuuuuuuuuuuuuuuuuuuuuuuugagaugauucucgcucuguugcccaggcuggagugcaguggcauguuaucagcuaacugcaaccucuaccucccgggugcaagcaauuauccugccucacccuccugaguagcugggauuacagguauccgccagcacacccagcuaauuuuuguauuguuaguagagaugggguuucacugcguuggccagacuguucucaaacuccuaaccucaagugauccacccaccuuggcuucccaaagugcugggauuacaggugugagccacuguucccagacuuuuguucccaucuuaauguccauguguauucaguguuuagcucccacuuauaagugagaccauguaauaucugguuuucuguuucuacauuacuuugcuuaggauaguggccuccagcugcauccauguugcugcaaaggacaugauuuuguucuuuuuuauagcugcauaguauuucaugauauauauugcacuacauuuucuuuauccaguccacuguugaugggcaccuagguugaauccaugucuuugcuauugugacuaguacugugaugaacaugcaaguacacuugucuuuuugguagaacaauuucuuuuccuuuggauauauacccaguaauggauugcugguugagagguaguucuaguuuuaguucuuugaaauaucuccaaacugcuuuccacaguggcugaacuaguuuacauucccaccaacaguauauaaacauuucuuuuucuccacagucucaccggcaucuguuguuguuguuguuguuugacuuuuuaauaguagccauucugacuggcaugaggugguaucucauuguggcuuugauucauauuucucugaugauuagugauauugagcauuucuucauguguuuguugucugccuguaugucuucuuuugagaagugucuguuuauguccuuugcccacccuuuaaugggguuguuuuuugcuuguugauuuaaguucuuuauagaugcuugauauuacaccuuugucauuugcauaguuugagaauauuuccucccauuucuguagguugucuguuuacagaacaguaguuucuuuugcugugcagaagcucuuuaaucagauggaaaggggaauguuugauuauaaacagucaugugagaucuuauuugaguaaaagaaauguucuguaacuggauuguggugauaguuuuauagcucuguacauuuucuaaaaaucauuaaauuguaugucuaaaacaggugaauuuuaugguauguaaaugacacuuccauaaagcuguuuguuuuguuucauuuuguuuuguuuuguuuaagacauaggcugaaugcaguggcucaugccuguaaucccagcacuuuuagagggcaagauacaaguaucgcuugaggcugggaguucaagauuagccuaggcaacauggugaagccccauacaaaaauacaaaauuagccagguguggcagcuugcuccugugguccuagcugcuugggaggcugagguagggggauugcuugagcucaggaguucaagaccagccugggcaacauagcgagaccuugucucuaccaaaaauaaaaaaaauuagccagcuguagugaugcaugccugcagugccagcuacaggaggcugaggcaggaggaucacuugagcccaggagguagaggcuacagugagcaaucauugugccacugcacuccagccuaggcaaguggcuaucuccagucagagcaagacccugucucuaaaaguaaacauaaaaaccuacaaggcagucgaagccaagcaacacagaguuagaagacaaccaggcaucuaugacuggaaucuucuuuuuuuuuuuuaaccauacuccccuucccuguguauuuauuuuuauuaaauagaaugaccucaaacauuacaagcauggcauuuuuuacaccuaggcagaugccuuaauuugaccucauuuauucauuuauuuguuuauucaacaacuauuuauuggacauuuacucugugucaggcacaaugcuaagugcuaaggaugugaagauaaaucucugcucuacugaauuucagucuagugggagagagagagacaaguaaauagucuauuucuuuacuauauguuaaguuauccaauagagguagauaccaaguuuugugggagcacaaacuucacuguugucagugaaggauuccuagaggaaguguauccuggggugaguccugaggaauaaauaagaguagcaaguuaggauuauucauagaauuuuacuccaucuucugugaagauggagaauacauaccaaauuguggaggcaaaagaaagcauggcauggucugaggaaaauaggauaauuaggguagaagcaggaaaauguuuguuauaagaauuguguguaggaauuuauaauagaggccaggugugguggcucacaccuguaauccaaccacucugggaggcugagguggguggaucacuugagaccaggaguucgagaccagccuggccaacauggugaaaccccaucucuacuaaaauacaaaaauuagcugggcauggugguguacaacuauaguuucagcuacucgguaggcugaggcacaagaauugcuugagccugggagacggagcuugcagugagccgagaucacgccacugcacuccagccuaggcaacaaagcaagacugucucaaaaaaaaaaaaaaaaaaaguuaacgaucaaauagaagaagguagauuaucagugauaugaugucucaccagauuucuuuagaaucguaaaagccucagaaaguaugccauaggguuucuagggaaaacaccuuuuaugugguagagucagggcugggguccacuguccuggucuccccagaaagagauguaggcagcaugccucugacccucauaaacuuaccagugccuacuaccugauaauagaauggagaccauguuaccugauugugagccucuucuuucuuucuuuuauuuuuuauuuuuuugcaggcauccuagaauacguuuccacacgggucuuguggaugcccaccucuacuguuugaaaaaauacaucguggauuuccuaauggaaaauggguaagaaaaagggugguagagucaaaccuacaguacuuaacaagcuacuuugugaauuccuuaaauuuuaaaccuucauaauuuagauaaccaguuucuaaaauuagcacaauagcacaguuaguucucauuuuuguuuuagaaaugaaauuaugucaucaauauaguguuguuuuaucuguaccacagaguccccugcuuauauuuuugcagcguguguuauaauaaaucagcaaaauauuuuguaacacuuaacgguaacccaugaugccucuuucugcccaguuccaggcucuucuucccuccuuugacaggagugagcuccacagcccuuaugcuguuugucucuaauuacauguucuccuaggcaguuauccuguagaugggcccucuuagcaaagggcuacagacuuaaccauagaagagaaaaaggagagcaaguuuccccccaauuuuagaaaagaagcccacuucagugagugcagagaaacaaaauuuggcacauuuucugauuuuuuuguuuguuuguuuuagaacagaauuguaggacuuaaauaguuuccagagauugugucuggcagaucaccggacuugaguuuucaaagagaaaaccccuuuugcaguugaucucaaggauuuuuuauaagaaaagcagcuacaguccucaaaggaacagguggaaaaagauuuaauaacugcaugguuaagaauaggagcagcuagcuucccuugaugacugcuggauaaguuuggaaaguucaccagugcuauccaaggcggaaacuuaucuaggugaacagauaccacaguagcaagagguaucuccgaccaucuggagaaaagaauuugagaaccugaguuuaaaugcuagcucugccuuuggcugauggacuugaauauauaucggaauauuaagaggaaggaggauugcuccccugcccaguaugaucuuucuugcaguguccuaccugucacccccccacaacacuugcuaaguuccuguggagaggcccauguagagccaaugguaaaacaaaucauuuggacuuuuagaaagcuuucccaaggauuguuauagcucuguuuccccuaccaaggacacaguugcccugcucccuucugaccucugaaaaauguuuucauuccaucuacacauacuuauuaagcacccauuaugagccaggcauugugcuagaucaaccaugggaucaaugauaaauaaacagauauggcccugcccucauggaaauuacagccuaagcucaugguggaauguggagaccuugcuuuuuagauagcaggguaacuuguugccaagauuuagagggugauccaagagcuauuucucagugaccagucuaagcuguuuguauuccaaaaaugaaauuaacucuuggccauugaaggguuuauuuuucacucccaaauaaaaaugaagccauaugaaaugagccuaggccuugauaggcagaagagaacacaacuguguuagaaaggaugacuuuuuaaaaaaugauuuacuauggaaaauuucacauaaaugcaaaaguaaagaaaauaaugaacucccauguauccaucacacaguuucaacaauuaucaacucauugucaauuuuguuuuauauaugccaccguuucucuccccccauuacccuaaauuguuuuaaagcaaggcauuuugauauaauuucaucuguaaauauuuugauauaauuucaucuguaaauauauuucagcauguauaguuaaaauauaaggacgcuuccaggauaaggauauuuaaaauagauauauauuuuauguauauguacauauauauauauagagagagagagagagaggcuuuuuuuaaauaaauaccuuaauaucauuaucacaccuucaaaaaacugacagugcuuucuuaauacuaucaaagaggauuguggcuuuuggugucuguauaugcaggcaguuuuacagcaaaccuagucaucucauccugguuguuauagcuuauuuguaguucauuuggccacuaccaguuaguuauucccacaccuggcaaguguaacacaaugguguguguaccuugaggacaagccugaaguuugugauauggcuauagguccuggccagaagcucugccaaaugggacuuucccagaaccugcugcaguagagaaugauacagagccucagcacauacuguuuccccaccucaagaucuguuuaggagacccuuaucucuuuccuccccgcaucuaccuugaccucucagagucgcuacaaucaaagagcauauauugaaaauugauauauuucaauauauuggaaaaaguaaaaaggcacagcagggcaaauuagaauguuacuugagggacagucuuuacuccuggcuggaauagugaaggucuuugaaagguugugggagaugggauugaauugguuggugguagguagcagcauguagaaggucuugaaagcugagcagggaguuacagaucuuuaaacagaauagucuuacaggaaaugagcaaugauacaaccuggcaagugaacauaaaccauucugcaugggaaagagauuucuucaagauaaguaggaggcacuuauaaucaucuggucaucagaugaugacuccuuuaggaauggaaaggaaagaguaaaccuaggagacacagcuucaagaaaggacuguuguagcaauccuuuguuauauuuuaccucugagaguuaacauauucuacccuguguuauuuauguagaaaagcaucauguuuucaauaaagucacacuuagguuuuguuauuuguuuacauguuaacauuuuccacucaaauucuuugagaauggauaucuaccuggauuuguaaggcauucauuauauacuuggugaaugagggaaaggagauguagugacagauaacagaagcaguuuaguauuaauacauuaauaguggaagaagagagguggguuucuacaguugaccaagcagaaaagcuacagggagagcugcagagagaagaaaaucuguacucucuuugaugagaauuuaguaacuguacacauuuuacaaguuuuuuauccacuucugaguguaguaugauagaugaauguuccacagaaucucuugaacauuuuaauucaaaauguguuggauucuguguccagggccaaagcagaucuuagucugaguauugugacugugauuccucuugauaacugaguguuccucccuguuuuauaaugucagcugguuuaagccuaaagaagcugaucucuuaggagaucuagaagcccagguauuggcccagcucuuugcuugccuuaguaggagcugcuccuagaccugagucagggcccuagauugucacuggcccuaugaaggacucaagcaauaugccaauaugccagcuuugugagcuaaagccaugggcaauauauaccaggcaauguauaccaggauuagucuugauuuccuuuuaguauagaaccucccccgcuccccacccccaccagccccauuuaucuuucucucuuuaagagacuuaaagauuagucuccuuaacagggagaauugaggcugauuacuuccuucuuguccagaaguauccacgguuacagucagccucuuauaguguuagaaucugauauugccaugcaguacuuacagucuugggguuggaccuucagagcaggaagagagaggaaagaagaaaauuuaaccaccuacuguguaccaggcacugugcugggugcuuuucacauauauucauuucuuacaauaguucucucauuagguauuauacucauauuauagaggaagauaaugcucaaaagucauuugcucaauaucaugcagccacagccucaacaaaauccaucacuguuuaauugauugccagcaacauccaccacagaugucggauaucucuguugccaacaugcuuauaugcacaugcacaugauuugcacuugaaagaguaacagagcagucacaacuuccuugccucagcuaugucaggauacagagaaauaaggauaggacccacaaagugaagucaagaguuggggauaggcagccauggcaaggucagaaucaagguaauaauuaaagccacauacaaaaugaaguuauguuagcugggcaugauggcauauaccucuagucucaccuacucaggaggcugaggcaggaggaccacuugagcccaugagguugaugcuacagugagcuauauaugauggcaccacugcacuccagccugguagacagaaagagacccugucucuaaaagaaaguuaaaaauuaaaaaagaugaaaguguagaauagcuagaaagccacgaguaagcacaagacagcagaguggagauaagcagagaugagggaccagauagugcugugagaggcuggcaguaguagucuugguuucuuacuguucaguucaggcauccauugauuuggcuguacuugguuuccuuacauauccuuagauguccuagagauugcacaauguguccuuuacuucaauaacaacaaaauuaagcuaagaguaugugacuuacacaccuucucaacagggcuguuauuggguggcugcauacugauaucugaagaugcaggugcugccaagauuaaaucaagguagucuccuuugaacuuccuaguugcauucauuuuuaucucugggacuucuagaaauauuaguaauauuaguaauagagaaacguauuuagaauucauuacauuuccaaauuaggaaagcuuuacuuuuuuuuuuuaagagacaggaucuugcucuuucgccaggcuggaguggagugcaguggugugauaacagcucacugcagccuccaccuccugggcuuaagugauccucccuccucagccucccgaguaacugggacuacaggcacucaccaccaugacuggcuaauuuucuuauuuuuuguagagauggggucucaauauguugcccaggcuggucucaaacuccucggcucaagagauccucccaccuaggccucccaaagagcugggauuacaagugugagcuaccaggcccagccaagaaagcucuaccuucuguauccaaaaaucuguguguuuauggguaaagagacagcaagcagagaauucuaaauccuguggaaagugcuuugguugaacuaagcacaagaugcuaguuaauaugguauaguggaaagagccauggacuauaggacagauguggagugacuuucaauucuaucaguuauaaaaguuguauuaacccuaggcaagauaguuaaccucucuaagccuugauuuccuucuuuauaaaauaggggccaggugcaauagcucacgccuguaaucccagcauuuugggaggcuaaagugggaggaugggcugaacucaggaguuccagaccagccuaggcaacauagcaagaugccaucucuacaaaaauuacaaaacauaaaauaagaauaguaauaccuaucauaagcauugcuauaagaacuugaaaugaucuguauuauuuuccuagcauaguaccucagacaugauaccuccucacacaugaucaaaaagcaguacauauaacugucuuuacugugagagcauagaagccuacaaauguuauaaaaggcuuccaagcagagaucauauuugagaaggguguuaugacuugauaaauuuucacaaagugaacauaccuuaugaguacuauauucagguuaagaaacagaacauugccagaauuccagaaacuccccucauucuaucccccuaccccaccacauacacaaaaguaaucacuauccugagcauuaaauaaguguaaggagaugggaugagauuuguacuuuagaaaaaucacugugucuacaaaauagaggauggauugaaggaagaagagacaugaucagauuguacuucagaaauauucugucagcugggugcgguggcucaugccuguauucccagcacuuugggaggcugaagcaggaaggauuacuuggagguaggcaggaggaucacuggaacccaggaguucacgaccagccugggcaacuuagggagaccucaucucuacaacaaauuuaaaaauaaaaaaauuagcaugguggcacaugccuguagucccagcuacuuaggaggcugaggugggaggauuacuugagcccaggaggucaaagcugcagugagccaugauaacaccacugcacuccagcagccugggugacagaaugagaccaucuuuaaaaaaauuuaaaaauuuaaaaaaagucucuuuuuuuucccaucuaccguaugaaggauagauuuuguggauaaaacuagagggagagagaccaauuaaaagcagguacaggaauccaggcaaaugaugacaguagucuggaccaggcaguggcaguaaagaugaagagaaguugaaagucuugacagagauuuaggggauagaaucagcagugcuuggugauugauuauaugugaggaguggaagaagaagucaggcuguuuugugaaagggccauuuaucacaaagcaacccccaaaugcagaaggagcugagaaaccaaagaagaaggcagacaaaucuaguuugacaguuuuggaugauuuauuagggcaacuuauagacagagucguggucuugggugggugcaagacagguagaucuccacacugcaaccccccagacccagagccuauaccuuggggaaaaaaaacauauaugcuuuggaaggaauuuucgaaagucaaagcaguuuaugaccuuaaggcauuuagcaaaccuaauaucugaccugccuaauuuagaccaaaugucuuuauuuuaccaauaaucuuuaacauuuuuuauuucccaaagauuacuaaaguuacgugaacuaaaaggcauuacaguuuuuauuuuuuucaaaauauuuuauuuaagugcuuauuuuucuuuaugccaauuaauuagagcuuuuacauaagcaucacacacauaacauauguauaaacuacacagacagacagaagaagauccaguaguuguaagauuuuucauuugccaguuucuuaauuggauuacuggccucacgguagagcccuucaagaaacaggucuaggaaaacaugcaguuucuggggccuaauaagcaggcacagcuggaagacaaaaacagacccccaaaaucaagagucccguuuuuauaucagauccuggaucccaaaaagagggaauuagcccaucucccaugagagucuuaucucucagugaggagugggaacauuuccauaacuucuagguggccaagagcaugcuucucugauguaaacaugcaaagagccacguauucccugauaacugccauuagccauugucaaaaguauauuuagccuuagauuuucagaggaaucuauccaccacccauuccugggguuuuaugaggaaaacagaguuuuuucccagaacagggucugugacaucuccucuguuuuucacaaggagucccagucuauuagagcuugaauauccacuuuuaauuaagcugacuggccagaugcaguggcucacaccuguaaucccagcacuuugggaggccaaggcagguggaucacuggaggucaggaauuugagaccagccugggcaacauggugaaaccccaucucuacuaaaaauauaaaaauuauccaggugugguggcgugugccuguaauccuagcuacucaggaggcugagaaucgcuggaacaaagcaagacuccuuuucaaaaaaaaagauaaaaaacaaaguaaauaaaaauaaaagcacuaugguuaaaagucagcuuaauuuuuuuuuuuuuaagauggauccucgcucugucacccaggcuggaguacaguggcauaaucucagcucacugcaaccuccaccucccagguuccagcaauucuccugccucagcuuccugaguagcagggauuacaggcacaggccaccacacccggccgguguuuuguauuuuuaguagagaugccauuucaccauguucaccaggcuggucuugaacuccugaccucaagugauccacccgcuucagccucccacagugcugggauuacaggcgugagccaccacuccuagccauaggacucuuuuaaaaagcacuuuuaaauuucuuauuacccgacucuagccacacugacaauauuucuggcuuuugaacuuaaccaaagguaacuucccaggugcuuagggaaaggaaaauucaagaugguucauggagggaaagauaaucaacuaacaguaaaggucacacagauaucaaaccagaaaggacucauucccuaagccaggaauugaacccagggcaucacugugaaaagucaaagccuuagcugcugagcuacagcacuggugguuuccauugcucuucccacuguucccagaaggaaucuaaaauaguuaauuuugugcuugcaaaggcuuuuaacuacucaagauaauuuuuagagcuagcuaugacaugaaucccagaauuccuguucccuggaaggaagagaccgagagacauuauggccacaugguuacaaggucaaguugccaaggacauaaaaccagauggagaccucacccaguuuuuuuguuuguuucaaggaccugcaguaaaauuuauuaccagcuugcugggccgucuugagcaguuuaugggguccuaagccccuguucuauccuaagguacccuucuuuaugacagaacaacacagacaaauucauagcacaaaauacauuagauucguuacaacuuaauaugagccucagaauuuuuucucauuaaucaaaacuuuacagaggagauaaacagugauuuuuaccauucauucagccaauuugcacagagagagagagagagagagagagagagauugagaagccauaagucugacuggcaagaaauuuuuaccccuuugccggcaugucccguuucuggguuccccuucccugagcggcccuagcgacccugcuugccacaccaucgcuccuggggccaagcugcaucacaaaggaaaaucauggaaccacaggcaaaauccucuaaauuuuguaaguugccgcccaaacggcugcaugggggaccugaauucuaauauuuuccauucuggacguagcaaaauacaugugacaaaacauagacauuagccaccauauggaugcuuagcacccaauauugaacuggcaaggcccaaacuugcccccaguugggcccugucaucuguauccauuuuuaaccaagagggacuuuauugagggaagggccucucacccaaucccauccuuuacucagguaaaauguauccccauuacguauccaaagucagccaauuggugcugcagacuguuucuuuugggucagauaguaacuaagcuaaaagauuaguaaaucuaauuuuuuaaucaauuagucauuuaggugccuuucauaaagucuuuuuuuuuggggggagacagagucuggcucugucgcccaggcuggaaugcaguaaugccaucucagcucacugcaaccucugccucccgaguucaggcaugccucagccccccgaguagccaggauuacaggccugcgccaccauggcuggcuaauuuuuguacuuuuaauagagaugguguuucaccauguugaccacccgccuuggccucccaaagugcugggauuacagaugugagccaucgcgcccggccuucauaaagucuuuaaauaaaaauauugaaaucuuuuuagaagcgucugcauaucaguaagcaucccuagaugagucucaaugcacuucagugcauuguucauucggaacguucuacuguaaguuaucuuuaguaagauuucgccauuucuguaagacuucacugcuuaccagcuaauguauaagcuggaaggaauucaguuuuccaaaaaugaaggaucccauuuuuaccuaaaauauuugcuuugcucucagguucccuugaugaauuuagccaaugauuuuuccuaccuaagcacacaagaaaaaugaaacaaagggguagaacacaaacaucccugugaauuuucaagagccaaauuuuacaaccccuacaguauuaccauuuacaaccaguuucuuucugacccagucagauguaagaagccaaguaauuagcuggauccaagccagcuaauuacuggaucaaguccaauccuggacccacucaaguuucucuugugacuuccaaaccuaguuuggaucagaaauuugcucaaagaaacuuggacagcucaaaacacaaauccuuggagcucugaaaucugagagagagcuuacccacaauccccagucacucugagagaucaauggacauaaguggguccuugcagguaccuugcuuguucacucagcgcuccugggguuguuaaagcucuacuucagaucccacuucugacaccaucuguagaaagaaaagcugaauuaaguuuaaaggaguuuaauugaacaauuaaugauucaugaauuaggaagcccccagaaucacagcaaauucagaaagacuccaaggaugccucauggucagaggcauuugacaauuuuuagacaaaaaaaggaagugacguacagaaaucagaagugagguacaaaaacaacuggauugguuacagcucggcauuugccuuauuugaacacgguuugaacacucagcaguguaugaguaguugaauuauggcugcugggauuggccaauucucagcuauuaguacaggcacauacuccuaaguuagguuuucagucucaucuaccuauuaaguuaggaugcaguuuguccacaaggacucaaauauagaaguaugaaguccuucucaggccauauuuaguuugcuuuaacauucauaauuccacuacugugagauaacuauugugaacauuuuaguguauuuguuuccauuguuuuauuuucauauauauaguaagaauacaugcuugaaaucacacuuuaaaaauaaucggggucgggcacaguggcuaacgccuguaaucccagcacuuugggaggcugaggcaggucagaucaugaggucaggaguucgagaccagccuggccaacauguugaaaccccgucucuacuaaaaauacaaaaaauuagcccaacaugguggcaggugccuguaaucccagcuacucgggagcuugaggcaggagaaucgcuugaacccaggaggcggagguugcagugaaccgagaccgugccacugcauuccagcgagacucuaucuaaaaaaacaaaaauuugcuuuuuucauugaguguuauaagcauuuuauucuaucauuaaagaauucuuggccaggcacgguagcuuacgccuguaaucccagcacuuugggaggcugaggugggcggaucacgaggucaggaguucaagaccagccugaccaacauggugaaaccccaucucuacuaaaaauacaaaaaaaaaaaaaaaaauuagccaagcguggugucaggcaccuguaauccuagcuacucaaaaggcugaggcaggagaaucacuugaaccugggaggcggagguugcagugagccaggaucgugccauugcacuccaagcgagacugcgucuaaaaaaaaaaaaaauucuuuacagucacaguuuugccuauaugacauucuguuauagagguauuuugaucuaucauuguugaauauuuuauuguucuccauuuuuauaaauaacgggaauaccuuuuuuugaaagauucuuguuuauaaucugaugauuucaucuauucagcaaauauuuacugaguaauauauuuuccuuaggauagacuuauagaaauggaauuacagggugaaauuauaugaauaucuucaagucuuuugcuauaauguugccaauuauuuuucagagauuuuaucaguuuauacuccgacucccauuaugugacaguaacgguucucaaagcacucuuaucaguaaugaaaauuguuuugaaucaguuaauuuaguuggaggagaaauugcaucuuauuuuaguuuuuuacuucuuugaaaauauuuuauauguuuuuuuaacacauaucuguuuauuaagaauauucuuugcccuauucauagcaauuauuuugucuuuuuauuuggugggauuguuugcuaguagucaagucuauuguucuccuuugugauugcuugagaagagcuuaugauuucaugagauaagacagguguuucuaggaaggcuguguauaagagggaaaggagaaaguaagguugaccagggcacuguauccagcaaguggccuaggcccaggauguucacaaugguucacuguagcuuuguaacauuucuuggcacagcucugagcugccugcacuuuaacuaggaagcaggaagaguaauuguuuccuucauuauguuucuaagucaacugcaucauggggauugaccuaauguugagcuccagcagaggugggugggaccuggcagggcuguuucauagccucucuucaaaucauggauccucucgaagguucugccugauggggccaugugccaaggcucgucugcuugccucuugcagugacaguucuuuuuggucuguaauguaaauaucauggcccugaaauccccuagcuguccgugcuuugucacuucuucaaagggaacugacuuguuuuccaauggaggaggaacauuugcugccuacacugguuugaagcauuaaaaggggagaaaaagagcuaagaguaaguguugcuucauucuuuguauucacauggaaauuuuuaaaucuucaucaaaggaucaggagaaaaaucacauugaaauucaauacaagagcucacagcuuaacacagaauuuuucaaaauugauucuuuaaaaauugcagaaacuaugaacuguguagcuccaggguucauaguuuuccuuacccuccucagccucugccucugucuugccuuccuuucuaccuacacuccaucuguuugguuuugugucagcaugcagagcuuugaaugggggcugggagagguggugggaaguaugcagcaagucagguuuauagagcugcccauacuuucaccccucucucaggccucauuaucucaucucucagaauauuguaacuggucucccuuucuucaguuuccuuauuccaggcuuucuuccacauugcuaccagaauuaccuuaauaagagauaaaacuguucaugucacuuucuugcuuaaaaacuaccacuggcagccaggugcgguggcucacaccuguaaucccggcacuuugggaggcugaggugggaggacugcuugaguccaggaguucaagaccagccugggcaacauagugagacuuugccucuacaaauaauaaaaaaauuagcugggcaugguggcacaugccuguggucccagcuacuugggaggccaaggcaggaggaucacuugagcccagguagucaagacugcagugaguugugauugcaccacugcacuccagccugggcagcagagcaagaccccgucuaacaaggaaaaauuaccacuggcuucucaguccagacuuucuagacugcuacuguaacuccucaguggguucaucuuaccugcugccgagauagagacgauuuaucaagaugggagaauugcaauaaagaguuuaauacacauagaggcagcuaaacgggaaaccagaauuuuauuauuacucaaaucagccucccccagaauucugaggcuaggguuuuucaaggaugguuuggugggcaggggucuagggaaugagugcugcugauugguuggggaugcaaucauagggguguggaaaccaguccucugcugagcccaguuuuggaugggggccacagaggggucacuggucccaguggagucauccagucaucagaaaugcaaaagucagaaaagacaucuuaaaaagccaaucuuagguucaacaauagugauguuacuuacaggaguaacuggggaaguugcaaaucuugugaccuuuggaaaaaugauugguaaucaugagaauucaggccccucuuguaauccuaaauuuguacgcuuuuauuaguuuuauaaaggcaguuucauuuugagaagggcuauuaucauuuaaacuauaaacuguaauaaauuucuggcuaggcaugguggcucacaccuguaauccuagcauguugagaggccggagcaagcggaucaccugaggucaggaguucaagacuccugaccucaggauggucaacaugacgagacaccaucucuacucaaaauacaaaaauuagccaggcaugguggccggcgccuguaaucccagcuacuuggguggcugaggcaggagaaucacuugaacugggagguggagguugcgauaagccaagaucgcaccgcuacacuccagccugggccacagagcgagacuccaucucaaaaaaaaaaaaaaaaaaagaaaaagaaaaaaaagucaggcacaguggcucaugccuguaaucccagcacuuuaagaggcugcagcaggcggaucacuugaggccaggaguuugagaccagcuuggccaacauggcaaaaccccaucccuaccaaaaaauacaaaaacagccaggcauuguggcaugugccuguagucccagcuacuugggaggcuggagcacaagaaucacuugaacccaggaggcagagguugcagugagcugagaucaugccacugcacuccagccugggcgauagagcaagacugucucaaaaaaaaaaaaaaaauuagccaggcauguggcucucacaccuguaaucccagcuuuccagccacucaggaggcugaggugggagaaucacuugaaccugggaggcaaagguugcagugagcugagaucgcaccacuguacuccagccugggcaacagacagagugagacccugucucagaaaaaaaaaaaaaaaaguuuucucccaaaguuagcucagccuauguccaggaaugagcaagagcaauuuggagguuaacagcaagauggaguugauuaggucagauuucuuucacugucauaauuuugucacuguuauuuuugcaaaggugguuucaccacaaaaagcuuucgugaucuggcccccuugccuaccugauuagcuuaaccuucugcuuuuccucuuaaacucauacaggcuacuguccauuggauuaugaauuccuugaagucagaaaugauguauuuccaaggccuagcacaguaacucgcauaugcuugguaaaugcuacauaaauuaauuagcaauauaaaauucuaauaaggucacagugugagagaacacugaaaaacaugugcuaguuucucaucucucugcuuuccauugcuaaguauaaauaaaaacauaaauaaaaaacacacacugaacuaaagaucaggucccuucuuccccuaguacagauuccugaucacuuagacccaacauccugucucaguacccaccaggaagcacucugcuucuccgaacugccaagucaaugccacauuugaucucugacagucccaaggugccaugacaggaaaggauuuggcuuuuccuuguaugcacagagcuuuugauccggguauguuccagacagucagguuucucauauuuggccauucuuucuuucuaggucaauaacuucuauccggagugaacugauuccauauuuagugagaaaacaguuuuccucagcuuccucacaacagggacaagaagaaaaagaggaggaucuaaagaaaaaggagcugaaguccuuaggucaguucuuggguugguucaguaagaggggcaaggguagcagcaccuuuggaaagagugguugggcagcuuagcccagcccaagaugccugacucaaggcagcagacuauuucuagccuacgaggcaagacaggcuugccaacccacugagcucuggguaagcuugcucaggcagauucugccacugugcucucggcaacaggcuaaucaugccuccagccccauucucugauucauagcucugguuuggcuguguuccucacuagaccauuuugccuuuaaacuccaccugccacuucuuaguuccccuguucucuaggcucuaggcagccccguuccugauuaaacucaaccucuuuuaucaagggaaggaaagugaaggaauguacaauugcaguccaaccacaggccaacccaggugucuccgugccaggaucugaagaucggaucugucuuguuugcugucauaucccuaauccccggcccagucguggacucauaguagauauucugaaaaaguauuuaucaaaugaauacacugacaguacagcaugaugauuaggacuguagaacugggcaucagacaguucuggauuugaaaucugacugccucuuacuagcauugugucuuuuuuuuuuuuuauuuuuuugagacggagucucccucugucgcccaggcuggagggcaguggcgcaaucucggcucacugcaagcuccgccucccggguucacgccauucuccugccucagccuccccagcagcuaggacuacaggcacacgccaccacgcccggcuaauuuuuguauuuuuaguagagacgggguuucucuguguuagccaggaugguaucgaucuccugaccucaugauccacccgccucggccucccaaagugcugggauuacaggcaugagccaccgugcccggccagcauugugucuugaggcagguuacucaguccucugagccccaguuuuuuuaugagaaaguaaaagaucucaaaggaucguuguaagagcugaaaaacuagagcccugguacucugggcuccaaguucuguacuuucugucauagcacagcuaccagauaugguaauagagacuagcagcacaaagucaaccuggcuggccacuaaagccuggaugcuggcuuguguuauuucaugauuuacaagggucaucuguuuuauuuucccuaguggucuugauuaccggucacaugcuuuuaggaccucguauuaagcauuuuuauaucauaugauauuuuagggaaguacauuuccucuuuuaguuugacuuucucuuacagauuuuagugggauuuccucaggguucauguuuugugggugaguuucaaaggaagaagugugagcuguaaucucuuuuaaaacuuagagccaagcaugguggugcacaccuguagucccagcugcucaggaagcugaggugggaggaucccuugagucugggaguuugagaccagccuaggcaacauagcaagaccucgucucuuaaauaaacaaaaaaacaacuugacugagucuguaucuguucuguuaucucucucucauuuauuuccuugguuggguguuuguucugaagauaucuacaguuuuauaaaagaagccaauacacugaaccuggcucccuaugaugccugcuggaaugccugucgaggagacaggugggaagacuuguccagaucacaggugcgcugcuauguccacaucaugaaagaggggcucugcucucgagugagcacacugggacucuacauggaagcaaacagacaggugagagcaugaguuagaaaaucauggggcucuuguccuagaaacagacugagccacuugucuguuucuucauuagguacauaguaacuuguuaagaaucccugucauucccaagguugagcaagaccuggcacgucaagggagacuacuaggguacucaggugcagcaaaaagggaagcagggggccugguccauagucagggccucuauggcuccagggaaaggcuaagaucuucaggaaggcuaacuucuggccuuugggucagcagguuccuccuguucuguucagcauggggauaucugcaguacuuacuucauaauaagcagguaaauacucuguaaucauuacucugaugaaguaaacauaggcauacagaggaggcuucccugagaaggugaaggagcagaguauagaguggccagauggcaaagccucaggaaaggaaugacuuugagagagaauugucugcaaacagcauuaaugaggagucucuugcuagccccuccuuuuaaccuugaaguuugugagauauggggaacaaauagcuuccacugaaggagaagcaguguccucaaagauaagccaggccuuaaugaaggcaggggguggagagggggacaguaaagaggcugaagguauaaaggaacucuguauuguauaguaggcccaggaggaagguuuugggagggaggaauaauaagacuaggaaaaggaaaugcagagcaguaaaggguuuagaugagaauaagaaaagaguccgggcacggugucuuacgccuauaauccuagcaauuugggaggccgaggcagguggaucgcuugaguccaggaguucgagaccagccugggcaacauggcaaaauccugucucuacaaaaauacuacaaaaauuagccagguaugguggcauguggcuguagucccaguuacuuggaaggcugaggugggaggaucaccugagccuggaaugcagagguugcagugagcugagauugcaccaccgcacuccagccuaagccuaagcaacagagugagacucuguauuaaaaaaaaaaaaagaggauaggaaaagauaaauaauugagggaacuacauugggguggcauucaaggauaacagaggugagauaaugaaaagauuaguuauugacauugcuccugguagaacccugugaaaauauaauugcagguguagaccaggguggcaguggagcgcagaauaauauaaaagaaauuguugaaaauugggauugaggccgggcacaguggcucacgccuguaaucccagcacuuugggaggcugagacggguggaucgccugaggucaggaguucgagaccaggcuggccaacauggugaaacccugucucuacuaaaaauacaaaaauuagccaagcaugguggcaugcaccuguaaucccagcuucucaggaggcugaggcaggagaauugcuugaaccugauagguggagguugcaguaagcugagauugugccacugcacuccagccugggcaacagagugagacucugucucaaaaaaaagaaaaagaaaauugggauugacuccugaagaaaaccuggcucaggaaucuguaggacccacaccagauaaaaccucaggugagccucaaccuguauugguuacagauccaagggagucccaagccagagagcuuaugagaaaucauagcuagucccacauuuacccaugacuagcaucuuucacgcuggucuggaaagauguucauggauaaccugagugggaagacuuguccagaucacaggugcaccgcuguguccacaucaugaaagagggacccugcucucgagugagcaugcugggaaaaguauccuuugaagugccaacagggacuaugcagcagacgggccugaagggccuuggguggaguguggaagaagagaaccuagggcugggggcuuggaauuagccuucacauuccaguguagccgugcugacaaggccuccgucagcuaguguggcugccacgcacagugcucugaccagcauucugucuaugcuggagaaucauagacaggcgcacuaccugugccuuccuaauagacugguagccaaagccccccauaccucuaaccuuuccagguuucucacacuggagagggaauagugugaacuuccccuucauguuuucuuuuggcugggggauagaugccuucucagggucuguccuugauuucgaauuugucuaaaauggaucucauccucaccucaugcguggucacagugguccaggaggugaccaggaacccaggaugcuuaugaucaggaugcgggguguuccuugaccugaucaggccuccuuucccaagaggugguauguggguaucucaaagacuggucucagugccucccagccaagggacauggcauuacuuucaaggaggagcauucaaagcuaagagacugacaauaaggccaucuagaagcugcugcauaaauaaucuugguccuagggggaaugcagcagccuccugcucccccucacucagacaggaagcuauggcugagaacucccuguaucucugauugagcacuggguucuaccuaagguguuuuuuuuuuuuuuuuuuuuuuuuuuuuuuauugaucauucuuggguguuucucgcagagggggauuuggcagggucauaggacaauaguggagggaaugucagcagauaaacaagugaacaaaggucucugguuuuccuaggcagaggacccuguggccuuccgcagcguuugugucccuggguacuuaagaucagggaguggugaugacucuuaacgagcaugcugccuucaagcaucuguuuaacaaagcacaucuugcaccgcccuuaauccauuuaacccugaguggacacagcacauguuucagagagcacaggguuggggguaaggucgcagaucaacaggaucccaaggcagaagaauuuuucuuaguacagaacaaaaugaaaagucucccaugucuacuucucucuacacagacacagcaaccauccgauuucucaaucuuuuccccaccuuucccgccuuucuauuccacaaaaccgccauugucaucauggcccguucucaaugagcuguuggguacaccucccagagggggucguggccgggcagaggggcuccucacuucccaguaggggcggccaggcagaagcgccccucaccucccggauggggcggcuggccggguggggggcugacccccaccucccucccggacgggguggcugccgggcggagacgcuccucacuucccagacgggguggcugccggacggaggggcuccucacuucucagacggggcggcugccaggcagagggucuccucacuucucagacggggcggccgggcagagacgcuccucaccucccagacagggucgcggccaggcagaggcgcuccucacaucccagacggggcggcggggcagaggcgcuccccacaucccagacuaugggcggccgggcagagacgcuccucacuuccuagaugggauggcagcggggaagaggugcuccucaccuccuagaugggauggcggccaggcagagacgcuccucacuucccagacgguguggcggccgggcagaggcugcaaucucagcucuuugggaggccaaggcaggcggcugggaggugguuguagcuagccgagaucacgccacugcacuccagccugggcaccauugagcacugagugaaccagacuccgucugcaaucccggcaccucgggaggccgaggcuggcggaucacucgcgguuaggagcuggagaccagcccggccaacacagcgaaacccgucuccaccaaaaaaauacgaaaaccagucaggcguggcggcgcgcgccugcaauugcaggcagucggcaggcugaggcaggagaaucaggcagggagguugcagugagccgagauggcagcaguacaguccagcuuuggcucggcaucagagggagaccguggaaagagagggagagggagaccguggggagggggagugggagagguagagggagagggagagggagagcuaccuaagguguuuucugaucuuuagugaccaaaucucuguccuuaaggugcccaaauugcugucugcucucuguccagaagaaccaccaguccauucgucagcccagauugucagcaaacaccugguaagugcuaguguggccaggacgggcaugagauguucuuugggagcaucgagacuuguuuuugagaagccggauugaggccuuuaaguccugaaccucaucagccccagggaaaucacaguggguucugagaauaaaaucucacucaacaagacugccugggcaaguaaugaccuuguaaggaaggguccauuauaguguugggacucagacacaggagcucucaaucucagccugaaagacucuagucauggguaaaugugggacuaccuaugauucucauaagcucucuggcuugggacucccuuggaucuguaaccaauccagguagaggcucaccugagguuuuaucugguauggguccuacagauuccugagccaaguuuucuucaggagucagucccaauuuucuuuuucuuuuuuuuugagacagagucucacucuguugcccaggcuggagugcaguggcacaaucugucccccuucuaacucugauuugagcacacucuuuaagagagcacaucuguauacacaagugcaugaguguguauaugugucuguuguuuuauuuuguuuucuuggcaagagaggagggcccaugcuucaaauagguuugaguuggucucagagguguuguaugaccuuguggcccugagaaauacugaucauggucccucuugcugaagugucucuauggaaagaucccauuagaucccagcuugagggaucuggagggugguuugcaguugguugagauggguggacagaguuuuauauuuugccuuuuacagguuggaguugacagccucauugggccagagacacagauuggagagaagucauccauuaagcgcucagucauuggcucauccugucucauaaaagauagagugacuauuaccaauugccuucucaugaacucagucacuguggaggaaggguauguuucccccuguacccacuugaggcaaagauaauggaaaaaugccuucaaaauucugaaggaagguuaauuuuaaccuaaaauuguauacccaggcaaagugcuaaucaagagggcaauagaauaaaaacauuuucagauaucaaaagucucaa

SEQ ID NO: 191402 - RNA, 27949 nt, Homo sapiens
acgcuugcgcgcgggauuuaaacugcggcgguuuacgcggcguuaagacuucguaggguuagcgaaauugagguuucuugguauugcgcguuucucuuccuugcugacucuccgaauggccauggacucgucgcuucaggcccgccuguuucccggucucgcuaucaagauccaacgcaguaauggugaggagcggggucccuaggucaaggggacucgugagcggugagacgacugaaauuacugcccguccccggacacacagaugggcuuucacucucuuucucucccucccuccuuuucacacgcacucacuccgggucucugcacuggcagucauucuugccuacacaggggugagagucccugcgcuguacguggucccuuucgcaguccucugggagugggcggaccuucuccaaggcugguagaccucccagggaaguugggacuucuaaauucacuucccuuccaaaauucuccccugaaaaugcccugcucuuauggggaccucggucuccuggccccuuuacucucgaauaaauauugcgcaguugcgguaugucagguaaacgggacagacaagaacccugcgcuugaggagcuuguagucguucucucuuuugcuuaagcagguaccgcaguucuggcaggucugauacccgugucauuagggaaauggacagauaugaccgccagaaaugaguuaggaaaaccccaaaagggccagauccucaaugcuauguugaggaaaaguucaucuaaggguuguggggaauccugugcucaaacauaccuuuuguauguucucuuuuguaggcucuaucucucuuuuuuuguaggcucucuugaguaggggugaauccuuaucccaugcagcucaguuuaaaaaccuguccccagcccaccucacuguggauauucuaaaggugaagcccaggagauuuauuuguuucucuuaguuuuuuuuuuuuuuuuuuuuaagguagcugccuguuccuucagguuaacuccacuuugggaaucucuguggaauccuaaaagugaagcucucaggaaagagauggguaacucugguuuuuucauacuuuauagguuuaauucacagugccaauguaaggacugugaacuuggagaaauccuguguuucaguggaaugggcagaaggaggugccacaaagggcaaagagguagguucuaugagaauuccucuaccacauuuaaugucuuccuacauaaaggaucugugcagaaguggaaucugugagagccuaguuucugaugcugugcucuucucacucacgccuguaaucccagaacuuugggaggcugagacgggcagaucaccugaugucaggaguucgagaccauccuggccaacauggcgaaaccugucucuacugaaaauacaaaaauuagccagucgugguagugcaugccuguaaucccaacuacuugggagccugaggcaggagaacugcuugaaccugggaggcggagguugcagugagccgaaacugugccgcugcacuccagccugggugacagugagaaucugucucaaaaaaaaaaaaaaaaaaaaauuggcugggugcgguggcucuugccucuaaucccgacacuuugagaggccuggucuggaggauugcuugagcucaggaguucgagaccagccugggaaaaauguugagaccuugucucuacaaaaaaauuaaaaauuaucagggugugguggcucacgccugugguuccagcuacucgggaagcugaggugggaggauugauuuagccugggagguugaggcugcacugaaccaugaucgagccacugcacucuggccugggcgacagagugagaccuuuccucaaaaaauaaaaauggucuucuuggcugggcacaguggcucacauguauaaucccagcacuuugggaggccgaggugggcagaucgcuuugagcucagcaguucaagaccaggcugggcaacaugacaaaaccucauuucuacaaaaaauacaaaaaacauuagccgggcaugguggugcaugccuguggucccagcugcucuggaggcugaggcuggagaauugcuggagucugggaaagcacagguuucagugagcugaaauugcaccacugcucuccagccuccugggcaacagaaugaggacuugucucaaaaaaaaaaaaaaaaaaaaaaagaaugguccccuuccagaugcauugggauuuuauuuagucagguccauucuaaauugaagcaaucaauaauuuucuggguuuuuuuuguuuguuuguuuguuuguuuugagacagagucucacucugucacccaggcuggagugcaguggcgagaucucagcucacugcaagcuccgccucccggguucacgucauucuccugccucagccucccgaguaacugguacuacaggugcccgccacuacgcccggcuaauuuuuuguauuuuuaguagagaugggguuucacuguguuagccgggauggucucgaucuccugaccucgugauccgccugccucugccucccaaagugcugggauuacaggcgugagccaccaugcccggcucugguauguuuguagaaagcaaacugcagccaggcgcaguggcucaugccuguaaucccagcacuuugggaggccgaggugggcggaucacuugagaucaggaguuugagaccagccuggccaacauagcgaaacccccaucucuacuaaaaauacaaaaauuagcugggugugguggcacgggccuguaaucccagcuacuugggaagcuggggcaggaggaucacaugaaccugggaggcagagguugcagugagcugagaucaugccacugcacuccagccugggcaacagagugaaacuucgucucaaaaaaaaaaaaaaaaaaacaaacugcacagaauuuuagguuuuagaaaacuuugcuugcccaagcuagguucugcaugcacacuaccugugauaucaguuuggugaaugaaaucaauaaccugguugaggagacaaaaagacguuucugaaucaccaacuaaccaacuaacagaagacaacuugugaugaauggcacagaugagcauugcuagagcagcucagagguggaaacuugcugagaaugggcugggcuuagaggguggagugugaaggcuuagcugaagcagcaagauggcacacauggggaccaugaagaagcuggccacgagcagugcagggcccaggaugcuuggcagccgcaaaacagcugaaaaaggagacaaaggucuucaugucuggcacugagcugguuagguuuucuucuguaggcaguggggaaccuuggaaggauuuugaggagagcacugugacuaagacauuucuguucuaguggcauugugguguagugaaaaggucacugggcuaggaguaugaaaaccuggauucuagucuggcucugccacugcuuuguguucucaggcauguuucugccccucuucgaaguuuaguuuccucaucuauaaagugaggaugauaauaaugucuaccucacaggguuguugugaggauuuacucagcacauuuuuuggacugcuuccaaaaugcuagacacuuauugggugcuagggauacagaggugaaggagacagacucuuggacucucuuccauggagcuuaauaaaauaauacauguagcugggcacaguaccuguaaucucagcacuuugggaggcugaggcaggaggaccucuugaggccaggaguuugaguccauccugggcaaauacagcaagaccucaucucuacuaaaaauaaaaaacaauuagccagucauaguggcuugcgccuguggucccagcuacuccagaggcuaaggcaggaggauugcuugagcccaggaguucagggcuacagugagccacuacacuccagccugggugacagagugagacccugucucaaaaacaaauaaauaaaaaagauaaaacauguaaaaagcuugcuuagcauaguacguauaguagagauauuuaggugguauauuugagaaauaaaaggauugaauacuuuccauuaucugccccuaaagaauuaagagguuccuaaaauuccuuucaaccagcuauuaucagucuuuugugauuuguuuuuguugcuuguuuagaaauauaucccuuguuuuaccucagaucaaauacugcuuuuggaauaagauccgaacuucuuaguggggcauucagagccuuuucaagcucugguuuuuuuuuuuguuuguuuguuuguuuuuugagacaaagucucacucuaucgccaggcuggagugcaguggcacgaucucccucagugagccgauuucggcucacuacaaccuccaugccccagguucaagcaauucuccucacucagucucccaaguagcugggauuacaggcaccugccaccacacccagcuaauuuuuguauuuuuaguagagacaggguuuccccauguugaccaggcuggucucaaacuccugaccucaagugaucuggccaucuuggccuccuaaagugcugggauuacaggcaugagccaccacauguggcucaagcucugauucuaaucacccuuuuucuuuguaccacauacucuucuuccacauauccuaugcccuggcaaaugaggcaguuuacugcucugugacugccuaauucccugcugccuuuacacucuuauuccuuucuccugggauguucacccugaauuaucaacaugagaaucaguugauugucagagcaaggcuuaaaacucugguuuucgcgggucgugguggcucacacuuguaaucccagcacucugggaagcugaagcgggcggaucaugaggucaggaguucaagaccagccuggccaauauagugaaccugcaucucuacuaaaaauccaaaaacuuagccggaugugguggugcgcaccuguagucccagcuacucaggaggcugaggcggaagaaucgcuugaacccgggagguggagguugcagcgagcugagaucgcgccauugcacuccagcagccugggcgacagagugagauuccgucuaaaaaaggccgggcgugguggcucaugccuguaaucccagcacuuugggaggcugagguggacggaucaccugaggucaggagcucaagaccagccuggccaacgugguaaaacccugucucuacuaaaaauacaaaauuagcuggacaugguggcgcaugccuguaaucucagcuacucaggaggcugaggcaggagaaucacuugaaccugggaggcggagguuccagugagccgagaucaugccacugcacuccagccugggcaccaagagugaaacuccaucucaaaaaaaaaaaaaaaccucugguuuucuuuguuguuuaugcucucuguaguuuagggguuagaaaugggggagguauguaccaagagucuguggcugucccagaaguguggauagaagugugauuacugaagugcuugccagcuuuugcauuuagugauucuauccuccuuuuuuuuuuuuuauuuaaaucucauucugcuuugauuuccuuuguacauaugacuuauaauccccauuagaaauugagcucaugguggcagggguuguauaugucuuuuuuuuuuuuuuuuuuuuuuuuuugagacaguguuucgcucuuguugcccaggcuggagugugauggcgcuaucuuggcuuacugcaaccuccgccucccggguucaagcgauucuucugccucagccucccgaguagcugagauuacaggcaugcaucacaccuggcuaauuuuuuauuuuuaguagagacgggguuuuuccauguuggucaggcuggucuugaacucccgaccucaggugaucugccugucucagccucccaaagugcugggauuacagacgugagccaccacgcccggccuauauaugucuuaauucaucuuugacuaccuucccccuguaggcugcugucuucguggugccuaacaaauguuugaauaggcagcaaauaacugcagauuucuuuuuucuuuuucuuuuuuuuuugagacggagucucgcugugucgcccaggcuggagugcaguggcgggaucucggcucacugcaagcuccgccuccuggguucacgccauucuccugccucaggcuccugaguagcugggauuacaggugcacgcugccacacccagccaacuuuuuguauuuuaguagagacagggguuucaccguguugcccaggcuggccuugaacuccugaggucagguaauccgcccaccucggccucccaaagugcugggguuacaggcgugagccaccgcacccaguccugcagguuucaucucuaggcaguaaagcccucacccuagaguacaugcuucagcucugucacauuuugaaauacaaaguugggacaaauuuaauaugucugaaccuguuguaaagcuauccuggugaaguuugaguuguuccuggagaauugcaggacucugaugauguaaacuuagaauugugaccucauugcaggcaucaacaggaaauagguaaggcaugggcaggaagccguaacuggggaaguuucugggcccagaagaaaauguagguagucuuaggguuagguagcagcugucaggaacuugccccugcccauaagauccuaaagggcccccauuugacucucaccagacaguuagaacuuguuuccuccuccgugucagccaucaagaggugcuuggggggcugugcccagcaggaccucacugcccagcagaucagcaggggagccaaguggccuagaucugcuguggaguacccgacuguuugccugccugucugcccuccucuucaccucauucucaucacugacgucuaccauuggcuuggaaaucagaaacccauauccaucuagaugguaaaccauuauuaaggaguaacuauuuguuuuauagcuauucauacuuaguggaacuuaaaguugguaaaguuugaauuuagggguaccccugucuauagaaauuuaauuuuuucuauguuguuuuuuuguuuguuuguuuguuuuuuguuuuuugagacagagucuugcucuguugcccaggcuggagggcaguggcucaaucucagcucaaugcaaccuccgccuccuggauuccagcaauucucccgccucagccucgggggggccaggcacaguggcucacaccuguaaucccagcacuuuaggaggccgagguggggagaucaccugaggccaggaguuugagaccauccuggccaacauggugaaacccugucucuacuggaaauacaaaaauuagcugggcgugguggcgcaugccuguagucccagcuacucaggaggcugaggcaggagaauugcuuggacccaggaggcagagguugcauugaaccaagaucgcaccacugcccuccagccugggcgacagagcgauacucugucucaaaaaaaaaaaaaaagaaaaaauguauuuggauugaacaauguuguuucauugaaacuuuuacuugcuccuugcagauugauuuugaugauguggcugcaauaaacccagaacucuuacagcuucuucccuuacauccgaaggacaaucugcccuugcaggaaaauguaacaauccagguaggugccugucaucuggcugcagccagugcgccagagaauucacuuugcuuauugacucuuugcugauugauugucuggcauuuuagcauaguacaugggcccaggaugggcccuugagaauugauaagagccauauauugugacaauuugauuuguuuuucagaaacaaaaacggagauccgucaacuccaaaauuccugcuccaaaagaaaguaaguggauuucuacuagcuuacuaucauggaauuugugucaggaauuauguuucuaggacucagaguuguggaagcuccucuuuugcaggugguuucuauguggguugaguccugccuguguuccaagcaucuuucucuaugagaaagaauccaaucuacagcuaucaggccaaccuuuaagagaccuggugcauuuaggaaauuugcugccuggccuagaaaccuuuucuguagaauccagagccugaugcugaggagaguaggaaucagccauugguaggccuuuuuucuucccucggggcucagcccccucaguggaacaguaugccuuggaaagagauuuugaaaaugggagacacuaggccuguggguuguuuagaaguacaguugguggcgcuauagagagggauggcuggggcuggagagaauaacagcauugccucguggucuaggagguugggagucucucugcagaaguagucugugaaaaccuacuuugacaacaugauagacugugacucuaggggguaagcuucccaaaagauccagcuuaaagccaguuguaccuugaaggcuggugaccugcacagcucuccaggucuaggggucaucauugcccugaaaugauucagcuaccucagggacucacagaauacuuggcuggagcuucagguucugggggcccugaguggaagguggugccauugcaagcuugggccugacuauuguggugcuggcccuuucuugcuggguguaccguaaggucaugcaggagaguugggacucgcagcagucccauuccguguucauguccucaaaggauauugccccagcuuuguuuuguuuuguuuuucaaaggcagggucucacuugguuguccaugcuggaauaccaugauaugaucguagcucacuguagccuugaacucuugggcucaggcaauccucccaccucagccucccauguagcugggacuacaggugugccccaucacaccuggcuaauuuuuuuuuuuuuuuuuuuuguagagacaaggucucacuauguugccugggcuggucucaaacuccuggccucaagugauccuccugcuucagccuccuaaagugcuaggauugcaggcgcgagccaccaugcccagccaauagcuuuuuuucuuuaggauggagucucgcuuuguugccuaagcuggucuugaacuccuagcuucaagcaguccuccugccucagccucccaaagugcugggacuacaggcacacaccaccaugcccagcuacacagcucauuuuaauggaaaaaaaaaucuuuaaggcccugagcaguagcucaugccuguaaucccagcacuuugaggggccaaggugggcagaucaccugaggucaggaguuccaagccagccuggucaacauggugaaacccugucucuauucaaaauacaaaaaacuggccgggugugguggcucacaccuguaaucccagcauuuuaggaggccaaggcggguggaucaccugaggucaggaguucaagacuagccuggccaacauggugaaaccccugucucuacuaaaaauacaaaaauuagccaggcgugguggugggugccuguaaucccagcuacucaggaagcugaggcaggagaaucguuugagcccgggggggcagagguugcagugagccgagaucaugccacuguacuccagccugggugacagagugagacucggucucaaaaaaacaaagaaaaaaaauuacagaucauuuggggcuagaugugauggcucacaccuguaagcccagugcuuugggauguugaggcaggaagauggcuugaaccuaggaguuugagaccagccugggcaauauagcaagacucagucuuauuauaaaaauaaaaaauaaaauaaaaucauuagggaaauaggacgauuguaaaaauucaaaacauggauuauauauagccaucagccugaacuuauaauacucagaaacuggguagaaguugguuuuggcagagguugcagugagccaagaucaugccacugcacuccagccuggguggcagugugagacucugucucucaaaaaagaugggcugggcacggugguucacaccuguaaucccagcacuuugggaggccgaggcggguggaucacaaggucaagagauugagaccaugcuggccaacauggugaaaccccgucuguacuaaaaaaaaaauacaaaaauuagcugggucugguggugcacaccuguaguuccagcuacuugggaggcugaggcaggagaauugcuugaacccaggagguggagguugcagugagccgagaucgcgccacugcacaccagccugggcaacaagagcgaaacuccucaaaaaaaaaaaaaaaaaaaagauucauaauacuuuuucucaaggacuuagauuaggucucucucucuccagaaauguuuucaggauagcuauagguuccuguacuuacucaagacagccgcucuuugugggagauauccuugcccucaggagcuccuagauuugcacaauguggacaaagagguuuugggguuacugguacuuggucuuucuaauuuuuccuuucuaaggaauaugggaaguuggcgagccccuuuccugguagcugggaccuauuucaccuuguacagaaacuuggagguuugccccugaccacccucgagaucgugcagcacugacuggcuacugcucucgguucuccaggucuucgaagccgcuccacucgcauguccacugucucagagcuucgcaucacggcucaggagaaugacauggagguggagcugccugcagcugcaaacucccgcaagcaguuuucaguuccucgugaguaacgaaugugcccccaaccaccauguuugaggcccuggagcacauugcuuggucccugugcuagaauauccugagauucauccauucccccagcuucagaacuggucugcuccugcccuaccaacacggcuuucuuauuuggaaaucaucucuuuuuuaaaaaaacuuaauugaaacauuacacacacauaaacacagacaugaacacauagcauugaguauuuaguucugugaauuuuuguaaacugaacacacuuauguaacuaacaugaucagagcauuaccaguacuucaaaucgccugaguucaagcccuguuugucacaugggggcauguuuuccuguggccauggaaucagucuuuuggaagaggugaaagacuaggcagaagcccucugagauaguugaggagucuaaggucuaaguacacagagcauugaguauauaguucagugaauuuucauaaacagaacacacucauguaacuaacaugaucagagcauuaacagaacuucaaaagucccuguugggcauauuugcagcuccuaauucccccaaggguacccauaauccugacuucuaauagcauuaauuagcuuuuuuucuuucuguauuuuauuauuuauuuauuuauuuauuuauugagacagagucucacucuugucacccaggcuggagugcaauggcguggucuuggcuuacugcaacuuccgccuccuagguucaaccaguucucccaccucagccuccuggguagcugggauuacaggcaugugccaccacgcccggcuaauuuuuguauuuuuaguaggggugggguaucgccauguuggccaggcuggucuugaacuccuggccucaagugauccgcccaccucggcuucccaaaguucugggauuacaggcgugagccaccucgcccagcccucuuuuuguacuuuuuuuuuuuuuuuuuugagacggaauuuugcucuuguugcccaggcuggagggcaaugacgcuaucuuggcuaaccucaaucucugccucccggguucaauugauucuucugccucagccucccgaguaggugagauuacaggcaugugcuaccaugccaggcuaauuuugucuuuuuaguagagaugggguuucuccauguuggucaggcuggucucgaacuccugaccucaugugaucugcccgccuuggccucucaaaaguucugggauuacaggcgugagcuacugcacccggcccucuuuuuauaccuuuuuuuuuuuuuuuuuugagauggagucucgcugugucgcccaggcuggagugcuguggugugaucucagcucacugcaaccucugccuccccuguucaagccauucucuuggcucagccucccgaguagcuaggacuacaggugcacaccaccacaccuggcuaauuuuuguauuuuuaguagagacaggguuucaccauauuggccaggcugaucucaaacuccugaccucgugauccacccaccucggccucccaagguccugggauuacaggcuugagccacugcgcccggccuauauuaaauugaauuuuuuuuuuuuuuuuuuuuuuugagacagagucucgcucugucgcccaggcuggagugcagugcugcgaucucggcucacugcaagcucugccucccggguucaugccauucucccucagccugcaaguagcugggacuacagccgccugccaccgcgcccggcuaauuuuuuguauuuuuaguagagacgggguuucacucuguuagccaggauggucucgaucuccugacuucgugauccgcccgccucggccucccaaagugcugggauuacaggcgugagccaccgugcccggcuauaaauugaauuuuaagauuuuuuaagugagucagaugagguguggaaaauuaguaaauauaaauaaaaauuuguaaugugaauuauuugucagucuuuaauagauuauauaaauuagaugcaaauuguguaagacacacaaccauuauacuuuacauauaucaaauucagcucuaauacgaugaagguaaaugaaugggucaugaccacguaugggaaguaaugagguguuguggauuggaccuuucuguauugaaucaaucugguuaguuauugccccaguucccugucacccuagauuuucagucuuugcuccuguuaaccaccuggguuccugaggcuugagagaagucagaaaggccuggcuuuucucccuaagaccagaccuggccuggccugagaacccaugcuugggugaagucuaaagaguucacgcucucagaggcuuuucccuucaugucaaagcccauacugaacuguucacauacccuuuaagauauuuugaccccaggagccagcccuugcagaaagggugagagugugggcugaggugaagggaaaagcacaagcucugcacauacuguaagccuuaccgagcaggcaggucgcucucccggcccauaaccagggccaugggcucaggugagaugccugugguauacuugccugcuucuccagugacucuuguuccccuacagcugcccccacuaggccuuccugcccugcaguggcugaaauaccauugaggauggucagcgaggagauggaagagcaaguccauuccauccgaggcagcucuucugcaaacccugugaacucagguagacacacugagcugucugcuguucugcuucuagugaggcacagauaguuuacauccuguccuaaaccuggccuaccuuggcaccugaguucaagcccuguuugucacgugggggcauguuuuccucuggccauggaaucagucuuucauuaucaagacaaaacaagaacuguuucacuucugugguuguugagaaaguagccaagaugcauaggaagagcuuggguuagaacuggagugcaguuaucacuauuugacuucauauuggccaggccacuacuuuguggacuuguccaucccgagagucacaucuauuacuucuuuuugcauauagugauuuaagaguaaggaucuagagaaggccucucccugggaaaggcccaguacucaguaaauagccagagaagaguaggcuggcuuaaacugguaacagagugggcuuccuuuuuuuuucuuuuuuuuuuauguuuucauaguucggaggaaaucaugucuugugaaggaaguggaaaaaaugaagaacaagcgagaagagaagaaggcccagaacucugaaaugagaaugaagagagcucagguaccuuucuugggagacuaggguaaggguuuuuggacagguguccuuaaccgaaacucuacgggcaacagagauacaguugggccccagcauuucugaggcuccaguucuugaggccccaauucuuuuuuuuuuuuuuuuuuuuuuuuuuugcucuguugcccuggcuggagugcaguggugugaucucggcucacugcaaccuccaccucuggguucaagugauucuugggccucagccucccaaguagcugggauuacaggcaugugccgcuaauuuuuuguauuuuuaguagagacagaguuucgcuauuuugcccaggcuggucuggaaugcuuggccuuccaaagugcugggauuguaggcaugagcuguugcgccuggccucugacgcuccaauucugauauccaggaaauuuaacugguuuaucaggauucagagaacaaauaauucagaaauguuucugaaggcccucagaugaggaacauuucaugcugacugucuaguaagcaagcccaucacaugcucacauggcgugauggccagaggggcugcagggcacaauuggucugcucucuccuauccucccccaaguuguacguauuuggagggcagggacugcaguacaguccccuuauuuggguucauugcuucugggaagcccgaucugcugugccuccuaaaauguggaacuggcccuaguuccaguuccuagcgugcuuuggcguaugcuuaggccccucugccaaucucuuccccagugcuuuguaccuggcuucucaacccagagccagggcagggacuuugacaacuaugaaggguggugagcaaagagcuguugcugcugccgcauaggggucugagagcacuuauaucuuaacagucugcccuuuuucacucucgucucaaaccaggaguaugacaguaguuuuccaaacugggaauuugcccgaaugauuaaagaauuucgggcuacuuuggaaugucauccacuuacuaugacugauccuguaaguacauccaaagaacuucucuuucuuaaguguacaauugagagacagaaaacuucucuuuacaggaaugagggcaugcaggaaucuuuacucaccuuugaggguuuuauuauuauuuuuuuuugagauggggucucacucugucacccaggcuggagugcagugguacgaucuuggaucacugcaaccuccacuucccugggcuugagugauccuccccaccucauccucccagguagcugggaccauagaugcauuccaccgcacccuacugauuuuuuguauuuuugguagagacaggguuucaccauguugcccaggccaaucuggaacuucuggguucaaggaauccgccuaccuugacuucccaaagugcugggauuacagguguaagcuacugugccuggcugagguuauuuuauuuuacuuuuuuuugagacagagucucgcucugucgcccaggcuggagugcaauggcauggucuuggcucacugcagccuccaccucccagguuuaagugauucuccugccucagccuccccaguagcugggauuacaggcaugugccaccacgccuagguaauuuuuguauuuuuaguagagaugggguuuuaccauguuggucaggcuggugucgaacuccugaccucgugaucugcccaccucagccucccaaagugcugggauuacaggcgugagccaccaugcccagccgagguuauuuuuuaauauccuuuggugggcugaagcuagugaggcccacauggggaggggucugaucuuuauaaacuggguuccacccccauaccauagguuggcuagauuccugcauuaguaaaaaucaugaaaguagugcugaaacucuuguaggcagcagagugagaaaaaugggaacaaaauccagugcucccuucuugugcucuggaguaucuaauggaggaugcagggguccuaguguuagaucuuggccucugacugggccagacaugggauuggaaggggugggaguucuggacaagcucgcuuuugaaauugcucugacccuuugcuguugguugccuccucucauccgcuugcagaucgaagagcacagaauaugugucuguguuaggaaacgcccacugaauaagcaagguaaguccuguucagucaggaagaggcuucagacugacuaaugggccuucuguuuccagggagcacccccugaaauacucuccuucugcagaauuggccaagaaagaaauugaugugauuuccauuccuagcaagugucuccucuugguacaugaacccaaguugaaaguggacuuaacaaaguaucuggagaaccaagcauucugcuuugacuuugcauuugaugaaacagcuucgaaugaaguugucuacagguuagucccuugcauccauuuuucccuccuugugcccuuccauccccuuuuuuugugggacaucgugguaacacuacucacagacgugcugaauucugaggcucuuccucgcuucuuguguuuucuuugggucacacccuuuggcagcuuaguggcccauccuugaguggauacugaaugagguaucacccguuacgugcugaggcagggcuggccaggcuccagggguucuucugugccuuaugcagccacaccauugcccacugggguucacagauuuggggaacuccagaucugcucuaucugcuuuuuuuuuuuuuuuuuuuuuuuuugagacggaguuuugcucuuguugcccagacuggaaugcaggggcacaaucucggcucacugcaaccuccgccucccagguuccagcgauucucuugccucagccucccacauagcugggauuacaggcgccugccaucacaccuggcuaauuuuguauuuuuaguagaaacaggguuucgcccuguuggucaggcuggucucaaacuccugaccucaggugauccgcucgccuuggccucccaaagugcugggauuaaaggugugagccacugcaccuggccccagaucugcucuuucuaauacagcacccaguacccucauagggauauuuacuuauuuuauuuuuauuuauuuauuuguuuuuugagacagagucucagucaguugcccaggcuggagugcaguggcgagaucucagcucacugcaacccccgccucccagguucaagcaauucuccugccccagccucucaaguagcugggauuacgggcacgugccaccacaccuggcuaauuuuuuguauuuuuauuagagacaguuucaccauguuggucaggcuggucucaaacuccugaguucaggugauccacacacuucggccucccaaagugcugggauuacaggcgugagccacugugcccagccaguagugucucuucugcuggaagcuggaugcugagcuuaggcuuuuaugcugugucuccagggucagaggaaaggucagauggcuuagaguaugggccaucagcuugcuucugguuagucggcccagugaucccccaacacccaucccacugccaguuugcuaggaguauuucagauuuguaaagugggguuggggucaggugggaccacugaggcaggagaggagugcuauucuuagaaggaggaaucgacccuagaacucugcaguggaaggguggcaggacauguuccagggagcacaguuugggaacagauacaaauacucuaccccucuucuagguucacagcaaggccacugguacagacaaucuuugaagguggaaaagcaacuuguuuugcauauggccagacaggaaguggcaagacacaugugaguauugaggccuggcggggaaagagccuuucccuugugcaccccuggcucccuauaaagggagacaaugaguuuguugagaaaggccccuuguuacagaugccccaucaccagauagccuugccaugucagaugcagggaggggcuuuagguccagccuucuggcuuuguuguggcccacuguagugaaggagccaguagugcucugcucuaggccaacagcccuuuuccauggucuucuaccccuucccuuugcagacuaugggcggagaccucucugggaaagcccagaaugcauccaaagggaucuaugccauggccuguaaguacuguguacugcugcuucaggguugggcacagaaaggcagguuguuugcuuagcaaaguucucucccucagcccgggacgucuuccuccugaagaaucaacccugcuaccggaaguugggccuggaagucuaugugacauucuucgagaucuacaaugggaagguagcuggcaggaagccccuuguuuacacuguuggggcccagcacuuuuuaaaaccuugaagcuggcuagaaguugaggccaaaaaccuauuagcugauuagcugucaagccacugaugggccauucugcccuggcauacacauguaggugguuuaaucugauggugagauggcaccuaaguucaagaaguauggcaagaauacuccucagggcgcccuuucaggugcaagguuugccuguguguguccugaccucccucggccgaccuccuucaucccuucuuccccgauugugcacguucagucucauauucauucuuucccugcccgcaccaccauauaucucuuccaccccucucucuauucacugugugcuucugcagaguugcuuuccuuagagugggaucuagauaauaaaaauagcuaauauuuaucauuaauaagauauuaggggccaggcgugauggcucacaccuguaaucccagcacuuugggaggccgaggcgggcaggucaccugaggucaggaguuugagaccagccuggcuaacauggugaaaccccaucucuacuaaaaacacaaaaaauuagcugggcaugguuaggggcaccuguaaucccagcuacucgggagucugaggcaggagaaucgcuugaauccaggaggcagagguugcagugagccgugaucgcaccauugcacuccagccugggcgauacgagcgaaacuccgucucaaaauaauaauaauaauaagauauuaggagcuaugcacuauucuaagcacuaccugucucaccuuuacagaugagaugcaaggcuagagugguuauuaacuugcccaggcucacacagcuaguaaguuaccagagucacagcaaacugaggcaguucggcucagaucccaaguauauugaccucugcuaggcugacauccaucaguucguauucucugccuuuccugcugcuggcucuuguccgagcugggcaggcuaguaggaggaagcagucggguggggugccgggugcccaguggccuuagccucauucccccugccuggcacagcuguuugaccugcucaacaagaaggccaagcugcgcgugcuggaggacggcaagcaacaggugcaagugguggggcugcaggagcaucugguuaacucugcugaugaugucaucaagaugaucgacaugggcagcgccugcaggugagaguccuggugaggggaaggagcgaccuucucaugucugguuuaugaguaaagucuagcucugagcacauuucuguuuacccagagugcugcuuugcccaguuugguaagggcugcgaaggccucugcuuuacggggucucaauaagacauaugaccccagggccagaggcuuaucagaaccaagucaggucaggcacaguggcucacaccuauaaucucagcaguuugggaaaaugaagcaggaggaucacuucaggccaggaguuagagguugcagugagcugugaucgcaccacugcacuccagucugcaugggcagagcaagauccugucucaaaaaaauaaaaauaaaaacaagucaaaguguuaccccaaaggcaugcuuccuggcuucuuuggguucuccuugcucuucccucccuuugugguggaagucgggagcucugggucuguucugggcuggaaguaauggguucauacccccucugcacagaauuaggggagcacuuuuccacuagggcuguagacauugguacaguggggcgcuacgcagcuauagaggcccagggagggggcugcccucuacaggguccucaaguucuggcaggugguucaugacagcuucccccuucccuuugggcccuuuagcagagggaauuuauccuuccccguguccuucuagggcuccaggucugacaaaggcccuaguccagaauccaguacuaauuuggcugccaggaaaauguauuagguccagagcuggagggagaauugcuacccagggagggcaagauggaagccugggacaggaaaacaggacuuuuucgccuccuaaccugugucccucccuuccuagagaacuucuguggacuugggugccaugggggcuggugaccacagaaucucauaaccuuucuuuaccacagaaccucugggcagacauuugccaacuccaauuccucccgcucccacgcgugcuuccaaauuauucuucgagcuaaagggagaaugcauggcaaguucucuuugguagaucuggcagggaaugagcgaggcgcggacacuuccagugcugaccggcagacccgcauggagggcgcagaaaucaacaagagucucuuagcccugaagguaguggggcagcuagagcugguuggccgggagagcuacugggaagggauggggagggaucagugcaaggaaagaagggaccucaguuguuccugcugcccccacaggagugcaucagggcccugggacagaacaaggcucacaccccguuccgugagagcaagcugacacaggugcugagggacuccuucauuggggagaacucuaggacuugcauggugaguagggucacuuugaaggugaugguacaggaggagacagaguugcuuuccacagagacacuuaguccugucccugggcuggaagcucagcacugcuggcugccuggguuuccaggcuguaccgugacugggcuuccagacccugcuuuaaugcacgagacuccuuguggccuaaccaagcguggaggaaaggaucuauucccuuuaagauguguaggugcagcucuugguuugggagaggucauuccugcauuaccugaugaaaaggggguuccagaauucggaagaugggccuuugggucagcaggagagggaaguccuugucuuuuccauggccucccucagguucacuggcucccagccuagaaaauagaaauagccuggaucauaaggcuguguccuugaaugacguccucuuuccuguuuuauccccaagccccuguaugugagaucugccauccuuccccucaagagaauauucuccccuacccuuuggguaggaguccuuucaugaggaaggugggauuuucugacuaagcucuaccuaaggcauuauccuuuggccuaagggaacugaaguuuccagcagaagccacagagcuuuaagauaggaccuugggcugggcgcgguggcucacgccuguaaucccagcacuuugggaggccgagaggcagguggaucacaaggucaggagauagagaccauccuggcuaacauggugaaaccccaucucuauuaaaaaauaaaaaaaauuagccaggugugguggcaggugccuguagucccagcuacucgggaggcuaaggcaggagaauggcgugaaccugggaggcagagcuugcagugagcugagaucgcaccacugcacucuggucugggcgacagagugagacuccgucucaaaaaaaaaaaagaaaaaagaaaaagauaggaccuugguagcaagacugucucagugaaggaauaaugaagcaaaagauaauuagaugugucuuugaaagcaggaaaccaaugucugaggcaccuuaauuugcagugcccauggggcaaguggccuagcacagcgcggugcuaaaugacuccucccaccaauaccaugugggucuccaaagcuugaagaaacacccugacuggaggccccucagggacaggcuauauagcauccucaccgugccucucagccuuuaaucacccaccccucuuuugcagauugccacgaucucaccaggcauaagcuccugugaauauacuuuaaacacccugagauaugcagacagguacuaguaccuacagcuaggugggaugcggaacaggacugggcaagggaagggcagugaugagaggggaggaggcucuggggccucagggccuacuguauacuccucugugacucugaaccugaggcuugggaguuccgccgugaugcuaggucugucccaauccucuccgggcccugcuggagagucagcugggugaggggcuuuuccaguccagcuuuaguuuucucucuccuuggcugaaggcaagguugccauuccauccccuuggagccucaagccucgaagccugggcggugccacauuccucuggugaguaccaagggggugcugugggaucugagaccuccuuguuuccucagggucaaggagcugagcccccacagugggcccaguggagagcaguugauucaaauggaaacagaagagauggaagccugcucuaacggggcgcugauuccaggcaauguaaggaccaggaugcggccaagcaagacagaaguguggccugcugaggcggcaccugggucacauaauugucuuucuuuuuggcccucucaguuauccaaggaagaggaggaacugucuucccagauguccagcuuuaacgaagccaugacucagaucagggagcuggaggagaaggcuauggaagagcucaaggagaucauacagguaggcagcuggcccuggacagggagcuggaugcagcacggcccucaguaugcuccacaccauucccagaacaugaccugggccuuguucccacagguauucacauagcaagaagcagcccucuacaccagcacucuuuaauucuuugccuguuaacccagcuguucuucuaauuaucacaaccccuucugcagguuggcacacauaggcuuucugacaucacacuagccagagcuagucucuccuccacgcuccugauagaggauuugaagggugauccauaugcagggaucuugucuuguguuuuggugaauguugcaacucuugugcugaauccaagggccaaaaaacaugaaguauagguaauaggcccuaaggguaugacuugagaucaauccugucucuuccauucacaaacugauuuccuugugaaauucauuuagccucacugggccucaguuuuugcaucucugaaauggucaagguaggaugguuguauuugagcguucaguaauaugcuuauaaagugucagcacaguacccaguguguggucaggguucaguaacugguaggugccccugcuacuguaaucccuacuguggaagagcaagugacugggaggcaggaauuuacgucccaaugguggggcgcucagaggauugcagagcaggaaggaagaacuuggggcagguguaacugaggagggacugugaaggguaagugcucaggccucuccuccccuuccuggagugcucagggguacagaguuuuguaagcacauggcacuuucaggaugaaugagaggcucaccguggucagagcaaaaggagugaacaggugauggaggguaguuaaggcuguggacaggucaacagggaucugaugcuagagucuucuagaugguucaucucacaggccuggacugcaucaugaggaagccuuuggaggguguuaagcagaguggugacaugggcaugucagagcuuuagauauaucauauggccaccauguggagccugguuugggggcuugagaaaagcaaagguagaggcaguuaggagauuguuggaaaggguucaagaaaaacuauugccagccaggcgcgguggcucaugccuguaaucccaacacguugggaggccgaggcggguggaucaugaggucaggaguucgagaccagccuggccaacguggcgaaaccccaugucuacuaaauacaaaaaauuagccgaguaugguggcgggcgccuguaaucucagcuacuugggaggcugaggcaggagaauuacuugaaccagggaggcaaagguuguagugagucaagaucgugccacugcacucuagccugggugacagagcaagacuccaucucagaaaaaaaaaaagagaaacuagugccuagaccaaacuguguccguguucaugggauuggaaugaggacaugagauucaugaaccauuuagauauacaagcaugaaaaucuuacaagguaccccccaaaauauguacucucucucuauauauauauguuuuugagacagagucucacucgucacccaggcuggaguuuaguggugcaaucuuggcucacugcagccuccgccuccuggguucaagcgauucuccuuccucagccuccugcguaccugggauuacaggugcgugccaccaugccuggcuaauuuuuuguauuuuuaguagagaugggguuuuaccauguuggccaggcuggucuugaacuccugaucuuaagugauccgccugccucagccucccaaagugcugggauuacaggugugagccaccaugcccagccuauauaucugguugguuuuuguuuguuuguuuguuuguuuguuuuggggggggauggaguuucgcuuuugucccccaggcuggagugcaacggcaccaucucggcucaccacaaccuccaccucccagguucaagcaauucuccugccucagccucccaaguagcugggauuacaggcaugugccaccacgcccagcuaauuuuguauuuuuaguagagacgggauuucuccauguuggucaggcuggucucgaacucccuaccucaggugauccucccgccccgaccucccaaagugcugggauuacaggcgugagccaccacgcccagucguauaucuauuauuuaaaaagaaucauuugaccgggcgcaauggcucacgccuguaauccugucacuuugggaggcugaggcggccacaucaacuaaggucgggaguuugaaaccagccuggccaacauggugaaaccccgucucuacuaaaaauacaaaaauuagccaggcaugguggcaggcaucuguuaucccagcuacuugggaggcugaggcaggagaaucacuugagcccaggaggcgaagguuauagugagccgagauggugccacugcacuccagccugggcaacagagcaagacugucucaaaaauaaaauaaaauaaucauuuggccaggugcagugagucaugccuguaaucccaacacuuugggaggucaaggaaggaagaucacuugagcucaggaguucgagaccagccuggguaacauggccccaucucuacaaaaaauaaaaauaaauaaauaucccaaagguggugugugcagcaaaaauuauaauaaaaagaacugaggguagggauagcauuaggagauauacccaauguaaaugacaaguuaaugggugcagcacaccaacauaguucauguauacauauguaacaaaccugcacguugugcacauguacccuagaacuuaaaguauaauaauaaaaaaagaaagaaagaaagaaaaaaaccauuuagggagcagaauugaggaggauuuggugacaaguacggugaaagaauaaagucacucgggcugggcgcgguggcuuaugccuauaaucccagcacuuugggaggccaaggcaggcagaucacaaggucaggagaucaagaccauccuggccaacauagugaaacccugucucuacuaaaaaauaaaaaaaaauagccuggugugguggcgcguaccuguagucucagcuacucgggaggcugaguuguauaccuauuauuuaaaaagaaucauuugaccgggcgugauggcucacgccuguaauccuagcacuuuaggaggcugaugcaggcagaucaacuaaggucgggaauuugagaccagccuggcuaacaaggugaaaucuugucucuacuaaaaauacaaaaauuagccaggcaugguggcaggcaccuguaaucccagcuacuugggaggcugaggcaggagaaucacuugaacccgggaggcggagguugcagugagccgagaucacgccacugcacuccaaccuggcgacagagcaagacuccgucuuaaagaaaaaauaaauaaauaaauaaauuagcuggcuaugguggugugugccuguagucccagcuacucgggaggcugagacaggagaaucacuuaaaccugggaggcggagguugcagugagccaggaucgcacaccacuucacuccagccugggugacagagugagacuccaucucaaaaaacaauaaaaauaaaaucacucaaauuucuagcuugggcaucaggaccaaugauguuauucauuugacauaagagauggggauaagcuugggauaggaggccggaagugguggcucaagccuguaaucccagcacuuugagaggccgaggccugcggaucaccugaggucgagaguucgagaucagccuggccaacauggagaaaccccgucucuacuaaaaauacaaaauuagcugggcgugguagcacuugccuguaaucccagcuacuugggaggcugaagcaggagaaucccuuaaacucgggggguggaggcuauggugagccgagaucacgccauugcacuccagccugggcaacaagagugaaacugucucaaaaaagaaacaaagaaaacgaaaaaaacaagcuugggguaggaagagggugaauucaagcuaaggauuuccuuggggagagggugaacagccaggguaugggucagggaccagagguaaagcaucuuacucaggugucugcauugcaguugguaggaccccaggaaugauuugcuaaaugguuauugaacugacaagguccucccuguguuguagcaaggaccagacuggcuugagcucucugagaugaccgagcagccagacuaugaccuggagaccuuugugaacaaagcggaaucugcucuggcccagcaagccaagcauuucucagcccugcgagguggguguggcuggauggggugcagguggacgaugguggccucugcuggcucuugggcagcugcaggugauggcagcucugcccugagugaaugggggcuccucagacucucacuaaccccauauguaccgcuacccuuucuuccagaugucaucaaggccuugcgccuggccaugcagcuggaagagcaggcuagcagacaaauaagcagcaagaaacggccccagugacgacugcaaauaaaaaucuguuugguuugacacccagccucuucccuggcccuccccagagaacuuuggguaccuggugggucuaggcagggucugagcugggacagguucugguaaaugccaaguaugggggcaucugggcccagggcagcuggggagggggucagagugacaugggacacuccuuuucuguuccucaguugucgcccucacgagaggaaggagcucuuaguuacccuuuuguguugcccuucuuuccaucaaggggaauguucucagcauagagcuuucuccgcagcauccugccugcguggacuggcugcuaauggagagcucccugggguuguccuggcucuggggagagagacggagccuuuaguacagcuaucugcuggcucuaaaccuucuacgccuuugggccgagcacugaaugucuuguacuuuaaaaaaauguuucugagaccucuuucuacuuuacugucucccuagagauccuagaggaucccuacuguuuucuguuuuauguguuuauacauuguauguaacaauaaagagaaaaaauaaaucagcuguuuaaguguguggaa
